United States Patent 11,337,426 (BIOLOGICAL CONTROL AGENTS AGAINST FIRE BLIGHT) - sequence listing, part 5

SEQ ID NO: 22 - DNA, 203759 bp, Pantoea agglomerans NY130
gtcttcaagatttccgctctgcccgataaggataactggcatccgggactgcccggaaggaagctcagatgcggtcatcactattccggccgcttttacggaagcatcgagagaactgactaggagggtcatgtcaatatccccgggcataaagcctgtgacaggacggccaggcgcaggctgaaagttagcgatcagtatatcaccgcccatcccctgaaagacatttgcagattccagctgtgccatattgccaatgttaatgagcgcgacgacgatagcgctgcctgttgctatgcctataagagccagaacagctcgccggccaagataccgtatactgtccaccgcagctgtgaagatctgccaaaaagaaggtccgtaaatcttgcgacgtcgataatttcttttatctgtatctggcattcggtcagtcatttatctttcagccacctttctgccatccactacgaaacgtcgtttcatacgtcctgctatcgactcatcatgagtgacgacaataagcgttgtatctgagcgctcattcatttcgagcagaagttcaatgactatattaccgttaacgtcatcaaggtttccggtaggctcatctgccaggactatagcaggagacccgctcagagcccgcgcaatcgcaactcgctgacactgtcctcccgacatttcattcggacggtgattatgatattcccccaggccaacatttttaagctgtactgcagccatacggcaggcttccctgcggttcaggcctcgatacatgagcggaaacggcaacgttctcaagggcggtcagcctcggaaagagattaaacccctgaaatacgaatccgagatgcatatttctcaggcgggagcgttcatcattacctgcggaagagacatcctcgccgtcgataaaaattttccccgatgcaggcctttcaagtaagcccataagactcatgagtgtacttttccccgcaccagacggcccggttatggcgcaggtctgaccggtcagaacactgaatgacacatccgaaaatatttcgttaggaatggctgtttttttataaaaaaaaccaattttttcaagtgccatggcagggatctcatccagcactggggctgatgaaaaaggttttttttgcatggtttagatccggatactgagctggcacaataaggtaatatcaggtgagagggtcattcaaattctggctggatgccggcaaatcaggcctgatttgccggcaaactaaaaattcagttactgaggaatatcataattaacagttatttgagtgttgcctgtaccattgattatgccggttgctttattggatttaacctggtagtaaaggaagaatggcgtataaactgatttccccttaaaggcagtggttgaaccagactgagcggctgaaatgtctgtacagttggctgttgacccctgacaaagctgaacgttcagcgttcctttattaccgacgtttacctgacctagagcatactcgtaataaataattgaaattatagcattatctgaagggatgatagctccagctcgaattggaaagttataggtataccaggtattagctgacgtaacagtcattgattttcctggcgcactattgtaagcaccccccgttgcagcctgcgcggatgaagatagcattcctgcaaccagtacagctccgattaacgtgtgaagaacctttttcatttccattccttaagttttttgtaatgcatcagtaaagatttagttaataatattaattcgtgaaaacagcaatagctggaaggtttttttgttatctattttttcgctctaagacactgtctgaccaggaaacagttagaagcagcattatttctcaactatgtagaaagcggaccttctgttgaaacacaaaatgacggcttaaaacccggctgcaggaggggggggtggctaacgctaagtgtcggacagcagtttcagccagcaacaggacatgttcattcggtgggatcagcattgcattcacctcaggcagcaatatagctgcataaagtttactcactcaatgttgcattccacttaacttactttatgtggaatggaaaactacagtggtaatcgtaattcattgactgcagacaggaacatgaagcaaaagtaaatacacgctttatgcatgcattagctgtgaaaaacgggagttagtaagctcttgtgcgagccataaagtgatcacaactaggaattacccaaatctgcaaatgaattggccaggttagccatgcaaagacatacgaaaccgatggattcacaggtgttgacgctggccagtcaggtggttttagagtgaatagtccatcaattgcccctcaattcatgacatggcagtctcacttgtcagaataatattcagtaatgattatccagatatttacctgtcagaagtgcagtctggacaaattactttggtcagctttcatacattgtgcattcatccgcccgcaagccaccgctcatgaaggatttctgccacaccttcatggagtactactcaaagcggcgcaacaagccctgcacgtagcgcggctaccggcgccatcctgctggatcgcagcctacgcacgagagtggagcgccacatggcaaccggctggggtttgtgccccgagcatcagaagctgtcggacgacggttttgcagaatcggcgtcatgatctccagctagccttctctgtcgagcaactggcgaatacgctgcagcatccgggccttgtagatcactgggtgggtatcggggccgtgcacactccttgtggcgaatgtcttgacgaataactgtcgactcaggattgcgggttgatcttccaccagcgaggcctggacgaggtgaatgaatgggaggtcggacgcaatgccttgtctcccttgacatcgaagcagcccagcatcaggccgacggtgggcgcatcgtcgatagcgccgagactacttccgcaagttgggcagaacgcacggctggactgctccgaagatcgatacagcgctggtatatcgccttcgccggtccattcgacgtcggccttgtcgaaactccacccagcacagcgtcagactgcccgagtggcgttggcacatgctgcacgagcaggtatgcgaaaatcgtggttcaccttttgcgctgaatcgaatgcggccgcaaaagcacccaccggtatgtacgggagttctcatgggtcctagtccttgccatcactagctgcgtcaatgatcacactgagtttcagccactggttgacgaatggggtaagcatctgcaaaaagccgccgattatttgcggctgcaggaaaccaaacaacggggccaggcgaacgaaatgagcaataccgtcctggtgccctcgctcgactgccaccttgtcgcgctggttgaatgcgatattgctggcaacactcggcgagagccccttgtccctttcaagatgactcgttatgtgttcaggtcgatgcgtcatcggcagcctctctgtctgcggtcgtcaccgaggtcatctttgccagtcgcggcgcacaccattggcgcaagtcgtccatcaaagaataggccactggtacgaataccaagctgagcaaggtcgaggtgaccaggccgccgatcacggcaatggccattggagcgcgaaacccggcatcggcaccgctggcgaacacagcgggcaccatgcccgcggccatggcgatggtggtcatgactatgggccgggcacgctcggcacccgattgcagcagcgcctgcgcacgcggcatgccgtggcgacgcttgtcgataacgaagtccaccagcaggatcgagttcttggtgacgatacccatcagcatcagaatgccgatcaccgccggcaggtcgagcgctgcgccgtacagcagcagtccgccgatggcgccgccgagcgacagtggcagcgcaatgaggatcgtgactggctgcaggaagtcacggaacagcagcaccagcaccgcgaataccatcaggatgccaaagcccatggcaatgctgaatttgtcgaacatttcggccatgtattcggcatcgccgtattcgacctcacggacgccgttgggcagttcacgtagcgcaggcaaggcgtcgatggcagccagcgcctcgcccagcgtggtgccggcgaccagatcggcatcgaccgagacgcggcgctggcggtcgaagcgctcaatgcgcgatggtccgtcggcaaagcgcagatcggcgaccgcatgcagcggcacggtactgccgtcatccgcagccacacgtacgcggcgcagagtgtcgagatcgtcgcgcgcagattcggccagtgccacgcgtaccggcacctgccggtcgacgaagttgaatcgcgccgtattggcatcaagatcgcccactgtggcaatgcgcagtgtttcgccaatggccagcggcgtaacattggcgcgcgcggcttcgtccaggcgcggctcgatacgcaattccgggcgcagcagcggctcgttgacctgcacgttggcaatgccggggacgacgtggatctggcgacgcagtgcgtgggcggcttctgtcagcgtgtcggggttatcgccgacgagaattaccgagatttcgcgggcggcagtttcaccacgaatggccaatcgcagatcggcaacgctcgctagttcctgacgcagggcctgctcgaaggatttttgatccagcttgcgctcacgcggtggcaccagtttgatcagcaacgagccttgcgccacgtcgtcaccgcccgcggtggcgaagatcgcggccacttcgtgacgttgtgcgatggtgtcagtcagcgcttgcagacgggtatcggtttcggccagcggcgtgcctggcggcaatgtcacgtccagttgcaccagactgcggtcattgaccggcaggaagcctgtaggcaggagtggtaacaacgccagcgaaatcgccaggaacgccgcaccggccagcaccgtcgtacgacggtgatgcagcgcccagtccagcaggcgcaaatagcggcgcatcaagccaccggcggattgtgtgagatggcctgtgtgttcggccttgggctttagcaggtacgctgccagcagaggtgtgcccaaccgggccaccagcattgaggccagcaccgcgacagagacggtgacgccgaactggctgaagtactggccgatggtgccgccgatgaagctaaccggaagaaaaacggccacgatagtcgcggtgatcgcgatcactgcgaaaccaatggagtcagcgccgtcgatggcggccaagaacggacgcttgcccttgtccaggtgccgctcgatgttctcgatctcaacaatggcatcgtccaccagaatgccgatcaccagagtcagccccagcaaggtgatgctgttgagggtgtagtccagccaggccatcaccacgaaggtgggcaggatcgacagcggcaatgcgatcgcagcgaccagcgtggcacgccaactgcgcaagaacaggaataccaccaacaccgtcagcagcgcgccttcgatcagcgtggtcatcgcagcgcgatagctggaacgtgtgtagtccacggtgttggaaacttgctcgatgcgcacatcgggatgtgcgcgttgcaatgcactgatcgctgcttccacgcctgctgcgactacggtgtcgctggagccacgcgtgcggaacactgcaaagccaacgacttcctcgccatcgagtcgggcgcgggtgcggggttcggcgccgccatcgctgacctgcgccaaatccgaaaggcgtgcccagcgcccatccgacaaggcgatgggacgttgggccaagccttctacactggtggcgctgcccaaggcacggatggcccgctcgcgcccatcgagagtggcgcggccaccgggcacgtcaatgttggaatgcgccagttgcgtattgacctgtcccgccgtgatgccgagcgcttccagtcgctcgggcagcaacgcgacgcgcacctcgcgtccgatgcctcccagacgttgaacctgctgtacaccgggtgctgtcaacaaggcgcgactgaccgtgtcgtcaatgaaccacgacaattccggcaggcttttggccggggcacgtaccgcgtaatggaacaacgcgccgccttcgacatctaaacgtgagatcaccggctccaagatgccttgcggcaggtcggagcggatctttgccacggcatcgcgcacgtcgttggtcgcgcgatcggggtcgatgccgagctgaaattccaccgtggtcagcgataacccatcgctcatcgtggagctcaggtgacggatgcccgccagcccggccacggcagcctcaacccggcgcgtgatcgcgttctccagttcgctgggcgcggcacccggctgggcgatggacacggtgatgatgggaaaagtcacctgcggattggcattgaccggcagcttgacgaaggccatccatccggcgatggacaacaccaggaacaagacgatggtcgggatcggacggcgaatcgcccaagaggacaactggaagctcatggcgtgtatcctttatcagcgccgttggccattcgcaccacgtcgccttcgcgcacaaaagcgatggcttcacgcaccacgtgctcgcccggcgccagccctgcaacgacttccagcaggtcgccatggcggcggcctagtgtaatcaaacgccgcacgacacggccgtgctcatcgacctgcatcacgctggattggtgctcggctgtgattgtgacggcccgtgctggaaccgccacagggaagaattgcacaggcaagctgaagtgggctttggcatggctaccggcatgcagtcgttgcgtcctgctgtccgactgatcgagagcaacacggatgcgccccaagcgcgtgcgcggattgagttccggggtgatcagtcgtaccgtgccattgaggtcatcctccgcatcgcccacatgcaccttaacgttcatgccgatggcaagccaggaaagatcggttgccgtggcgtcggcatcgagttcgatcactccatcgccgatcaggcggaacaggggatcggaacccgccaatgcgccgacacgtgcgttgcgcgatgacaccaagccatcgacaggggcgaggatgtcggctttgccgcgttggctgagctggtcggcgacctgcgcttgggtctgctgcacatcggcacgcgccgcttgcacattggcagcggcggaggtggcccgcgcacgttgctcatcgacctgttgcgcactgaccgcgcccgagcgcgccagtggttcgatgcgcgccaacgtggtgcgggcttcggcttcatgtgcctgttgctcgcgcaacgctgctcgcgcccgcgacagtgcagcctccgcctgttgcaactgcgtcagcacatggatggtttccagccgcgccagcagttgaccccggcgcacctgttcgcccacatccacatgcacctcggctatgcggaggtcctgcaacgcggtgccgatggcgatgtcatcccgtgccaccagcgtgccgctcaggcgcagcgtgggcgtcaccttggtcggagctgccaccgcagtgctcacaagcaacggtggttcgctgtcaggtgcatccgtggtgcctggccatacccaccagataacgaggacaagtatcgccaagacagcaagcctcaatgaccatgggcgaccatgtgggggagagcattcagcggttcggcgtgtcatcggcgttatctcgtgatctggataagggaaagtcggaagcggatacgtgggtcaggttgtccagcccgcgcagtccgggtagccatgcggctgcggcaagcaggacaatggcgacaagggccatcgccgtgagcaccggacgactgccggtcaggtcgatggcaccaccggccagtagcactgccaaaggcgtggctaccagcgcggcggcggtcgaagcaccgagtacccggctgcggatggcgattggcgcacgccgcagcagaacggtggtcagcaaggggttgagtgggccggagcccaagccagccagaattccggccagcaaccgcaggccttcgtcattggtcaaggtgagcaggcagaacgccatgacctccagcgagaggcaggtcagcacgatgcggcgcagccacagtcgcggaccgaggcggccaaacgcaagtgcgccgacaatcgcaccgctaccggctgcggccagaaaccagcccagcgaactggccaccagcccggcctcgcggatgcgcaccggcatcacgaccgcatccagcgcgcccaacagaccgactacggcagaaccaagcagcagcaggctgcgcaacaaggggtcacccatcagaaagcgcgcgccagccagcacgtcgacggatcggctggcgtcctggctgcgacagcgcaggcgacggcccggcagagacagtctgtccaacaccgctgccaacagcgagcatccggccgtcagcagcagcgtgcgttccggaccgaacagtgcaatacccaggcccgccgctgccggtgccacgatgttggccaggctgccaaccagcttgttcagtgctgtggcgcgctccagtggcatgcgggccagtcgcgccagttcgggatagcgcgactcctgcgcggtcattcccgggccatcaaacaatgccccaagcgcaatcaaggccagcaggatcgccagcccaatccattggtgatctgccaaccagacgatcagcgccatgctgccagcgctggccagatcggcaatgaccgccaccgggcgcgcaccgaagcggtcgatcagcgcaccgcccaaaaacgatccgaggatcagcggcagcataccggcagcagcagccacgcccgtccaggctgcgctgccggtcatgtccagtaccagccaaggcagcgcgaccgctgccacgctgttgccgaacagcgaaatgccgctggcggcgatcacgcccagcatgggcgcacgatggcgcttgggaagcaggctcatggcgtatggttcgttgagcccgtgatcagaagctgtagttcagcatcacggtgccggtgacgccggccttttcttcgaccactggactgtccttggcacgctcggaaaactgcatgacgttgacggccgcaaacagcgtccagtacttgttaaagtcgtggctccagtcggccgtcagcgagtaggcgtagatgcccgactttggcgtgaagtgtgagaagcggctgcgctggctttgtgcctgggtcacaccgaagtacgtctgtgtgtagtcacggtcggccgcatgcacgttcatgcccacggtgatggtgtcctgggcatcgtcgaagacggtgctttccaggccaaggcggtagttattgccacgatcgcgctgtcccgccacgcggaagttggcttcggcattgacggccagccaggacgtgagctgttgcgccgccagcacgttgatgactgtgctgctcttgatctcacccatacccgcgagtttcttcgagccgggtcgccagtcgctgtccttctcggtgcggccgaagtcatagctcagcgccgaactgacgtaaaagccggattcggtcatgtattcggcacccaagccgcgcacgctgtcggcaaagaaaatgccgcgatacatcgccaccgtcggcaccggcagcaccttggagtccttggctcccaggtagcgcggtatcacgcctgcacccaggccgacgatgacctcggttttttcgccgaacaggctgggcggggaggggacatcctgcgcgtgagcggccacggttgccatgcagccccccgttaccagcgcggtcgccagcagtttgcgggtgcgtacggggcgtggagaggaagggaaaaacgtcttcatgaatgtttccttcggttttgacagacaaagcgggtcctacggccgcctgtcagtcgggtgccggaggaagaattgggcagtcgagggaaagcgcctaaaggcgcattgagtcgcttaaccggcaggcggctccaggaaacggcgcaccatgcgcagcagtacaggggtatgcgtgctggccttgaagtccgggtccatcaacgcacggccgacagcgccatcggccaaggcaatcagccaggtggctgcaagcgccggctgaattgtcgggtcgatttggcccttggcgataccgcgctgcaacagcgccgccaagttggccttgatctgtgcttcgttctcggcaaacaggctgccggtctccgaattactcatcgtctcggcggcaatctcgacgctgatgcgggcatagactggatcggccgactgttccagcaactcaatcgccaaggtttcgatggcggtgatcgcatcatcctcatcaatcaggcgagcgaagcgcgcattcatttcgttgcgatcttcctcggcaatggcggcgatcaaggccggcttgttcgggtagtagtggaacaggttgcccgggctcatcccggctgcagcgcaaatctcgttggtcgaggtgccatggaaacccttgcgggcaaagcaggtcacggcggcatcgaggatctggcggcgcttggcctcctgtttttcggggtcgatctttcgcattgcatcactccttggtgttaggggccagtgctgatttctcctgtcgctgaccgaccagttgaccgccgacataggccatgctagcggcgaggatcaacacatagcctaatagttcagcactttcttctaccgcgttcttgaacagcttcaggtactgcgcgtcgagcagtgcctgccacagcaggcgggaatagaccagcacaacgaccagtcaggtcagcatgtcggtactggcccgcgagaccagcagcctcgccatcacggcaatattgtcggttatcgtgccaaccccccagaagattgactgccgtctgaacagcatgggctggctgcggcgcaccgggagtcgccattcgggcggaatcacgcatcactgcgagaaccttctgatcatcacttcacctttactagactaagtagtcgatctattatttcggtcaatccggaacgtgtcaaccactttcgtaaccaaggactcctccatgtactatccaccccctttctcgttgcgcggcgtgtttcgacacatatatttattcacggccgttgcgctattgagcggctgcgtcaccctggggccgttacctgatgctgcgcagcccgtggcggctgactggcgccatcgcggtgtgctgaccaccgccccaggcgcggacccggccacgtggtggagtgccttcaacgatccggtgctcgatgcgctagtgacgcagacactggtgtcgaatctgaacttagcacaggccggtcatcgtttgcgctcagcgcgcgccttggttcgacctgcgctcgctcagcaacgcccgcagatcgcagccagtgccagcggacagtggcagcaacggctctccggcccgggcaacatcgactttcagcgtagtgagctatctccagacggcctgctgctgcgcgaggaaggacgcagcggcggagattggaaggctgggttcgatgcggcgtgggaaattgacctgtttggacgggcctctgccggagtcacggcggcacgggcggcagcagaaggtgccgaagcggaagcagagatggcccgtgtatcggtggtcgccgaggtagtgcgcagctatgtcgaactgcgagccgcgcagcaacgccaggcgctgctggcagcgaatgcggacgaccaaaatcgtctggtcgcactggcgcgtgagcggcgtgatgcaggaataggaagcgacctggacgtggatcgcagcctgacgatcgcagccgatactgctgcgcagttgcatctacagggcttgctgattggccaggccgcgcaacgaatcgcagtgctgaccgggcagccggtcgtcgatgacgcacttttgctggccgcgcctcaaccgcaggccgggttgacggcgatgccaatgttgcctgccgacctgttgcgggtacggccagacattcggcgcgctgaacacgccgtgacgcaggccgcggcggatctgggtgttgcagtagccgacctctacccgcgcctgagcttgaccggtgccttgcaggccacgggtaacctggtcggaactgtgctgccgggccgaacctcgcaggcgctcgctgggctttcgattcagatcccattgttggactggggtgcgcgccgcgccgtagtgaatgcccgtgaagccatattggcggcgaccattggaggctatcggcaggccgtactggaaggcatcgaagaaaccgaaaacgcactcaacgccgtcgagacgcaacgcagccggatgagcgaggcgtccgttcgcctgcaagccgcgcaacgtgctgattcccacgcggagatgttgaaccggcgtggcatgacctcgctttccgacaaactggatgcagccatcgccttgcgtggtgcgcaactggcaggcgcggaagtgatcgagcaatacgccttggccgtggtggcactgcacaaagcagtaggaggcgccagcctgcatacagcacaacccatgcacacgcgcatatgaaaggacagcatcatggaattgcgccacctgcgatgtttcctggctgcagctgaagaactgcatttcgctcgtgcggtaaaacgcctgcatattctacggtcgcccctgtcgcgtgccataaaagaattggaagaagagctgggagtggtgcttctcgcgcgcaccacacgcagcactcgaataagccgtgcgggcaagccatttctggagcacgtgccgcgcgtatttgcagccttggatcaggcccgtggcagtgttacagcgccagctaatgggtttcatgcacagttgcgcattgccttgtccgatgggatgatgccagcacgtttgcccacgttgttggcacagggcagtcaggacggacccgaagtcgatattcgtctattcgaggtgtcgctggcgaaacagatcaaagggctgcaccaagatatgtacgacgttggctttgcccagagcaatgaagtgggagatggcattctggctgagccggtttggcacgatcctttggcggtggcagcttggtctcaacttgcaagcgctgcaccggatgagaatttcgccatattttccgcttgggcttcttcgggtgttttccaccccagcgtttcccgtggccggccattgagcaggcgaacgatgtcgttgagcagcgtctggctggcgatcgacaggtcgctgcccttgggcaggaactgacgcagcagtccattggtgttctcgttgcttccgcgctgacacgccgcatgcggatcgcataaccagatgtccatcttcagccgccggctcagttcatcgtagctggccattttgctgccgcggtcgtaggtcaggctctcgatcatgatcacggcgcgctcttctggactcaggtggcggtaggttctggacatggcaacgccctggcatggagatgttgcacttggaagttgagtcttaggcgttcatcgccggcgaccggggattcaggaagggaggcggaagtaaggccgcgtcgccgaagccgagctggcaatgcacggacacgttaccgccccctcgaacgcgcagcccaaggctgcgcgttcgccgctctggaaggctatggtcgattgggctactatgaaaaaagtccgttatctgctggaaatgggccccgatacagtacgacctggctttctaccgcgacgctcttatgtagctcctggctcacaaagcagcagcctcgcaaagcggtccgaagtagagcttaactcgtgttctctataatcttttgagctctcagcgaattccctcgccgctggagttttttttgccttacatcgcgctgtccggtgaggtcctgcagccggtccggcgagcttgctgcatgatcggctctgtcaatccggccggttcgcttgcgtatccccctttttgtatcagaattatcctgtgcctgtttctgaaaccccgggcacgacgagttattctgaacctttttactggttcgcccgtcaagatggcgggttttttttatgtttatggcgcggcttcgcgacgttcgtgtacagcctgcccctgcgcgcagtccggcacgcacagaggcgcagcggcaggcaaaaaagcgaggggtatgcccgtacggccgcgcccgtcagacattaacagatggtcttcagtccgggtctggcagcgggcgtaaaggctggcagttgccttcctgagcgttattgcccgtccagggaggtcacgccggtcagcttatcaagggcttcatgactgatttcatcatccgcactgtcgaccgccgtggaaatactcagcagggcctgcagctcgctcaacaggatggcggcatcggatttaagcagttcgtcggactcagcagaatcaataacggtattgatcgccttgttagcgctttcaatcatctccgttacgcccccctcccggctcactgccagaacaagtgcgctgatcagcagcgactgtgcctcaacgcgcgctgtcagctgtttcatgccggcatcaatgtgtgaaattttagccagcatgctcagtaccacgtttttcattgcttccgctccggttaaaaagctgatgttacccccccatgtcggctctgcctacggacacgctctgaaaatactcccggcagccttggaatgtgcgcagtcatcaggaaataaatggccgcccgaccttctgttatcttcagaggagtgccgtcctgacgtacattttctgaaaaagttaacagccaggtgctattcggcaccatccagggtgaacagaatgcgcaaacaacgcggatttgaggtgatgggtacgtcagagcgcgggtcagaatatctctgtctgcttcctgactgacctgcagccgaaatgcgagctgcagcgcaggatggaaaagggccgtaagcgttctgacacaccgcctgtcgctgtatactcagtggagggaaaagggacttattgtccgcggccacatccggccgggggccttacctgctgtccggcaaatgcgcgatgtcaggcctgatgcggcccgcagggagttgtacataaattatccaccatttttgtggataacatcagaacctagctgaattcaccggaagcttatgcaatgtcctcaccctccagcggtcaggacattacatgcgtcctccccgccaggcaagatggattccggttaaaggaaaggagccggacgccttaaggcttccccggtggcgggttctgagcagaagacctgacaccagcgtattaacctgttgcgctgagtgcgtaggcagcctcatcatcaggcccaatagcggtccggcaggataaaatcgacgtgctgcaggcatcttcccgcccataattcgggtgagggcgtacatatcgctgtggtccccgaaggttcagaacgcaccaggggagtatctgctgacggtaaaggtatcgggcaggctgaaaaaggggcatgaagttacgaaaaggccgacaggatagcacggccctgaatcatttattaccgggattatctgacggatatttagacgggacgtaacgttgtttcatctgatgctcgtttctgacgtagtcttctccgcactcagcagaacagaaagccgtacccgccacggccgcttcatccctgcaccagatacacctgccgtccggactcttcagtccgggtttgcgggctgacagggcggaagcaatcagcgcctcctgaacttcatgtgccagatctgcgtcatccatcatatttccctgagcatgattgttattagttgttacaccggtgaaaaaacactcgttataaaccgggcattatcggtgattatagttcaggcatactgccattgagtaaaccacatgcgctggcagcgcaggaaaatacttacaactgcacaactctgcagtgtttactggcccgcagccggcatcctgattcactaaaatccctgctgttgtgtaagcgtcacgttcacaccgccttccgtttctgcccgtgctttctgccatggatgctttcgcgaacagggagattaacatgtacaaaatacgccttacaccagaaggcccggggtaactaccacactcagcctgcgattaaacgacgctttgcccgtcgcgccggaaaaaccggctgttcgcctgttaagatgaaggtggagaacatgcggcaatcctctgttcgctgatgggcacctgtcgcctgaacggtgtgtatcccggaacatcgctgcgttatgcggtctcatctgacgcttaaggttgtaacgggctaactgtttttttcaggttgtgaactgcgccagcccggcgtgaacctgcttttgctctggcgtatttgatgactgttaaccagcggatatcactgcagcagttaaggtgtgactccagcgataaacgcagctgtccccagcttatgatttgcaactcaggctgtttccggttcaggtaccccagctcactgagggcgaggtcgacactgcactttgcatccttcaggtttccgccgcactgataaattccggctatctgcctgattttttgagcacaattcccgacagctgtatttactggcaaagaatatcctgttttatacttttatacggtccttaaaaacttaacccagaacaggccgtaatggtactttcggtttaaaacagtttcatgcttattcagagacagggcagggttaatcggcctgttcctgaacccgtatccaggagcgggcgttccggataaactctcaggatgtaccgggatacagacatttcaaatcatcaggcaatcagttacggcaaaaaatccacgtccaatggtttataaaagtgcctgactgacagcgacacatcacccgtagtcgtcctttcgaacaacgatctgagtgatgtcgacggttagtaatatgcaacatctgcccccatggtcatcagctttgattcgaccggccacaagcgatatgcttgccccatgcgaaaactaagagaaagcccattgtcctccccttcagaatctcccggtcgttactctgtctcatctgaggaggcaactgaacagttggccgaagatctgcgaagagtggtcggcaatcttgtccgggaagtgcgcagtgaatcgcatacgccgtcttcagcacagtctgaaactttagatctgcttgaccgtcatggccctgcgagcataagcgcgattgctgcgcgtcgtcacgttaagcatcaaagcatgcggctggttatcgctcaattggagcagcagcaactggtgacacgaggtcttgatccgagcgatgcccgaaagcagctctttgagctgacccaccaaggtcgagccgcgcttgaacacagccgtcatcagcgcagtgactggttggctcgccagctcaaggaaaaaattacagcatcccagctgcaaacgcttgaaactgcggtcagaattctggagcaactgattgcaaccacctcaaacggtcaatcagtttgagcgcaaagccgccagcaaactgggcaacgaattaatcccccagtgctcgacatactggccattacggatgcggacgatgtcgatgacatcaatggacactgcacgccccgttgccgatataccgagaaatgccccggagtggcagccggtaatccgctttcgggtcgtcactttgtcgtcttccgcaacctgatccagcacctcgacttggagactggacaaccccggatgcagaacattgtgaaaggtatgccatagaccttccctccctttattctgaccggccgctgccgaatgattgatgaaatcttgcgcaacgagcatttcaaattcgcgccggttgcagttctcaataacctgatgattgaaacggcggacgatagctttgttcactgccgacataatgaccccttacgcctggatgcatagaaacctaaatatatacagttaaactgtatatatccagtgtctcgcgagcgcgagtgctaataccatctaggcattgatccatagctgccagcttcgacctaaagctatgggttcaggcagtgtaaaaaccctccacccaggtagaggacacctcggtcaacgcgctgaccgaaacggctcctctacagcgcgctgaagttcacctctccaaattatgtctttacgggcggttacgcccgtctacatttctgaacgatgtctcaggcggctccgtttcagcaataaccacgaatttcattcctctgcgccagtcgccgagctcgcggctaaagcttcgctcaaggcggtgacgaacgttttcaggcataaccagatcgggaaagccagaaaatagccccagcggcagcattgcctggaaccgtgcttcaccggcctcactccagcttgccgacatggaaaaccacaatgagtcgcctttttttcttttcggccgctctcaggtgttaccggttagcaataacctgtggcgtatctttcatggccatcagcaacagagattcttccagcagcatgagacctatacgaatccgggcagccgtctgctgcaggcgccagctcacccagctaggggagcgtttctttttatcgaaagcggggtgccagacattaataccagactgctcccacagcaggtgcagaagccccaggaagctcatcgatggccgccgtttgcgtttcacaggttcgtcgtctgagacgttttcagccggttttacatcagaaggtgcctttttctggaggcccgtgggcagtctgaccacaatggtgccatccgcagcagcacggaccgcttccccctgataaatctctgcctgaccttcatcagaccacacagaataaaaccggcagtcaggtttatgctcattacccgtgaaggcgtatgaagacagccagcagcgttcggtatcccgggagtaatgaaccttcagccgtctcctgacaggatcgttttctgccggccgacacctgaaggtcactactgtgttttttttattatcccgggagtgtttgaaccagcgctgccaggtggtagtttcattctgctggaaagtgtcagaagcctcctgctggccccgctgaccagtgaagtgaaccggataaacttttttcgttgtcatatacagtccgctcagcagattatatttagtctgtagatcatgaatagttgcactgtacgggcgatgactcggcccaaaggtggttaaattcattctgatattgctgactcaggaatgaattgcctcggataaccagggcattttcagccgatgatgtgtaattagacgatcccacttgcacgccgttttttcctgtcataataaattcgttatgcacaatactttactgtgtatcctttctgaccggaacacccgaaccggacagttcattaatcagtgaccagcggctgtaagttttcttttcatctatcacaactcttacgagtacgccccgtaatgatagcttctcaagcgcttttgctaaaagcacacgggtaaattcgtacagggacgcgtcggtagaatcggctcttgagcagataaggttgataatgaatatccgagcggtgtagtccagagaaagctcaactgcatgtcagcgcttgcatatgcagaataaggaaaatgacaaaaaaaatggttaatgcgattcagacgttatcgtatcgatagatacgctgaagactttatatgaacacctgaaatataaaggtgactcgaaagaagagttcgcaattacttcagcatacgatcatcgtaaggctgaattgacggtggaaaagttgttcgatcgcgttccggcacacatgtggaaattagccgaatgagagcctgtgtaatgtagcagtaagattttactggtaactggcggcgcgcgcacaaattctttgtgcgcgcgccgccagttgaacaagccgcaggcgcgttagtaataagatcatttatccacatttacacaggttcgatccaataacttaccaatttagatccttatagctcctaacagatcccgctacctctgaggccgcaccacatgtggtctgaagggcttttatgatgtgtggtggcgggataaacatgtgtcctgacgggaagttcgtgtgtgctggtgggctagtaatgtgtgctgttgggatgtaatgtgtgtgctgttgggatagaagccacttttattaacaggaagatcctgtgactcagaattgagataactatatgacagataagtcattcatcggcgatgcactttatagtgacatggtcagtaaagataaacagctcacagttaattctaataatactgttcagccagtggcactgatgcgccttggtgttttcgtgcctaagcctacgaaatcaccgggcgaaaacaatgttgttgatgcttctgaattgttttcacagctggagattgcccgggctgaaggttacgatcacatcaatatttcaggtcctcgactcgatatggatagcgactttaaagtgtggataggagttatctatgctttcagccgatacggactgacatcgaataaaattgaactgaaattcaccgagtttgctaaagggtgtggcttctctgctaaacgtatcgacggcaggctgcggctttcgatccatgagtctttggggaaattacgcaataaatcaatatctttcaaacgcggacgtgatgctaagggaagttatcagacagggcttttgaaaacaggctactttgatgctgaaaaggatatcgtccagcttgaagcggatgaaaaactctgggaactgtttcagctggattatagagtccttcttcagcaacatgccatcaaagcactacccaagaaagaagcggctcaggctatatacacttttattgaaagccttccagctaatcctattccggttagcttttcacgtttacgcgagcgtctctctctcagcagttttctgtgagtgaacaaaaccgcacgattaaaaaagcccttgagcagttacaaaagatcggttatctggaattttcactcgttcgtaaagcgcgagaaaatttcgttattattcataagcgtaatccaaaactcaaaccagctgacatatgaatgtgtgctatttggatcactgcacagcctttcacttcataataactatatatgttatcctgccagcgcacatgttcaggcaatgcattgttgcaggagtctgccagcacacatatcgaggacttttcctctgaatagaagcccgtcagcacacattatcgatgtattttaagcgcaactgatcccttccggaacatatgaacctcccgccagcacacatattgagggcttttactctgaatagcagcccgtcagcacacactatcgagtattttaagcgcaactgattcactccgccgcatatgaatatccctccagcacacataattatgaaacattcagaaaaggatatcttgccagtatatctttttttgtgtcctccaggctcagtttcccgccagcacacatgatcgtgactttcggacgggcttaaccggccagaacacatttttagttttacttgagctcgtatccctccagcacacatttctgcatccaaaaagaagaaaatagcctgccagcttaaatctcttggcttctgcacagtaaatgtgcgtccaccttattagtcagttgccgcatatagctcgttttagatgtcttttagagggactgcccataagtagaaccgccagcacacatgtttaagtcctgttctttttaatacctgccagcacacattttcctttgggataatgacatcccgccagcacacacgatctattgcttaattgtagatgctctgggctgtaagtctcctatggcagacattttattgtcttaaatgttgagtaaatgaaatttttcattctcttagcaaaatgaccgtactcagttttaattaaaattgtgcctccgccaaatttattgaagcacgtatgaatgacctttaaaacttctaaaactgtacaggcatcacctgaagagtaactgaaagacattgcttattatcgctgagataaagggaatttcagcctgaaataaaccaataaaattcaataaaaacagatggataaacgttataaggtgtggggtaaaatttatctgaatttaagtgttttactaatgctgagactgtgattaattcactatcaggacatcacttttgccagaaaagacagttatactgtgagctatattttttgctcatgtacaataaaatcatgtcttttcgaaaaatgttgctctggcgcttctgacatgtacaatcaacataaaaattgacaatggaacggttaaatgaaaagtcattatggtggcgtggacgagaccgcgcgtagggccagcgcaatgttgcgcagtatgagcgacgatatatctctcagaagaaatgagtttggtttggatcagtactatcagacattcacacgtaactctgtggcgaaccttcctaaactcagccggcgtgcagttgagcaggcgatcgatgaaatggaaacacaggggcatgtcttcggcagaaaagatgccggtaatacccgacactatgcgctgaccattaaagacgttgttgatatttacgctcaccgcaaagtgcctaaataccgtgatttacacgccggggaaggcccctttgtcgtctttgttgtgaatctgaagggcggcgtttcgaaaaccgtgagcacggtgactcttgcacatggtttacgtgttcatcaggaccttctacagcatgatcttcgtgtgcttgtggttgatcttgatccccaggcctccagcaccatgtttctcagccagcaaaacagcattggctccataatggagacggctgcacaggcaatgcttaacgatcttgacgctgagcagctccgtgaagacattatcaaacccacaatcattcctggtgtggatgtgatccctgcttccatagacgatggtttcattgctagtcagtggaatgatctcgtcagagaacatctgccggacaagttaccctcagaggttctgcgccgcactatcattgaccgtgttggcggggattatgattttatctttattgataccggtcctcaccttgatgccttcatgctgaatgctctcgcggcaagcgatttactgctcacacccacgccgccggcacaggtggattttcactcaactctgaaatatctcacccgactgcctgaaatgattgaacagcttgaagaagagggaatcacaccgcgtataaaagggaatatcggctttatgtcgaaaatgacctcaaaacgtgaccatgagatgacacatggtctggctcgcgacgtctttacgtcttacattcttgatgcggcactgccacggctggatggctttgaacgttgtggagagagctttgatactatcatcagcgccgatcccggttcttatccgggcagtgttgaggcgctcaaaaaggcaaaacgggaagcagaacgctttactcaggctgtatttaaaaggatcgagttcatcaggggtgtgaaatgaagaaagaaatggtgaagctgggccgacagctgggtaactcaagtttttcgaaaatgatgagtgagtcagacagcgagcgggtgtttaccctgaagtctggtgctcaggcccattttgttctgacaaagtttctgcatgatgatattgaagcacagacttttgtagacgcaaccgttaatggtcgtgaccaggcctttctgacgcgcgaatcggtcagtgatatttcccgtaccatcagactgcagcagttctttcccgctattggccgggaggtagacggacgtacagagattctcgatggttcacgccgtcgggcggcctgcctttacaacgggaccgcctttgaagtgctggtgacgcgtgatgcgttgtctctttctgatgccagacagctggccgctgatattcagactgccagagaacatacactgcgtgaactcggtaaacgattaaagctgatgtatccagcagagatgaatcagtcagatattgccgccgcagaaggactttctgcggctaaggtcacccgggcgtttcaggcggctgcagttccagaagagattattgcagtttttccttcggtcagtgaattctccatcagtgactatcagattctgcttgaggtgactgagagagctcggacgagaggcatcagcaccgaggcgttaactggccacgtccgtgcacgtatcgaaagtgacgcgcatcacgacaggggtgatcctacctataaggcaaagataatcagttattttcgcgctgaaagcgcagagcccaaaaaaggatcggccagcaagaaagtcgtgactgtaaaactggctgaatttgctgataaaaaacagtttgccagaaagaaaacggattcagataaacgggtggttacctatgaattctcgcgcctttctgcagcctgtcaggctgaacttgatgccgctgttagaagcgtcattgagcgtatggttgtgaatgaaaaagacgcataacttactgccagttgcgggaaattcagaagggggttcccgcaaaaaaaatcaattaactttatgttttttaaaataaaaagatgaaaatttcagtctgaaattcccgaaataatatttcttttaattgtcagcagctgacagggccggttctggtcaaagcaacagtgatatcaaagctgaccaacattaagcatgatgaaagaatgagacctatcgtataaaactcatttttctaaaaaaacaattctctgcgagcctgaacagaaaagatggtgtgtctggcccacccgagctgattcaactttatccccatcctggaagtttattcatttactccgcttcacctgaaacagaacctgctgtacgtcataaaattctaatccctgccttccttcaggagttacgtcatgttttgaacccttcacatacagcaggcatattgattactcacgtttcctgtatcctccgcggtactgttaatgaggcaggggtatgtcaggaccgggatagcttttcccggttgctgaaataaattgcggtacgacaaatcaggagaaaaagatgccgaccattactcatcttatgctgaagaacttcagaaaattcgattccctgagactgaatttccagcccgcaacaaatgttctgagcggagataatgaatgcggcaagaattctgttcttctcgcactggatcctgttctaagcggcagccagcgccgggtggaaatgctgggagttgaatccctgatttcccgccaggcagttatggcgtttcgggcggggcagagccgcgcagattcactgccggaactcatcgctaatgtttttctcagttacacaggcaatcccgatctgaacgggcgacaaaatcagatggaaagagatgctgacggtctgagaatgcatattgccctcgatgcttgaagagtatggtcaggacatcagtcatgtactggaagaggatccagccagcttcccgtttgaatattatgcggtaaaatttttcacgtggcccttaagccgtctttagtcgtcatgtcaatcatctgatgctcgacagtgcgcgcattgacaccgatcacgctgcacaggagtacacacgcaccctctacaacgttaaatgtcgctgtctcagacggtaccggctggaaaactcctggcgtcagcagaaagaccgtttccaagagctgcatctctcggccattattgaagagatcgaaacctgtcagtttggtatccggtcaggcatgcgtgccggccttgaagccagtcttgatattatagaagacggtatccccatccgtgatcgcggcaaaggcagacagtgcttcataaaaaccgaatttgcattgcgccggcgtgaacagcataaagagctggatgtgctgctgcttgaagagccggaaaaacacctcagccatgtaaaattgaagaaacttgtgagtaagctggcgcaggaaacggcagatgcaactgtttgtggccacgcacagcagtcatatctcatcgcgcctggagcttcgaagtgccatcctgctcggtaaaaacaggcctgtctcaaactctacgtggcctgttcgcgcgcccgggggcgcatctggtttttaccggaaagtcttcaccgtcaatttagacagtaagcgttatagaggagaagatcagcggggcagcagcagccggctcgcctcatgtacatccatggagaactgcacgccgagctggcgggtgacgtccagcgcaaacactcttgtataccactcggtggatttggcgtccttatggcttataagcgtctggatcaccttctgcggcaccaggtgctgcacgaggtgcatcgcgaacgagtcccggaacgttttcggcgtcaccggccggatggaaaacgtcacaccgtcacgcgccgccaccgcctggcttatcctgctgcgcgccgtgtcctcactcttgatgtcccagagccgcgcacccgcaggcaggcatgccgtcgtaaaccactccctcaaacgctgtacgaatcccggatcggtgagcggcatcgcgcgcggcgggttttccgtatctccgcctcggtttcccgctccgcctgctgctcttccttcgttggtcggccgcgtcggcggctgcgcacgctcaagctttcgctgcttgagcgtgcgcagcaccacgaacagggaagacagcggtgcgccggtcagcggatcgtccagcgaaaagtcctcccgcgtaagcggcagtatttcatcgagccggcctgcggtgttccacagcgcattgatgaacaggcgcttgcggagatcgagcatcctggacagcaggacggtcacctcgggcgccagcaggtagcgcggcatgtaggtgccgtaggcggctgccaggtttcgcagcgccagcgcgctctggtagtcaaaatagcgtgcggcgcccggagtggtcagattatgaccactggcgtcgctgtgtgaaatctgtgtcagtttgcggggcaaagtaccaaaactttcattctccgttgtctgccggtgtggaacgtattttcccctgtatgtccagcgaaaaccacgggaacaaatcggtccggatctgttttccagcttttctcccggatataaagaataacctgctcagtccggaataaacaacgggacgcctgcctctgatccgggtggcgactgccgcgtaactctatgaaggtataggggaagatcgaaaactggacgggtctgggggtgtatcaagcacttcggaattctgcccttatttttatgcataatttaaagatcgcacaatgtaatttatgttaaattaagttgacgatagccataacaactttccaggtttcaaatgctgctttaatattccatcactcctctggttttacgacttacgattatggatgattatgcctcggatattagcggtcgtgctgtggagttgtctgtttttaatcgataaaaattatcatgatgactccctgcatgagtagcggctctatcctctttggatacagacggttttctgcctgtgataacatgcggtcattatttttcagagccggtatcgatgaagaagaaaaacagcacaccaactcctcacgatgccacgttccggcagttccttacacagccggatgtcgcccgtgatttcatggaacttcacctgcccacaaagctgcgtgctatctgtgaccttagtacgctgaaactggaatctggttcatttgttgaagacgacctccggcaatatttcagcgatgtgctctacagcctgaagaccactgcaggcgatggatacatacatgtcctgatcgaacatcagtccactcctgacagacatatggcattcaggcttatgcggtatgctgttgccgccatgcagcgtcaccttgaggcgggccataaacagctgccactggtgataccggtgctgttctataccggcaggcgcagcccttatcctcactcaacgcgatggcttgatgagttcgatgatcctgtactggcggaacacctttatggcacctcgtttcccctggtggatgtcacagttattccggatgatgaaatcgcggaccatcgcagtatggctgccctgactctgctgcaaaagcatattcatcagcgggacctggctgaactggtcgacaggcttgcccctattctgctggcaggatatctgtcttcatcacaggtgatatcgctggtacactatattgtacaggcaggcgaaacatcggacgccgaagcatttgtacgcgaactggcacagcgtgtgccgcaacacggagacgcactcatgaccatcgcacagcagttagagcaaaagggcattgagaagggcatcgagcaaggtattgagcaaggtatacagctgggtgaacagcgcggcattgaaaaaggccgaaacgaaggcaaacttgaagttgctcgtaccatgcttcataacggcatcgatcggagcaccgtcattaaaatgaccggcctgacggaagatgatctggcacaaattcgccactgagtaattcgatagtctttctggacgtactgctgagccaactggctcagccttcctgttgtctcactgccccgccttgcggtcacacgcatgctattgtgtaccttcaatcatgttagcgggttcaggaagtatgttatcggtaacgatactgccataaccccttagtgatagttccctcttaacgcgcagtaaaaggtttcgaagcaccttaatctttttcgcgtcgctttacgttccgtattcaattcctctttacaacatatatccactgtagtcattaaaggctgtcattattgtcagtggaagacatcatcagctttgctaatttctacttagttgctgtttaatcggttttttctgcagttagcttatataaacctgatgctccactcagggccatttgccatccgcagcggttaagaagtgtttccagcccctgtacgagtccggtcattcgcgccattatcggtgtgagctgctgcccgttatcgtcaaaggcagcatccagacttggccgggacatataaattccgtttacggcagcgttaaggacagaagcgtacctttccgaccactcctggtcgttaagcagccaataaccccagcccatatctttcgccgtctccagggcatatgtcagtcggaacaagtcattctgcaaagataattcgccagtaccggaaacgccagaggtagtcgagcttaccggcaagctttgcgctaactccatactgacgcccctgttccagcagccactcaatgtcaggggccacctcccgggaaaagcgatgctgcttcagggctgtggccagccagcgtgtgagaaagagattttcctgagcagcagaacaaacagtgccgtcctgacgtgcaaatgcaagagccgctaaagcgcaccaagccaaatgaccggatttttgggtcagtgtcatgggagtttgtcctccatagaaatcgtattcggtattctaatgcgactctctgcgcaataaatcatgtacggaggatttttactttgcgggggcaatatactaaacatggcgctctgtatgagacgtaacggtaacagataatgtttgaaaatgtaaattcgttagtagtgtcagctactggcatacatgagtcgctttatacttattatgttaaataaagtacttacatcattaggagacacgtttcctctagctttaaccatcgttgatgctggtgtcgtgttgcttattcgagatgggttgccaggcgacaaagggcatagtagtccccgagtgtgagagtattttttgcatgcctcagcctgagaatgtgcgtaacctcctgatgatatgcattggccgcgttgtcgccctgataaactgaggcgcgcggatgttgattgctgagatattctctaaaactgcttctgagaaacgccacagaatcgttctgtcccctgtcagaatctatcagtccggccatcagcgcctgaaaatagtgcaccataccgatttttgaaccaaacatctgctgcagccgtccggcaaaacgttcgtgatcgcctgcgatgtgctcttcgcacagctgatagttccatcgtagcttcagcgtgaaggccttgaacgacagagcatcatgtggcgttaccccttgcgtggcaaacacgggacgtccgcgcgcaacctcttcaagcttttcgggtgcgtgtgtctcaatcgccatcagaaacgccatgaaaggcacgtccggcttttttaccgtggccgcaaccgctgcggctagccgatcgagccataaatcaaccgtgcgcagttgcatggaaaatccatctgcaatgccggtcaggatttcaatcaccgcgccctctcgctcgggtgagtcttcaagaagaatggcaccgggctcgctggcgcaataatgtcgcaacggcgtcagctggcgatagcgctctaagataaaagatttccggctgacctcattgagcgtcacagaacggttgaagaagcgatccagatatagccgcgagtcaaatccactaccgtatatcgccctgatagagtgctgcagctgagctttatcggtggctatcacgaataccacgtgttcaatgctgaaaatatgcttaatagtctcaagcatctcaacagcatacgttgggcggcagcgatccagctcgtcgatgaaaacaaatagtggatagctcagcggtggggatgcggtattgatgacggcgcgcagccagccagcgatgccttccctaaactcctctacgctattgccagcctcatcgtgcgcctgtagcgccgcttcgaccagctttgcgccaacgtctgctgagctatcgtcactcaaaatttttgccaaggcatctgaatcaatgccgagtcggcttttgagtagcgctttagtaacttctggcgcaacggctttaaacaggcgccacgtttcccttaagcagccgggaatcaagcgccgctttatcagtacgggcaatgaggctgcgacgaatttcggccacaacattcagcagcgggtcctgcagatggtcgtttttccaagcgtctacgtagacggtcggatatacactgcttatctcggcctgccagcggcgcagaaaccatgatttacccgcgccccagctagcgttgaggttcagtacgtagcaacccgtttcactttttgacagcagcagtgaggtcagaaagcgggcatgagacgcgcgattcatggcgtcggccggcaactcatcctgctgtagtgaccaatcgaatcttaggctttcaggaagtaatttcattgcatcctcgctttatgtctggcaattgtactgcgaaagcataggcttctcagctttcaggcagatctagtcgggagctatgatcgagtagattagcggtacgggtctagagaggatcgtcataccagttcccggaaaatcccatttttccaacgaaacataagctggcggctgcgtcataagcatatcaagctgctcggaagacagtgtgatgcttgcaagcgtagcatcggcagaagattatgaggcactggtacatttaaaaaccagattactgatttgtccatgttcgtattggcgcgggcggcaaagccattggttacagaccgccgacaggggctgtgacaatgacagaatatgatgagctgctagtggagttggttaccgcattataggtctgagcattactgagattgaactgcacaagacttacgctatccgcgtttatgggcttccaccatttgcagaaccgctgtccgtaaagctcagtgtcaaaacatctcctgccataaaatccgacgcgggatatttattgaaactaaaggagagtgacatagatcctgacaacacgttgatggctgcacagccattcgacagtgcaaacgcggttggagccgctgatatcattaatacagctgagaacagccgggcaatcatacttggataacaaaagcaggaatttatgggctatccctagagtatgtgaatagaatggttattgtgcgctactttagcaggagggcaaaaaatacaacgaggggattaaggcagggaaaaaggctataaagcctgtttaaaggagcatgatgggatatagagctttagaagatagcgtcagcaactttgaaataaacgagtgaatattaaaggtacagtgtaaaataattactggtgaaactattaaccttaaagattaattgtatgcttattattcataattttaacaatcatcttctattgatagtacctaagatgaaaatcttggcatataacacacaaagcatgctatatattttaatgttaattgtaaggttgaaaacgaaacagcattattcatagctaacatattttaaacggtaagaataacatgaaaagtgaaaaaagccagaaatggctcataaaaatacgtccatggtttctgtcgctattaacgcctacgctaatttcaacttttatagcaacgttatttatttgggcacacctggcgcgtattggcctaccggaacttttctttgatagtgtcagtttttcttcactttttggctatttgatggtatttgcctctgtcagcgttttactgttctgtgtggttctgttcacaccctcactactgacaggactctttatatatagtgacagtaagagcagcgaaccatcaaaggatttaacagaaaaaaacattcgtaatgttttcctgacatctatactatcggcgctgattttttttggctggtttttcatatcgaatttttctagccggatattaacgccaaaggtaccaatacaattaggattggtctggctctgcagtattttaatttcagtgtatcatcacgcttccctcacccgaacccgaaccattcaaatgggttttttgcagaaaatcggagtttttctttttacacatgttctgcagcctgcgcttttttccctggcggccagcgtctggatatttcctgttgagctatttcttcgcactctggaatttccagatggtacaagtgagttcaggcaggcactaaccatcattgccatatctatggttcttatcattttttctcttataccgggtgttgtctttctaagactaagaggacgaactggtttgctctacaagtttgcgataacaggtggtattatgggggggattctttttgtaatatgcttgtttgtacaaatggtcccggcaatgatcctgacaatgttcctgagaacaccgggaataatggacttacgtccttacattatggccgtacctgtcaattcatatccatcagaatattttagggaagaagattggaaaggtgcacgttcagaagatggcagattttacctgcttcaagcagttaaactatattctttaggcaatatcagacttatttgtccgttgagtataatagagccatggaggaagagtcttaaatatcaggtcttagataaagactatgacgacagcacacgaggagaaactgcaggaagcagtgacacattgccgcagagtgacgaataatgaacttttgacgcttgagcatttacctgagaagaaaccggtaatatcttagtccatgcggccatggccgtttagcttattacggccatggctatactatgattaaggccaaagtccatataatactagctatgtaatacttagtttaagtttggggcataaaatcacgcgccttatttgatatttgaataatcactttaaacagcattggcatcttacattcactatcttgagtgataacgtagttaacgcttaaaattcatgatacattatcattacttgtaggcattgctgagctaattgactcgctgaaaaaattatcaaaatgatttaaaaaagtttcagtcaaatgtccatggtaataagcataagcaattgaagatatatttttgttttgtggttttataatattgaaaatcaaagcgccatcatgtagggatggcttgaaccacgcttcagaattccactcctccgctttatgagtataatatatcttatctttacttctaatccaagttgttattttaccttttgcttcggtctgatcgattgcttggttaaacatgtttaaaagttcttgaggcttaggggttataaattttaaagacatttttactccataagatatattattttcaataaaattaaatttcacgcaatcatctaaaagaagaggtttttaagaagttatttattcttgcaaatattctagttcatccttcattgggattacttgttcataaagtctatgataagactttcctattgcccctctgaattgaaccaatttaggtgagttttcacctatgcttaatatatgatctttggtaatgccagggtatgggtctataaaaactatttctgaaatagcaagctggtatgccttttttgcacaaagctcacacgggcttgctgtggtatagagtctacctccggtaattccatggccaccatattttgctaattgtagaaaagcgttttcctcagcatgtaatgctcttgtgtgaacttgattactttgtttttcgatactattatgaatatctttaaagcaataagataagtttcttcctgataaagcgataccattattgccgatctgagtgaaatcaattaacttctgtcttgctttttccctgaatttttcattattcctttcatatgagctatatttcattggatcaaagtcatgcattaacccattgagtgaacgcattgcgcatggtacttgccccttagcaacatcattccatccgactgatttaactgagttatcctgatctgtaactactgctcccacctgcctagatatacagccagaatttaatttaacggtatatgcaacttgcattaccctttccattgaggtaggagatattaagcccggatgtttcatcaaagcaaagtaccaagcgagttgtgctttaagtatattattattatcgtattcgttcttagggttgaaaatgtgaatgtctgaaatctcgatgcattttttaatgtttggattagttaagtgtttatattcactttttccttttccagattcttcatcttcaattcttttaatctgttcaggtgagaatttatgtagtttttgaagatattttgtccgatgttcatctggagcattgattgatattaaatgaaaagctgcatacctgtctttgaaaaatttagcctcataagggtttctaatagcgtcaatgacaataaatgctttcccatgacttaactcccttatcaacttaattgctcgattgatcgtctcaggaagatggaatactgacttgggaacaaaatcttttacttcgtaaccctcttcaactttacctagccttcttatcgattttcctgcggcttgatatgttgatacatataagctactatcaacataatttaattcctttttgaaattctttgtgaaccttctaactattgtcaatattctaataaaacgcctcaggtttttatcttctaatttattatgattgttatgatcaaggagatgcttgactacatccatgtaaaactttttgatcaagtttttagaaaacacaccgctatctattaattttctaacatcagaaacattaactttcccttccgatgaagatgttatgaaatctataatttcagcattactcatcatcaataaataaactgagattaaatcgctaactttaatcgagtaaaaactatcccagtttttctctgtgaatttttttgcaatttcatacctgttgacatcaaggccactataaaatcctgagaggttattaacttcagggaaatttggttttttttcttcaagaatatttgctgtggtcgtacaacctgatccagtccgtcctgttaacccaacaagtataaattggctattctctaaaaaaagctcgctaataaacttttgatctctcatcgaaatttctcttttttataagaagaatttatggatcattattcatcttaaaatagcaaatatcaatataattcatcaattatataagaaatttcttaaaatctatagttgtcgtttgacaaccatagatagattcaacttcatataataggtgatttatgaactctgacggtctcatacctacgtaacacctcaatgtttaccggaccccgaagctaaccttatataattacctttatataaggccagacaggcgctctgaaaccctgtatcatgcggatccgggccggatcctgacctttgtgtagtttatacgggttgtagccgggtatgaaagcggctgaaaaacaggcagcgctacgtgaaatctggcgggtaaccaccctgcggtttcttcagaattcacgtatcgtcgccagagggtacatggaggaaaactgaacaggatgaacgatctttccgtttttaccggcctcatccccggagcagtaccggatgatgacctgaccgataggctggcggcttttgttcgtcaccgagaggccttttcgcacaacacgtggcgacaaatgctgagcgtcatgcggatctgctggcgctgggcgcaggcaaaccggcgctcgttcctgcccatgtcgccggaggatctgcaggactatctctttcacctgcaggccaccggccgggcaacgtcaaccgtttctgtgcacgctgcgcttatttcaatgttacaccgtaacgcggggctggtcccgccgacggtatcacctgacgtggtgcgcgccagaaaaaaaattaaccgtaccgccatcatgtctggtgagcgtacgggacaggccgtgcccttctgccgtccggacctcgaccgtctggatgcgctatggcagcattcgtcccgcctgcagcacctgcgggatctggctttcgtccacgtggcatacggcacactgctgcggatgagcgagttgtcacgtttgcgggtgcgggacgtcacgcgcgcggccgacggccgcgttattctcgacgtgggctggactaaaaccatcctgcattctggcggcatagttaaggcgctgagcgcgcgctcttcagaacggctgatagaatggattcgcgcggcgggtctggcggacgagcctgaggccgtgctgttctgccccgttcaccggtcaaataaggtgagcggcgtcccgaccgcgcccatgagtgcgcccagcctggaagacatttggtaccgggcaaggcggcagaccggccagacgtcccgcgcggaaaccaataaagggcgttacgccagctggagcggccacagcgcgcgcgtcggcgccgcgcaggatatggccagaaaaggcgtatctattgcgcagatcatgcaggaaggcacgtggacgcagacccagacggtgatgcggtatatccgcatggtcgaggcgcataaaggggccatggtttcgctgatggaagatgaggattaatctggtctgctgcgcgcctgttaaaaaatacgccggtatggccacctcccgttgaaatggattttaatgctaaattgcatattaaaaataattttgcctgaggccagctcccggcttttccgggctcattcttcaccgtgcttacccccgttagtgctgggtatgttcactcagaaaactaagtaattatagtgagttgtaaattacggtcacccattcacagcatacctgctgatgttaaatcggtaagctagtgtatgatttgctcttgcttttaatcaatatctgcggcaggtgttgtactttttcatgagttaggctcctgatatctgtgcggggtctgactgcgtagcatctgaacggaagaattgacatgctgctaacataggtgttttttcggatgccgagttaacctgatgaaatcatggataaaaatggattacttgctcagcatcagtcatcacccgcgcggcaacatcatgatatttgtcggcagagtctctacattttcctactggctgaataacgatttcagcacacgtaacatataatcgcgattaagctggcagagtcttcagcagacaccattccctcagcagcggaagatactccggatgaagagcaggcttaggagtcagaaaataatagtgacatagcaggaagaaatgtttatggccttctgacgcgcccgcaaacctcacgtgaggctagcggattgctcatatcctcagggtttcgcgccagatgcgaccccggcagactcaggccggtttggctggagaagatctgcacggctgtcagagcgttatactgccaggcgtgaattcatattcccgtgatgacttagcattcattcacctccgccctgcgtatctcgtgacgacggatgcatcacccgccagataaacttcatttttctaggctgaacggtcatcagaccttatctcagcatactcacaggacatgataaagcacgcaaaggcgggctgactggttatcactattgctgaacatgtcataataggcctcgcccggcttatcgaaatcgcacggcatgacgccagcttttgcataccggtagccttcccgccagattctggtcagtcctccaggcgctgacgcgataatgtcacgcgtgtcgtttcgtcggataatcgtagatgcggcaggccgtgtttgaatactgcggctcattatcgtgacgcaaggtgacgatcaacacgctgatacaccggcagcgtgaatgctactccctgagcttttccgcctcacgagcagcacagagcactaccgtctgccgcatatcctcaagccgggtgacgcactaccgaaaggagcgcgagttgactatctgttgctttggtaactgtgcatcctcatcacctttgagctaccgcatcatgcgctcaaccataacgtcaaagttcttctctctggcatacattttagagtgcctgacactcactacttaaagatccgcccggaatacggagtgcccgccatttccgcagacattctctggcctcacggcgagaccttttcaaaagcctcagaactgatgcctcccacattgttatggcgtcgaggtaaccccacgctgtcactgatagctaaatgctgcacggtaactattcagctaagcgaattttccgctctgtccccgcatagagtcttgcttaaggggcaattaagttaacgaagcgagcgtgccattaacattcagaagtgaaatgcataatttcttaactttacccttacactatgatattgataaccattatcatattagttctcattaacgacgccgcggtgcggtgacagtaaataacctttacatgaacagtttttacagcagaggatcatttgtatgaaggtttcttcccggtgcattgcattaacgctgctcgctacatcaacgctttatgcacaggataatgcagatgatgagctgatagttgatgcaactcgtaccgaaggttctcgcaatgactctcctcaggtcatcagagtgattaatgaaaatgagattagtcagcagcgacaaatcacgtctgacacgtcccagattctaagtaacctgctgccgtcattctcccctgcacggcagaaaatgtccggcagcggcgaaacgttacgcggccgcatgccgctggtaatgattgacggtattccgcaatctaatcctctgcgccctaccgggcgcgagatgcatactgttgatgcttccatgattgagcgtattgaggtcatcaatggcgcaaacgccagtaacggtatcggtgcgaccgggggggtaattaacatcatcacaaaacgcgcaaagcccggcactgtcaatcagcacttcagcgcggaagccacgacgccgacggctgaatttgagcgcgatacgcttgcctacaaaacgaattacagcattaacggcagtggggaatacatcgattatttgttcgcactgagttacgaagatcaaggtctgttcagggacgcagataatcatgcgattggagttgataatacccagggcgatctcatggattctcgtgcttgggacttgctggcgaaggtcggttactggctggataatgaccagcgcatacagctgagcctcaaccgctaccagctgaaaaacaaagaccactacgttagcgtcaccggcgatcgcgatgccggcatattgaccacttcaaaaaaaggcaggccggaaggcagcgcgccgcgcaacgatgtctggacgatgggagcgacctacgataattataatctggcgggaatgaagctgactgcgctggcctattatcagcgctacgaagcgttattcggcgcgacaaactcatcctctttccaggatcctgcgatcgcccctctcggtacactttacgaccagagccgcgcctttaccgacaaatacggcactaaaatcgctctcactaaagatgatatctgggacgaccacattaaggcaacggtagggttcgatacgctttttgacaattcaaagcaggatttatggtcaaccggtcggacctatgtacccgaaatcaactataccgacctgtcgccgtttcctgcagcttgagtatgcgcccgttgagtcagtgaagctcagcggtggtgtacgctatgaatacgcgcgtctgaacattgacaattaccagacgacctgggcaaacgatcgcgtcagcgttgaaggtgggtcgccctcctttgaacaaacgctgtataacgcgggaatcgtctggacgccagttgaaccgctcagcttatttgccagctacagcgaaggtttcaccgtgcctgacgtgggccgcgtgctccggggcatcgacacccctggcatcagactggaaaactacggcggcctgaaaccgatcgtcactaaaaacagcgagacaggctttcgtatccagcatgcgccctttgattttgaagcgagctactaccggtcttcttcaaaactggggagccgcgtggagctggttgatgatgcattcgtggcccgacgggaaaaaacggaaatcgatggcgtggaggtcagcacgggttacaaccttaatgcggatcacaagctgacgctcgcctggtcgcatatgcgtggccgttacgacagcgatgacaacggaagccttgatgcaaagcttgacggcctgaatatcgcaccggatcgccttatcgccagctggtcggcaaactggaacgcggagctgagcaccttcctgcaggccaactgggctatgagcaaaaaattcgacgatgaggaaaaggatttctccggctacacactggtggatgcagccataggttacaaacttccccgtgggcagctgagtctgggcatttctaacctgcttaataaaaaatatatcacttactattcacaaagtgcatccgtcgaccctgaccggtattttgccgggcggggccgcacggccacgctcggctatagtctcgatttctaaatatggcagccctgtcaccggggctttaacctgacgatgaaaaaccaattattattttcgccctttcgccggcgctgtctgcaggcgctgctgttatgcagtgtttcacccagcctgcaggccgtacaaccgcctgcacgtcgtgccatttcactgtttcagggcgccacagacagcatggcagcgctgggcatcatgcccagtggaatcgttgaatcctgggctgaaaagccggtctatcgttacttacgacagcagttttcaggggtgccgcagttaggcctggaaacccagcctgcgcttgaaaaaatagtgatgctcaggccggatatcatttttgcctcccgttttcgacatcaggacgttgcgccgttgatggaaaagattgcgccagtggtgctgctggatgacgtttttgagtttaaaaaaacgctgacagtcgttgcagaaaaactcgcaaagttaaatgaggccagagatctgcttcgacgatgggacttacggattgccgccctaaagaccctgttaagtatgcggttaggcgcacgggccagaacccgggtgtccgtcattgaagtgcgccccgaccacattcgtagctacgctccgcaaagctttcccggctcggtgatatccgaactcggttttgactggaatgagcaggttgcgcagtcgaacagcacgtcgttacgtttttccagcatggagaaccttccactgctggatgccgacatcttttttattctgctgcgagcggatagcccggctattctgcgtcagtaccggattatgaccgcacatccgctttggcagcaattgcgcgccgtgagagcgcggcagttatggcaagtggacagcgttccctggagcctgtccggtggctttattggcgcaaatcagatcctcaatgatgttgagctggcgctgagccgggggccaacgtgaaagcccgctttctgtcctgttgcagccttctgatgctgatgatgctgctcagcgtcatgtccggagcgcgcttctacccgctggcgcaggtggcggaggctttgtttcacaccgatcccgcccgtgtggctgacaccatcattcgcacttcccggttgccccgaacatgcctggcgatgggcgtgggtgcctttctggcagtggcaggagggttgatgcaggctctgacccgcaatcctgtagcatcgccggggctgttcggcgtgaatgcaggtgcggcgctggcgattgtgctggccagcagcatttttacccttagcatcccctggctgacacttttactggcatttttcggtgcgagcactgtcagtatgctggtgtggttcgccagcagagcgggtaatggacgacacaacccacttaggctggtgctggctggggtggctataaccgcgctgtgcaatgcttttacccaggcgattctgattatcgatcaggagacgctcgacacaatgctgtttctggctggccgggagcctgacgggtaacgatttgccgcatatctatgcaatgttgcttcccggcacgctgctgatagtcgccgcctgcctgtttgcaagccagatgaatgtactgagtgccggtgatgagattgccaccggccttggacaaaatatcgtccgggtgcgactgatcgccagcctgctggtcgtgggactggcgggaaatgccgtcgcactggccgggagcattggtttcgtcggactgatggtgccacatatcgcccgccagctgtttggcagcgacctgcgcctgatgctgccagcctgtgcgttgcttggcgcattattgttgctggcggcggatatcgttgcgcgcgtgataattttgccgcaggaagtgccggttggtgtcatgacagctttgatgggggcgccatttttcatagtgctggcgcagcgcagggtaaataatgtcagataaccgcgtttttcgctgtggcccattttcacgccagtatgccgggcgattgccgctggtgatgctactctgcatggttattttgctggtgattatgcttgcagcattaagtgccggcgatgtttccatgccggtgccccagacattgcggctccttgtacaacctgatgccagcgcgcagagctttatcctgcacgagctgcgtttaccccgcgtggcacttgcgcttttgtcaggcgcgggactgggactcgccggattggttatgcaattgcttgtgcgtaatcctctggcatctccggacacgctcggcgtcaccagcggcgcaagcgtcggggcgctgctgtggctttcgtttttcagcgtttccttcggcaccacgcttatgccagtggcggcgatgacgggagcaacctgcgcggttgggttgatattcctgctttcatggcgctgtggccttacgccgttacgactgattcttaccggcgtgggcgtatcggcaatcgcgggtgcggtggtcacgctgatcctggttttcagtccgctgacgaccaccttttctgcctgggtatggctcagcggcagcgtttacgctgcgacctgggaaaaagtgtggcgtcttctcgtcattgatctggccgcattaccgctatggctgttttcgctgcgttatctgaatgcgctcatgctggacgacgccctcgcgacaggcctgggtgtgcgggtgcctctgatgcgggtgctgctgttgctgggctgcgtgatactttccggcggcgcgattgcgatggtcggcgccatggcgtttgttggcctgatagcgccccacctcggaaggctggtcgtacgtcatggtctttttggccaggcgtttgtcactgcatgcggcggtggcgtaatggtggttactgccgacctgttagccagaacgctgttccggcctgcggatcttccggcgggcatttttgttgcgctggtcggcgcgccgttttttctggcgttgctgctccggcagcgtacgtaaactgatggagcagacgtgtcactttcaactcataagcttaacgtaagctattcacagcaacaggtaatccactcgcttgatctgaccctgcctgtagcgaaagtttgtgtgcttatcggcagtaacggttgtggtaaaagcacgctgctccgggcgatggcaagactccagaaaccgcagtcgggcacgatcatactggacgggatggatattcatgccagcagtacggcgcaggtctcgcgcaagctggcgattctgccgcagatgcccgtcccaccagaaggaatttcagtacgtcagctggtcagcctggggcgtttcccttatcaaacctggctgcgtcagtggtcagcagaagatgaaaaacaggtagatgaggcacttcgcctgaccagcactgatacattacagcatcgtcctgtggattcattatcgggcgggcagcgacagcgcgtctggattgccatgacgctggcgcaggcaactgatacgttgatgctggatgagcctacaacctatctcgatttagcccatcaggttgaagtgcttgagctgttacgcagcttaaatcagacacagggcaaaaccatcattatggttctgcacgatcttaatctggcctgtcgctatgctgatcatcttgtcgccatacgcgacggacgaatttttgcacagggcgcgccaaaggaaattatgactgaaccgctggtgaataaagtattcaatctgcagtgccggattattgatgatcctttctttcactcaccgctgtgcattccttttcccggagcattgcatgctgacgcctgaggaacatggatttttgcagaagacttttggcttacgtgccctagctgaggccgatgcgcgtagtgtgccgttagaatatgtgtttgatgcgcaatgttgcggtgagttgttacgtcgcgttatgccgttaacgggggcgccggatatggccattgccgcctcattattcgcaaagcgtctggcgtttctcgcaacgggcaatgtgctctatgcgatgagcgtatttgataagggcttaccattgtcactctcatcttgccggcttgagtatgcgcatgatgacggattatggacgtcgtcactgcccacagacatcacggcaacaggttaccttcctggtgagcgggatgcgtggcgtgagaacgttgcagaggcacttttcagcggttttctgtcaccggtctggcagagtctggcacaggtaagcggattacccgtgcagatactctgggagaataccgccgttcgggtcttttcgctttatcagggccggatgaataagctggatgaagagcagacgcagcgtcagcatgccgactttaactggctgaccggtcaggcttccccttccctctttggcctgccctggaacccgcttaaacgcttttacagaccgtttcagcaaaacgcagagggggagcccgtgcgctttcgtcgcacctgctgtttttattacaaggcgacaaaacctgccgagtattgcctcaactgcccactctgcagaccagcataaccggcggaactaaacaggtcttgtacctttatcacttacaggtgttcttagatgcattaataatatctgctgatttcctttacctcaaaaactacagcctcagccagcagctcatgatgagctcgcaagaaatggcgccctataaagagtcattctcaattaatgagatgtcataagatatcaggttattgatagctatagaaatctttgaggggcaggacaccagctgcttacacagacttgatgatcgatgtctgtaatggaccagctaaaactttagcattgcacagtgacgagggggttttcctattaaggcagaggaacatgggtattactcagacgctgtcagcgaatgctgtttactcaaaaacatatagatgaactataattactgataacacttggttataaaggggacttttttcacaggtgtatcaactgacaataattcacgctcaggggaagatgatggatgatgcagatttagcacatgaagtacaggaggcgctgattgcttcagccctgtccgcacggaaacccggactgacgagtccggacggcaggtgtatctggtgccgggatgaagctgctgtagcgggcacggctttctgttctgctgaatgcggcgaagactacttcagaaatgagcatcagcttaaacagcgttatattccgtctaaatacccggcatagaactccggtaataaatgatctagggccgtagtaccctgattgccttttcgtaacttcgcgttttcctgtcagcctgccctatactttttaccgtcagcacacaactgcctccggtgcatcctgaactacaggatttacagcgggctcacaccagcgtcgcacgcaatttatttatctgcaggacggcgtctccggtgagctgttctgtttccctagactgattcattatatggtgatcccatgcacaggaagtttacgactaaactttattgttttttctgcacattaccggacatggccgccgaaaaaggcgggcgggggtgtgacaatcacttttacgaaacccgttcaatgacggagcatagatgttcgggctcgggaaactatacgattctgttcaataagatcttcggcaccggttacaatagcgacgactttctggagcggcttcaggtattcatggctacaaagaatgagccgttaagactcttcagtgaggcctctccagaactgtacattacactgaacaacagtcgtatatgcacgcctttatccgtattatgggcgggagagacaacttaacttctgcttccggatgcaggtcacttgccttaagcgggtggattttattctgatgaccacgcgggacgggtgctgtctcggtatccggtttgacggtgtggttgtcagcgcaacagggccaggcgtcggtgcgccgtcttctgcttctgctctgatccgccactgaggaggccttcaggcgtctgactgatgctggcacctttcctttaaccggaatccatcttacctgcggggagcacgcatgtaatgacctgaccgctggaaggttgggatatatagcacagactcccgttgaattctgacacgccccttacgttatccacaaaaatggtggataagttatgtacaactcccgtgggcaccatcagacctggcggcgggcttataccggatgagataaaagcccccagcaggcagcggcctctgaacattagatcctcttccccccgtcacaacatagacaggtggaaacggcatccgccttttttctggcatttgcaccgtccggtactgcagcccgcgcatcagtgtcagacggtgcgacatgccggtcgccgccggggctggtaatatcgttatattttaaccggcaggtccgggaagccgtgcaggtaacgcccgaatggcgtcaaagcacagtgtgcataacatgccagctagagagtaaagacattcttcttttcggtaaacggtggattttttaggggctccgcttcttcacggggtgtaaaagacagggcggcgttgtgtttccggatggctcagcatcccggagctaagacagaccatttctgagccgagggccgcacgcatttcaggattaccgtatgtattttcagagcgccgctgtaggcagggctggcaaggaggagtaaaatcgccctttttaaccggagcgggagcggacgctatgaaaaacgtggtactgagcatgctggctaaaatttcacatattgatgccaacatgaaacagctgacagcgcgcattgaggcacagtcgctgctaatcagcgcactcgtcttggctgttagccgggacggcggcgtaacggaaatgatcgaaagtgctaacaaggcgatcaataccgttattgattctgctgagtctgacgaactgcttaaatccgatgccgccattctgttaagcgagctgcaggctctgctgagcatttcaacggcggtcgacagtgccgatgaagaaatcaatcatgaagcgcttgataaactgaccggcgtgaagtccctggaggagcgataacgttcagtgagggcgtatcctgaagttaatcctgcttccggagtggcagcactctgtccattttcggcgggcgccgcagtacgggcttaccccttaccctttttaccgaccccggcgcacctctgcgtgacgggctgtgatggcagtaaaacggaatgctgtacacgtgaccgtgacggagccagccataaaacacaagaaaacccgcctcgtcgacgggtgaaccagtaaaaaggttcagactaacttgtcgtgccccggatctgttgaaacaggcacaggataattctgatacaaaaagggggatacgcaagcgaacccgccggattgacagagccggtcatgcagcaagctcgccggaccggctgcagaattcatcaaacagcactatttcaggcaaaaaacgccgacggcagggaaattcattccggggaatatcccgatatcattctgacttcaaaaaaataattcagtttatcaaaaggttaatcacgcctgatgacaattcaggacggcaaccagctgataggaggccagggcgcggggggggaacgcgccggcacccgcgctgttccgcctctggccggcagatacccgcctcaggatgtatcgtcgtttctccgcagaacaggatgccgtgagactgcctgtcgtgcggtgcataaatttccggttgaacatactgtcgcagaggcgaccattgatgtcggattcctttggcagattctcgtgtcgccggcattagctataactgaaaccaggaatgcggtgcaatgttaatgtacagaacagaagatgaaaaaccgggcagacatgaagctcggtgaggcggtcctttttttactcagatagggcgcgccggttaatgagtcagcgctgctcctcaggcgtcatcagggaagatgacgcggcactgagcatgtggaaacaggaggacgcagctggccgcgtcacggaccgggcggataccttagcgcggtccggcgcggtattaaaacacggaagcacccggcatcataagtctgtgtcaccggcaacgacgctgattgcccggccgtaaagctttttacgccgcccgcagactgggcctcctgctgcttcagaaagacccgtatctcctgcatgctcacctcttttcctcacttcataagagctgagacggcatgccctatcactgacttaacatttttccatattatccggacggttggtacacacttcatactcctgacgcataggcgccctgctgtatatcaccggcaacgacgtcatttagctcccccagcgtggttatgatacctcccgtaccaggcgagaagcggtaaaacggtgtcaggcctgcgcgcgcaccagcctttcccgcagagcggcgacccgcttagtcagcacactcaacttatcacaggtcgtgtccatcaccgacaccatatctgcaggcacgccggcggccctgctccgtcaggaaaatcagcacgcacggtttatcatgcagcgtatcgcgctgtcggcagataaagccggtctgctccagccgtttcaggagttggctgagcgtgccagagtccagacggacacgcgcgccgaccttggagaccgtgaggccatcctgttcccacagcaccagcagcaccaggtactgcggataggtcagtcctagcggcttcagccggtttgatagagcttcgtcatggtaaacgacgtcgagtaaagcgcaaagcacagaaattggccaatggtttaaggcgccgcatcgtggttcccgagtatttcatctttcatatcatcatatcttccggccgggccgctttttccggcgaagcggccggaccaggcacgtttgttaagggagccggactcaggcagtcaggggcggacagcagcggttctgcgccccgttcagggcgcacagcattgagtcagattaaattgatgtcaacgagaaccggcgggccggttcagtgcgcggtggcagtgcagcgcagaaaattgtttatcaccataatcatccggcccacagccatcaggtctgcggtcagcagcaggtccgtgcgaaccagccggtccatcaggatccggtcgttcatctgttcctgaattctggcgtacagggccatcaggtgaacccagttgttggcaaacgtgtccacgctcaggtattccccctcgctgagctgccgcagcagcgtgtccacatcgaccttaagagaagtaatacggtccgtgtcggcgaatacagcatgtctatcgtacttcatacgcggaaggtctccaccatgccgcgcagggcgcgggcctgctctgacagcgactgcgatgctgaagacgactcctccacaagggcggcgttgttctgcgtcacaccgtccatctggctgacggcgatgctcacctgagagatgccctgcatctgctcgccggaagagagggaaaggctgtccatggcgtcggccagctctcccaccatgcctacaatcctcaggatactctctcccgtaccggcggctgcagcgacgccgccttccacctgggatacggcctgttcaatcagcagcttgatgtcccgcgccgcgctggcgctgcgctgggcaagtgtcctgacttcccctgccacgacggcaaatccccgcccctcctcgccagcgcgggcagcctcaacggccgcattcagcgccagaatattggtctgaaaagcaatgccctcaatgaccgaggttatgtcccgtacccggaccgcgctcagcgaaatctcgttcatggtctccgacatgcgctgcacgtcagcttcaccggcacgggccagcgtggccgtctcgcgcgcggtgccagcggtctggtgtgcgccggccgcgttgctttttaccgtggcggtcagctgctccatgctggcggcggtctcctgcagggctgccgcctgctgctcggtgcgtgaggagagctcggtattaccctgcgaaatttcgtcggcggccagcgccaccgaggcggacgcgtccttaatctgcgacaccagtccgtgcaggttggcctgcatgccgtccagggaggcgagcaggctggcggtgtcgccgcggcgcagcgtgaccagcgaggtcaggtcgccggcggcaatggcggcggccagcgcctgcgcttgcgcgggctcgccgcccagctggcgcgtcagcatgcggaccagaagataacaggttgccaccgacagcaagacggacagtacagccaggcccgacaggataacggcggtccgggaggtgcgagcgctgttttcagacaccgtatcacggctcagctgcatctcaatgtccgtcagatcgtccagggcgttcagcaggatcctctgcgctggccgggcggtggccatcagaaagacggtagcctcctgctggcggttatccagtcccagctttccggccgtcatcagcgtggaaagtgcgacaccctccgttgacagcgtccgctccagcgcggccttcccctgtgctgaaacgttgactgacatgcttttttccagctgctcacgcttccggatataggcctcacgctgtgcagtcaggcgctgccactcgggctgcatctgggccggatcagacagcagagccaggttgcgcacggcaatcgccatgtcgcgtacgccgttccgcatgtccaccaccagtgcaaagcgcttcatcttcacgtcgacggtgtcgttcatcccttccctggcctgccacagggcgtgaacggcgatacccgtgcacaggacaaaaagcagaataagcagaccaaagcctgcgctgaggcgcgttgaaatcttcatcgtttctccgggaaacatttgtttgatgaaggggtatcggcagaaagcgcgcattcaggagtgctgagcacaacagaattgcacacaatataatgtgtacgggtttacagcaggaagtaatcaggctcgctgccgcatatcatatagcctggatatcgcgcagctgaaaggcttgcttgcgcaatgcaaattagttaagccggctgagaggctaattatttttatacgttgcttttaaagaggtagctttttctcatgaaaatcgcgcccaggcagatcgccacaggcgataaagccaggctgcgcgggcaagatactgccggaacacaagtcagcggccagaccagatgcagtcaggccggctgcatgctctgccggaacaggctggctgaaaagatagccctggccgtaatcacagccccgcctacggagccattcaagcgtggccgtattttcaattccttctgccgttaccttgacccccaggtccttacaaagctgcagcagggtctcaaccaccctttcttttctggggctgtttataaaatcagagatgaaagatcggtcgattttgatatggttgatacccagccccagcaggaccgataggttggaatagccggtgccaaaatcatcgagcaccacgccgatgcccgattctttcagggtgagaatagcccgccgggcatcttcggatatcatcatcacgtgctgttcagtaatttcgatctccagccggaccggcccggcgcgctgcatgatacgggacacgcacgccgtaagcgccggcttaagcagctgctccggtgtgatattcagtgccagatgaaggcctgccggccaccctggggtcagcgggacaacggcttcaagcagccgggcggtcagcgtgtccatcaatcccagtttctccactacgggaagaaatacgtccggagcaacggcccgtccggaagcatttatccaccgcgccagtatctcaaaccccctgatgcggcccgtcttaaggcagaccagcggctgcaggaaaggtacgatatcgttatttctgacggccatggcaacgtcattctgtaaccgctccctgcggcggaaccgctgctccaggccgagcgtaaaacgaaccactggatgcgctgtatcccttttcgcctcatacatggcaaggtcggccgcccggacgatgtcatatccggcgctgcaggcagggctggccactcccacggacaggctcaggaacattcccggtccggtccgtatgcctgccgcgcgtctgagaaggttttgggctgtctcaatggcttcatccgtataacaatgtccggaggtaatagcaaattcatcaccaccgatgcggaatacctgcgtttcaggcccggcgaatgctgtcagcagtcgggccagagtgatcagtacggcgtcaccctgctgatgcccgtgaaggtcgttaatgctcttaaagtcgttaacgtcaatcagggtaagggtgtagggtgtcccgccagcgtcaagttcagcaaggcggacgctgaacgccctcctgttaccggttcccgtcagctcatccgttccggcaagcaggagcgcacttttctctgctgcgatacttttgcgcatgaggccggcgatgagcagccccggaattatcattgccagcccggcaaaaaccgttgacgtcagaataaatctcagcctctcactcgtttcaaagccagcgtcatagtccaggccaagtactcccaaaacatgcttttccagcccgaattcccagagagatgaaagtaaaacaatggtaaccatattaatcatggccagccggaaaattttcaggcgcatccggggactcccgtcagtataatcagtaaacattgtgctgtttttaatctatccaaactggggcgtacttcccgcacaatacctgcctgttgccagaaataacccgttatttatcctaaaatgagcatgagaacgtaagcggatgaagcctgtcatcggctgcctgctgttgcccggtgccggacacgggcagcacgggcaacagtgagcagcgaagaaatcacaaaagccttcagaggcacatacagactgtatcggcttcgcgcataaaaataacagggccctgcccataatattcctgtcgcagctgcccccggagccctgacttcggagtgggctgattcccctacaggcagcaggtcgcctgatacccggtctggcaatcctgcgcacatgcctggcagaaagtcacgggacctgcctgcgtaaagatgcaaaagcagtcactgtatccaccgaaaaaaatgagaagcagctgcaatgactggtggtcagcctaatactttaaaactaaaaaagtttagttaaattaacctattaacgggccgaatcacttaaaaatattattatgtccagcactttgagcaggggatctacagatacctgcaggacagtgtttcttacgaaaaacggtaccttcatattatttgcagctgacaagccctgatttattgtgagcacttcagatggttccggcctgattcaggaacgtttgtcgcagttatttacatgcgctgacgttatcataaggccagagttcaggaatgtagcttaccgataaattgcagaagctaaacggtcttttctgactggctaagtcagggagatgtaccggatgcaggaagtgccggataccggtatccgctgctgtgctcagttgagggatagtagtatcagatgccacacggtcagaagaggcttgaagctgcagggttggaacatagtatgtcccgcaaagcaaaatgctgtgcaatgcgataatgaaaagcttcttcggcagctgaaaacggaatgctgccgcctgagagagtttaaaaaaataagctagttatgaggcggtattgccaagtgtattgactattacaatcatgaaggaataaaacagaatctaaacaggctgagtcacgtaaagtaccgaaaaaaggcccgatcaaccgcctgataggaaccgtccagttttatagagtcagttcaataactgcggttcaaagaggaattcagggacggttatttttatcggggtgcggcggagccgccggccattcttaataaaaaagatctccatggcagcaagcgttagcattagaaaacgaggcttatacgtggtcccctcttcacttctggcatcatgcatatgtcttagccctttccctccggaattttaaccaaaaaaacacgccatcttgagcgtgctaaacaataaaaagcgttcacattttacagcaagcgcgccggatctaacaggggaacggcacgtctcaagcatggtggaaaaatgcggttccgcaagtcggcatataccggggctggaaaaaagtctcgtccgggtgccagacaggtacagaagcctaagtttaatgtgaaccagctgaaagattcgataagtgcctgccggatttgcgccagcataaaaggtaccggggaatttctgcctgcgagcatacttgatttactataatagctcgaagaccggccacggcagaatcatccgctctgagcgagaagcggacgcccccctttcgcattccggcgatgcaccgtacttgctggtaacctgcaagatcacctggattgaacataacgtccggctggcgaaccgtaccgcttagaggcaagagctgacggatccacaatgaaaaaaggcaatccggacggagtgcctggcagagcaaggtctcatgagttgctattgtttctctggcgctgcattttgggtgctgtcacttctgttatcggcacggagcaggaagaaactgtgcgctgcactgcattttgttaaatcagtttcccaaggtaactctgactctactctggattgaacataacattcgggcagcaagtttcctgacagtaatcactttccaaacttctgctcgaatttttgcttactgaccttccgatccatacgggcagaacaggcagggcaaagatactggttcttaccggcaatcttccatttgtaatatttgcgttgaaatgggctgttacagacgctgcagcgtttgggcttaaaaatttcagccacgataataacgacgataatcagaataatttaagtagcaactttatccaattgacgcacctgaatgaataagcaaaaaaacatttaaatcaatagattaattacaaatttagcatgattttatgactttaaaacgactatataaaaataaattttgatcatgaacaagcttttgtcttgtcaaaattgaaaagcagcgaaatgcggcgtatcaaagtaagtggcatctttgccaatcactttggaaatgtaaaatggcagacagaagaccacttaatccaaatgtagttgttcccaagccgggcggcggcacacagccaagggatcgcaataatgacggcaccgttcgtgataaacgttcagacgctggtaagcccagaaaaaaatagacggaggtcgcccgctggggcgacctttcttgattcatatccgccacacgacagaatcgaacacagcttatgataagaagctggctccggttggctttttatacaaaggcttaaacttgtcaggattgcttctaaggggtcaactcaaatgcttaagactgtacggctatgcctgttatcctttttttctcatgcttccccttttgagcaatatacccgcagcaaaaggaaccgagtcagacgcacaggtaaagcaggacattattgatgaatcaatagcggcctataccggaacatgtgcatgcccctttaacagcgcaagaaatggcagcgcctatggtggtcgcagcgcatggagtaaggccgacggttattcaccgatctgctacaaaaaagaattaactaaagatatggttaaacagtggcgggattcccactcaacaaataattgatggatccttcctcatttccatgactcttttttggcggcattctatttattgctcagagcccctcgcttttaatataacatcccggccaggtagtgccgctacgcagccggaatgggcttcaggaatgtgcgttctgcatagcagacgcagctaaacgttgatgatttaatcggaaatactgcttttcttcgaccgtagaagccccgagtgacaagtaaaattcggcagctttcgggttggttgtttcagcagtccagtcaaaacgtgttcagccatgttcaactgctaaagtcgcaataaatcgcatgagtgatttaccgacctcatggcctctcactgctgctgatgtgaagagatctttcatgtatgcctgcccggaaaactttggcgcaggaaacatcagcgtaaacgtggcaaatccgacgagcgctccgtctttccatgcgcctagaaacggtcacacccgaataggcggagaaaatgctgttggtcagataagagagcacttagtcatagctggcagcctcactcccgaagtaataaaattccatttcgaaaaaaaaactctcgccagatctggaatgcccgaatcccggtaaatctcgattttcatacgtatcctttattttttgcagtcagtacatcacccgtattcataacatctcttgccgcccccgcaggggccctcagtgcgtttctacgccgtcctgccttttccccgtcccgatatccgcaaaaaaagtccctgataagttttgagcaactgtatggctatgcacggacgtgcatgcggggagatttcgcgcagatgttggctctaagcgggtatttacggggaaaggccggatacttgccagaggcactaggtaaaaatacttcactggctttccgggtttgttgttgtgccccggtccgtacattatggccagggcaccgtataatgccaaattggtggcagtttactacgcggccgttaggcgttgggcaaacagcctgccgcggaacgaatcataggcagctttgagcgaatagcggatctgcctctttttcagttaaatatgtatcttctcaagatcggtaattaagttcggtcctttggcgcgccattccagctgctcctgtgtgattgcgcttgatgcagacatatcctcagcgacaaatttactcaaccagccaaaatgtgctgatgcttcagatgattcaatacttttaaccggtacattaagcgtacgtccaatggtctcggcaatggctttcaatgtaataccttgttccgccacagcgtgatatcgactgcctggtatcgcgcgttttagggccaggatatagagagatgccgcatcactgatatgtactgctgaccagcgattctctcccccagctatatatgccgaaacgcctttctctcgggcaatctcaaccagcggcgtaatcaggccctgttttaaagtgttgtgaacctgggaaagacgaatgagagagatattgacgccatttttaagtgcagcgatcccagccaactccgatgctttacgagggttcatatgttcatgattaaattggttttcgaccgcaattgcacccgttttttgtgaacccagacctacgacagaagttataagtaacggctttgttgtaccttttaataccccggccatttcttcaatcgccagccggtccatttcgcaatttatggtgaaggtggaaaaatcgtgattgaatgcggtgtgtataacaccgtcacttgccattgcgccgagcctcaagctttccggctcagtaatgtcgccgaaaagaggctcaatgcctgaggcgaccagcatagctgctccctgctggcttctggtgagccctgttacccggtacccggcagtgatcagtttttttgcaactgcagaaccaataaatccagttgctcctgtgagaaatatacgcattgtgttcgccttatcagtcatgagggttgcttcgtcaatccagtaccgtcactttaagagcggccagcactactatctatgtgataaagtcgcttttttatgtctgatagtctgggatttatatggatatactttcacagctgctctcgcttctcagaccggaaagttatgtttcaggcggggtaaagcttgcggccaaatcatcggtacaatggccatctcatgacggcgttaagtgctatgccattgtatctggcgagtgctggctgtctgtggaaggtaatatgcacctgttgaggcttcagaaaggggactgcttcctgctgcctccaggtccccctttcagactggcaacagaattatcagcaaaggcggtagattttacgacagtccgtaccgcaatggtctcagccgaagaggctggcgaaaagccatgctgtttgcttgttggtggccattttcttctggccgggcaagctgcaaagatgcttttagaggcgttgccggccgttgtacatattcggaacccatccgataaggcagcgatgcagtgggcacttgagagaatggttcaggagatctgtgagccgcagccaggcagcgcactgattgttcagcaactggcatttatgctgttgatacaggccctgcggctgtatgcaaatgaaaatcagaaaatcaggactggctggctttttgctctaagggacaaaaaactgagcgctgcgctgaccagtatgcaccagaatcccgaatacaagtggacgatagctaagctcgccgggcaggcagggatgtcccgtgcagcatttgcaaaacacttcaagcagaccgtaggcaccactcctgtcgaataccttacacagtggagaatgatgcttgcctgtgagcaactaaattattcggaccagacgattgcccagattgcagcagcatcgggatatgagtcggaaagcgcattcgcaaaagcgtttaagcggaccgtcggttgctctccgggaaaggtcgcagccaaacggaaaccttgaacgttaagcaaaaattctatggctggtttttttcaactcctgtcaacgtccgctttgtgccagaagcggacgttggcattccactataagtatatatctgtacacagctagcaaagttgcaacagaaaacgctgtaattcagccgtgacttcttttggattttcttcggccatatggtgaccgcttgctatcgcctttccccgaacatcatgtgcccaggttttccagatacctaatacatcgccatatatatcttccagatcatcatatttcgaccataaacaaagcgttgggcacataatcatgtttcctttctggcgatcctggagctcatgttctttatcgatactaaggccggcacgatagtcttcaagcatcccatgtacagtttccggatcatgaatagcttttctgaactcaaagtactcttcatttcccattgtttcaggctgccctccataccacttgtcaggatcagcgagtatcgcccgctccggcttttctggttgagcaaagaagaaccagtgataccactgccgtgcaaacttctcattacaccggttgagggcttctagtattggaatgcaatcaagtacggcaagccgtgtgattcgctctggatagtcaagagcggctctgtaagctgtgtaacttcctctgtcatgcccaacaagcgcaaattgctcaaaaccaagctgactcatcaactcaatacaatcttttgctttagctcttttagaagaaccagcatgatcacgctgatcagccggctttgacgactggccgaaaccccgtaaatcaggacatacgacggtaaatgatttagctagctcgggagccacttttgaccaggttacatgggtacgagggtgtccatgcaataacagaacaggtggtccgtttccccccatagcgcacattgagctctgcttctgaaaggctgactcgtgtatgtgtaaatccttcaaacatatgctgactcccacggcaatagtgtggggataattataggctgctgtttagtcggacactttgctacgtaaggggccgagcagattcacccttcttggcgaaactggtaatgcaacgcaagaagacattatgggaaaaaatttaaaatgaatgtccgcttttcgctcaaagcggacctttagcgacctccgtcggctttgtgccaggagcagacggtcactgccagcgcaaggctatcctgtgctcatagctagttcagccgcgaagcataagaataacagtattgagcagagcatagatatctggaaccggccgcggaagatgatgaaccagccagtaacgcataaatacacgactgactgatggttaatcatgcccggttataaacttcctgaatctctaagcgcaaacattaaagtccgcaataaaagggctatttgaccctgcttaaccggctctacattcacattaaaaattttccttttatatatcgccagcattcatacagcagtaaattactgtaaatgcgaatgatgatcactatcatttattttatcgtttcgataaggtttccttaacatatgtacaaaaaaatactgtgtatttaaacaaatgtgcgtgtggttgcacctaatacaaggagagattatgtcttacgaaaattacaacaatggcgtttcgccggagcctggacttgtttgggatggaggagggtgggtctatccaacaacagggtatattggtggtgatactctgactgtgtggccggaaagcagcgcacgttatccggttgaatcatttaatcccgatactggaggcggctttgtgccgacagtcgatggagtctgggaaaatcccctgccctcacttttccctgaaatgcagactgcattatctcaggttacccaggggcttacttctccacagtgggataatttcataagcgcacctttctggcgctttacaccagctctggcatatccaacacctgataacacagttaatccctacatcactatgctgcctctgaaacaattaacccacacaccagtttctgctggaagtgcggcgccagcatcggtgatgttacacaccagaattaccgatgatgtccgcaatggcgtgcaatatctagcggcagtaggagaccagaggcagcagtcatttaacgtgccggtacggcaagccagttacaagggctccaatacagaagcgtttctttgccggtatgatgccgggatcgcttggattcctggaattttatatttacagcaccagtaaagagggaacaagaccctggaatacttcagttgaacagggggagctattacctgcgggggcgactgctggtgcaaatacacaggaccttattgtctggttcccggctgaaagtggcatggagccgctttatgtagccttcactacaagtatgcctgctgcacagctccagcgtcgcgctgagcaacaggcgcaggcgcagctcacagttgatgacaataagctgaaagattctgccaaagccgtagtggatttttaccagctggctacagaaagagccggagcgcaaatttcacaggcagctaaaacattagccgatagcgtacagggcaagcaaatccgaaatgcagaagaggcttatgcagcctttcaggagtacggcaatgtactgaataataagtacagcgtcgctgatcgagaggctatagcgcaggcacttgaagctgtcgataaacaaacgctttctgaaaatttggtccgcctgagtaaagggcttggatatacgtcaaaattaatagatggttatgacattgttggggttgaacttccaaaagcgcttagaacaggtgactggagacctttctttgtcaccgtaggaggaatatatcttggtgttcaggccgcacatcttacggctttggccttcggagcacttctgactactcctgctggaatcatagcttacgtggctcttttaacggcaacaagcgctttcgttaatgatactgtaatgcttgagattaaacggctggttggtttatgattcaacatcaggcctctacttagaggcctttttcataaacagaaaaataatcagaaacattaagcttgccgggattgccataataaagcagaacaaataatagagaatatatacaggatttttagctggtgtctccataaaaatcccgcgactccagaattcccttttggtatagatcaaagcaaatctttcaattgccatctttgaaactggataaagtaagaaactaatcatagatattccagataaaaccctccacatcaaactatcaggatctaaataaaaattatatagcaccacagaaagaatgaaagcagcccatggcaggcacttaaaataatttccaacagtcaatcctctattccttttttaaaataagtatataacaaatgaaaacatctaatcatgttataaacaaataatggttttcctggctgacatcaatacaaaaccgtgatacatcagccttcttaagcggcgggaagctaccgccttgtataatacatataaatcaaggatttataaatacattcttggatttttgtgaaataaataaatatggagtacagataagaagatagaatgctgcctctgttattagatgaccaatataatcaggagttaacgaattaatatccatgccaacaacataaactccatacatatatgttactgagtaaatagttacatatattaacacaagagtcaagaaaacatatttagctactttttttcttttaaagaaaaataagagaaacaatagcgataaaaatataactaaagataacgaaatcattgagagaatgaaaaaaacttttaacatggaatcactttccagggatatgaaaatcttccagtaagatataagcagttctactcttgtcaatgccatgtagaaaatagagaatgctatagcaattaggataaatccaaaattttctttttcacttttattcgaaaacttagaatcactcatgacatacactccgtgcgattgattatcgcaataatatcatcgtttttttcagatgtcttcgaagaaatgagtaaatccattacccacaataaatatgaagttaatcagggttgtgataagtcagattggttttctattctgctcattggacaagtgtgtgcgaacaatatattggaaaatttttccgtacctggtttacatcttatgcatatatgacttactcaagcaacttaacacatggcataacattatttttcgccggattcgaataaatcgaatttacatctagcagcacatttcctgcttctcactgcagtcgaggccgctgaatattctttacatgcccagcataatgaagactgccagggccacagcttttgcgagggaagtgtctaattacttcttacgatatacagacttggctaaactagttagcttggctaatgtccgttttcgctcatagcggacgtcaatctgactccgtccgctttgtgtcaaaggcggacattgcatactttacgatacgccaatcaacgttgagcattcacagtggaatggtaaggttgtggcttgttccctttcaaaaaggccatctgcatgagcaatctggtaagaaagaattaccgtgcgttaggtgaagtaaaggctccttacgtccattcagtaaagcatggcaacacgctctatatttccggcctgaccgcgtttggcacagcggcacaacatgaaggcattgttgagcaggccgaagaaatattcagccaaatcaggaaaattgccagcgtagaagagatagatttttcagcactaatcaaggtgactatatttattacctcttttgaggagataaacgggctacgcaaagtgctgtaccgaaattacggcgatcacttgcccgccagctcgctcgtagaagtcagccgcctgttctcacctgacctctcgatagaaattgaggctatattcggcctttgattcattgctcatagccggatagtgacaactgttcggctctaactccgttttatcaaaccttctctaagaaataacttccgcttctcgctcaaaacggaccttatgagtctggggttcgtccgagttgtgcctgaagtgggcttaaatatcattccggacgctaataaacaggtcgcagattagtgcttatcaagttattaactttgctataaaggcttatttccgaagcgagatagacggtaaatctccgggatctcatcgttcttaccgttgcgtaattcttcagaaaccagcctcccgatcgtagctgcgcaagtaacagctgggtgcataactgcgacatagacgccctcgctctcatcagtgaagccaagaactggatactcatcctgcggaaacagggcgttctcctattgagtattgggtgagagaagccgactctgcgcccctgagcctgcttcttattgaggcctgagcagcgataacagtttctctgacgctgccgtttgccggataatcctcagctgctagcaaatccccgttacgggaatgtcgaacctctatatcatcacctgcgatgagagttttgactacgcactggggtgctgcaaaacgtagcaatacagcaggtgatgccagaaccggaacaggggtacccatcagcttagtcagagcgggaatacccgttccacaggccagcacaacgcaatccgcctccagttgcccctgagaggtcaggacacctgtcaccttgcctttggtcatgcaaaaaccctcaacagtcgtttggttttgcactaccaccccctttccgcaggccttatccagtaatatacgtgtcgcttctatggcatcgatggccccatcttttgcagcataacgggcttctgagggaggaagtaccaacgcaggctcaagactggctatttcggctgtgtcgaggaggcgttcttcaggtaggcaggcctgagacgttgctccgtattttaatgaaccaccccagttaatctgaagctccggaatttgttcttcaagcctgtgccagtcctcaagtgcggcgcgccggagaagcacatcaggcgcatcatcacacaccacgccggtcaaccagccgaacgcgctgccggtcgcccctgatgcaggcatattttgctcaataacagtgacgtcaaattcaaggtgggcaagatgccatgcgattgaagcaccagtgattccggcacccacgatgacgatcctttttttcatactcaccactgtaaccttctcctgagtgggaaacatctccatgccatgatgcaaaggttatttgttacggtcaacctgctagaattgcaaaacgcatggccacaactcgtcaagacagcagctttatatgctttgtttagaagtccgcttttcgctcatagcggacatcggtctttcagtcagtccgctttgtgcaagaagcggacattgttaacctcacactagattcattatcaaggcgcatatcagctgaaagccataaaattagaaatagcctccatcagggggctatttcagaatgaggacatgaagggagctgaatgattttaagcctaaaagatgattgaaggacagagagttttatagtgggcagcttacatcaccttcaggacaattcagcatactttcaagctctttagttctctgttctgttttggcctgaagacaaatggcagtattcatcgggcttactgagccatcacttgatttataagtctggaacttacaatcggcgtcgcgatagctgatccattttttctgtgaggattgcagcagattccgttgttcacctgatgtgagtttctggaccttttggtatgcactatttagagctctgtctgcttctttgtagtccgcagaaaagcactgattcatttctgactgaatctgtgcctcgccacagctggctgccactgcctgcgtaagtggaaaaattaccagagagagagcaatcgtttttttcattttcagtttccttttgaacaatgcgtttagcgcattctattttatccacaattgaggtttacaagaaacaccaatcctcctgacctgccccctattaatgaatacacgacaatggaagcaagagctcaaagtgtaatgacaactacggatgtcctctttcgctcataacggaccctagcctgccgtatccgctttgtgccagaaacggacattttactgggatgcagcacggccgtttggatctgctgcatatttgaaaaggtctgtgtctggagctggcataaaatgtcagatatcagattccagcctcacgtcactctcagcgggatgtgaggtaataagtgtgagccatgtgagagtggatgaatggttacatacttgccctgacgccaatagttacttagtaaaaaaacatgccgagcatccgccctgtgccagagttgctcagaatactttccgttgttaacgtaattttttccgatacaggctggtggttttaagacgacatatcggcgattgattggtacagaatgttttgtgcgcagtgacgctgattatgattctgacggagttaatagaagagaagcacaggctgcgctctttgcttagtcgttctctatgcattgacagaaattttttcattgtgcatattgttacgttataacataacttaaagcatggtgatgaaactgacttcccctctaatcatgtctgcaatactgttattccctctggtcagcctgggcgccactaactatccgctcacagttgaaaactgtgggtttaaagagaagttcagtcaggcaccttcacgtgttgtgaccattggccagcatgaaacagaactgatgctggcgctgggactggaagagaaaatagcaggtacatccgtctggtttggcgcactacctgatgatctgaaacagcagggtgaaaaactgaaacggctggctgagaatgcgcctggattcgaagccgtggcggctcagcggcccgagcttgttcttgctcagtacagctggcacgttgggccacagggcgaagtcgccacccgccagcaatttgagcagctgggaatcaaaagctgggtatcaccagctgactgcacagcaaaaacagtcacctctacctcgaacggtgatggtgcacgttctgaaccttactcaatcaatattatttttgatgaaattacagcgctgtcgcgcatttttgatgtacctcaacgtggccaagctctgaagcaaaagctgtctgagcgtattgctgctgtgctgaagcagagccgtataaagccgtcaacaccgcttaaagttgtttactggttttcaagcactcgcctgaaaggcgatccgtggatagccggtaataaaggtgcaccgggctggataagtaaaactcttggtctgtctaacatcatcgattcagacgaagagtggccttcggtgacgtgggaatacattatcaaagctcagccagatattatcgtcatcgcgagcatggacaggcggctttatcccgccgatgacgtgacgataaaaaaaaggtttctggaaaccgaccctgtcacgcgggaaatgcctgcggtgaaacaaggccatattgtagtggttccggctatgtcgctcaatccgtcattacgtaacgtagaagcggtagagctgattgggcaacagatccatgctttctatcactccagatgacaagtcatccttttctttactggcgaaacggcctgataatttttaccggcatattgagtctgcctgtaatgatggtgctggctgctgcgaccggcgatataccagtgagttttgccactaccgctcgtgcaataaccaatggccttggtataactcacttcaatctgccccctgtcgaagccggaattatctggcagtaccgcatgagccgggcgctgatggcagccagcagtggtggtggcttggcgttatgcggactggttttgcagtcgttattgcgcaatccgcttgcggatccttatttactgggcatctctgccggagcctcaaccggagccgtcagtgtaatgctgcttggtattggcagcggcgcaattaccacaggagccggggcgttcaccggagcctgtgttgctttttcgctgatggtagtgttatcgggcggcatgcgcgagaacgcatcacgcatcatcctggccggtatcgccggtacgcaactgtttaatgcactgacatcctacattgtcagtacggcggcaaatgccgaacaatcgcgcggcgtaatgttctggttgctgggtagcctgagcggtgtacgctgggctgatgcactgctgtgccttgtagtagtggcagcaggcttactgatagtgatctgctacgcccgctcactggatacgttcaatgtgggtaccgacgtctctgcaacgcttggcacacgagtgctgctggtacgcattattttgctgctgaccaccgctttaattaccgcagttatcgtcagcgctattggcgctgtgggctttgtcggtctggttatcccgcatataacgcgcatgatggccggccaccggcaccttatcacgataccaatcgcctttcttgccggatgtcatttcatgatccttgcagacctggtatcacgcaccctgattagtcatcaggttttacccattggtgtggtaacggccttggtcggtgcccctgtttttgccctgattctgtaccgcaaccgggagaaatgatgattcatgtcgtggttgagaagctgagtgtgacgcttcaggctcgtagcgttttatctgatatcagtttcagtgtgaaacgatcgcaaacagtggggctgcttggcccgaatggctccggtaagtccacgctgattcgcgcgatggctggcgtacaggcctgcgcttactcggacgtaaaaattggcggtacactgacaaggaatctgagccgacgtcagctttcccgtacgcttgcttttgtgccgcagcatgcggagtctgaggcggagatgagcgttgttgatattgtgcgtctcggccgtacaccgcatcgcagcgcattcactccatggcgtcaggccgatgaggatgcagtgcaacaatcgctatcgatgatgaagcttgatgccctggcgcacagatcctggcatcgcctgtcaggcggggaacgtcagcgctgtcagatagcccgcgcactcacacaacaaccagatatcctgctgctggacgaacccattaatcatctggatatacagtttcagctggaactgatgcggctaatctctgcgttgccctttaccgtgattgtggcactacacgatctcaatctcgcggcaaaatattgtcaacatctggtggtattgcacgaaggacagatcgtggccaccggtgatccggctgacgtgcttactccagcgcttattcgatctacctggcaggtcgatgcctcaatcaaccgaaccaaacagggaacgatgaacattcagtacgcctgaggcaagacggctgaaaaatcgtcattaacgcgctgagggtgtcgtcaatatcctgggagaccaggtagcgactggtccggtgtttcagcctgttctcaatctaaggagtagttatgtccgcaaagtctccctgtactgatatctgtatcttcagtaaaactaaaggctggtgtgagggctgtggccgtacgctgcaggaagcacgtgaatggcgcaagctttctccttttcatcgtaaaaaaatcgaacgggagttgccttcgcggctaaaaatgctttgcgcaacgccggaagagtagtgaatatttcccttcgtttactggaatgcggccattgcgtcatgcaattgctcagcgtgccagtgaaccgatgataacagtacataaaaacatctgctcgagacgcttcggttaagccgtcattatatatgtattttcgtatgtattgcttgagttcgctgcgcccggcctgacaggttcagtattaaaggcgaaagtatgtttctggcggatgcgatttttgttctgacgctggcactggttatttggtagccaaaatgactcagtattggctgaggtgccgttatcgtggccgcgctggcgctgctgaccggcgaagtgcatatcagcgatattcctgtcatctggcagattgtctggaacgctacggccacgtttattgcggtcattatcctcagcctgatgctgagtgggcagcactgcacgtttccggctgaggaggcggtaaaggcgggttgttgttcacgtatattgttctgttgggtgcggtggcggcgtcgctgttcaccaatgacggcgcggcgcttatccttacgccaatcgttatcgctatgctcctggcgctgggctttagcccgggtgccacgctggcatttgtgatggaggctggctttatcgcggacacgtctagcctgccgctcatcgtatccaacttggtcaatattttgacggcggtcttctttaagcagggcttccgtcgtggtgccggtgaatattgcttccatggcggccacgctggtgatgctgcacttgtttttctgcaaagacatcctggcagcttatgatctgacgaagttgaaaatgccatgggaagctatcagtgacatgcgtacttttaaaaccagctggctggtgctgctcatgctcctggcgggcttttttggtctggtgccgctcggcggaccggtcaatcaggtcgctgcggtggcggcatttattctctagcttgttgcgcggaaagggcacgctatcgatacccggaatgtactgaaaggtgcgccctggcagatagtcatgttcccaaagcaggatgttggaaggtcagtttcttgtacaaggtggacatgcatgctgaaaggtccgccaggaccgaaaagcgaacgcgtgaagggcacatgaagataactctttagataatttaacaaactgaataaaaatatagataagagccaatcggcttttcttataatagttttggctaacctttggggggcatttttaccgtgcgaatcttttgcacggatttgaccatcccgttcatgaatcagcaattcgccaccttgattttgtgtaatagtgcgagttgcatcgatagcttgctgctgtgtgtcatgtactgaggtagaattaatatttcctgacccttttaagcctattcatagttatgaggaactacgtgcagaatttatccatttaatgtatccgcttgtaaaatcggtttaacaaactctacgggaatagaggttgagttgcgttggatgaatgagtgaaaacagaggtatcatctaaatttacacctttggcagatggcttttaaagtctgatggatttatgaaaatattatgctcaataatcactaatataaaaacagttattcacacacaaacctgcatttcataattgcatttcacacaattaaaatgcaataatattgttaattttttacttcttcatacattttttagggctttcttcatgaaaataagtgttctcacggaaaggctttctcaaaaaataatcacgctgatcgacagcggtgttctatcgcctggtgcgcaccttagcgtgccaaagctggcagaatcttttgatgtttctcgttcacccgtgcgtgaggccttagtttaccttgaacacaaaggcattctgcaacagcagcataaccgtggtttttttgtaaagcaggactatgcgcctcagactcaaagttcacatgaaagtgaagtggataacgatcttcctgaatactatcaattagcggaagactggctgcaggataaaattgaatctgaagtaaacgaactttatctgcttaagcgttataacctttcgaagactcagctcacgaccattcttgcgcgcggtatcagtgagggatgggttgaacgtaaacagggttatggctggcgttttctaccagtagccaaaactaaagccgcgcttgagcatatctttagcttccgcatggttattgaaccaatggcaattttagaatccactttcaaagccccgcagagtaaaatcgatgagattaagcgcgagctagagatgcttttagagattggcattcagcgtttatcgccaactcaactccagctggcgggttaccgctttcatgagacggtcatcagtttttcaaacaatccgttttttgaaatatcactgcgcaacgtcaatcgcatgcgtcgtttaatggattaccgcattatggatgatcgcagccgctactacgctgaagttaaagatcatatgcatttgctgtcattaattgagaccgggcaactgatcgaagcgtcatatatgatgaaacagcacctcgctgtcgcgcttgataacaaaaaacaacgtagtatcggagtataaaaaatggccctaatgggccattttttcatcagagcctttactcgccaggcgagtaaagtggataaagacccaataacaaacccgatgccaggaaaatcatgcagagcaggaaagcccatttgaaggtatatttctgatggtcactgaattctactccagctaatcccactaacagataggttgatgctactaatggactcagtaagtggattggctgcccaaccaacgaggcacggccaatttcgactgggtcaatgccatacactttcgctgcttctgccagaaccggtagtacaccgtaatagaaggcatcattcgacataaagaaggtgccaggcaagctgatgagtgccgtaatcggtgccagataagggccccatgaatcgggtaacacattcagcagagatgccgacattgcggtgaccattccagtacccgagaggataccagcgaaaatacccgcagccagaaagattgatgtctggttcagcgcggcaggcgcatgcgctgcaatacgctgacgctgggcatcaatatgcggatagttgatcagcaacgccagtgcaaacgccaccatgaacagcaccgacagtggcagcaactccatcaccagcgatcccatcagcagtaatgtcagacccgcatttagccagaacagttttggacgtcgcagttcttcattgacttcattgattgccggcagatagctttctgcatcatcttcattgactgatccataactactggtattaatactcagcttgcctaaacggcggcgtttcacgaataccgatataccatgacagcaccagtactcctacaaaaccgcaaaccatagttggaatcaacggaataaacagatcgctggactcaactttcagggacgcagcaacgcgagccagtggaccgccccatggcaacaagttggtgatacttcctgcaaggaagaccacacaggtcagcgccagtggatccagacgaatacgtttgaacaatggcagcatcgccgttacgcagatcatataggtcgttgagccatcaccatcaagtgaaaccatcgccgccagaatggcactgcacatcaccgctttaaccgggtcgccattaataatccgtaaaaaaaagcgaataatcgggtcaaataaaccggtatcaaacatggtgctaaagtagagaatggcaaaaataaccatgatggcagttggagcgacttttttaagcccctcaatcatcatctcgcccatttctccgccgaatccggctatcagagcaaatattattggaataatgatcagtgcgacgagtgcagaaagtttcttggtcatgattaggatcataaagaccacaatcatgccatatcccaaaagcgagagcataagagcctccagcgtatattattgctaatatgcgcgataattaatttgacgtaaattttgagcagggtgttctgttattttattagcccatatgcaggccgccgttgatagagaaatcagcacccgttgcaaatcctgactcgtcagatgccagccaggagcatatagcggcaatttcctgcggagagcccaagcgacgcactggaatttcctgaacaattttatcaataacctgtactggcgtgactgttttcagttttgatgtagccagatagcccggcgataccgtatttactgttactccgcgtgccgaaacttcgcgtgccagggcgcgagtaaaaccccgcactgcagattttgccgtagagtaattaacctgaccagtttgaccaatttgcgcattgactgaagaaatattgataatacgtccccacccacgcgacatcatgccatcaacaacttgtttagtgacgttgaataatgagttcatattggtgttaataacggcctgccactcctgtggctgcatatcacgaaataatacattccgtgccgtgccagcattattaaccaacacgtctatctcaccgatttcagcttttattttggcaaatgccttaaccgttgattcccaatcagccacgtttccctctgatgcgatgaaatcaaatcccatctttttattgtcatcaagccaggcggttttacgttgagaattggggccgcatcctgcaatcactttaaaaccatccttcgccagtcgacggcaaatagcggttccgaggcttcccatccctgaagtaacatacgcaatacgttgggtcataacccttctcccagatgcatttatgtaacagttttcacgacttgttaacagtaagctacctgcggttttttttagcaatctcttggcgtcgaaattgtgaccacgatcgttaattttctgcatttaaacgcattcaaatgcaatgtatcggaattgcgatgcaattttgaatagcttcccaatagccagaaagctcccataagtgctactttcaatgcttgaaaaccataaaattgtgaagtaaatcacaagcagtattttgcacttgtgtttatataaatgcatatttgtggatcgggaatgtaaatgaataagtttgcctatgtgggttgccgtacgtccgagtggcgtggggcacgtggaaagggaattgaagtattccgcattgatgagtcaggtaactggcataacgttcaacgtgtaatctctgtacaggaaaatccttcctggctcactctggatgagaaacggaaccgattgtatgtgctgcatggagatggcagtcaggtggccatatttgcgcgtgatcctatctcgggcatgctgactctgttatctaagcaaacaacgggcccacagaatccacatcccgaccttgatccactgcgacacaataatccggtacatgccgctctctcacccgatgggcgccatctgctgattgctaaccatgaaggcggcaacgtagcagcattagcgtttcgctgatgatgacgcgctacggcctcctcaccatttggcgatggtggaaggccacgcagatgaggatgacgctgcggccagcttgtcacgtccgcatgaaattatttttgcgccagatagcgactattacgctctgcccatccagggcagacaggccgggaacggcattgatatggtgcgtatttatcactggcgagatggacaatcattgatcaatgatgaagtgctgttgccgtctggaagctggccgcgtcatgtcgattttcacccacaggggaagtggctttatggcctgagtgagctcgggaatacaattaccgtttacgattttgaacaagagacgggaaacattgcgctcaagcaaacgttgagcagcctaccggaaggatttgaagcacgtaacgatgccagtgaaatcgaagtgcatccgtccggacgcttcttatatgccgccaatcgtggtcataacagtattgcggtgttgcgcattaatcctcttgatggctgcttagcacctgttgggtgggtcttttgcggtggtaagaccccgcgttttacaacgctctctgcagatgggttgtatttttatagcgctaacgaggactctgattctattagcattttcagcattgatcaggactcgggcatgcttaaagacacgggtaaagaggtatttactgctagcccaacctgcattgtattttccgattaactcagcgcttgaggtcagcattgatgagactggccccaagcaacggcccctcttcggcacccgttaaacgtttcaatggcgtgacattttctataaaagctttcactgagggtgatgatagggcataacccttcacgccaacgtataactcacgtttcgcccatggctcgacaagtggaatacagcgtactgcgtcatgattagccacctgagcgatttcattaactggcaagatggctattcctaactgttgcccgaccagttcggccatagatacaaaactgctgacccgtaatcctatattaagcgttttacccagctttctcgcttcacgcttcagaatgtggctaactgcgctttcccgatgtggaccaatcattttctcatcgacgcaatccactaattgcaaggtcgggcgctccgccaaaggatgcccctgccacaccagaacggacaactggtcttgctgccatggccatacttcaattccgggagcgggtgtccaactggaaaagaaaccgacatccgcgttcccctgcagcaagccttgcacggcgctaatgccagtgtgttcttcaatatcgatatctgtctgcgggtaatgagcaaggaactgactgatggcacgcggcagataatgcatcaacgccgcggagatcgtaaaaatgcgaatgtggccgcgtacgccggccacgtaatcactgagttcctcttccatttgatcgagattgcggaacacttggcgcgcatgaaacagcagcgagtgaccagcaggcgtcagctcgatgccacgcggcagacgtagcatcaatggcgtgccaatttgctgttcaagttcagttatgcgcttactcacggctgagacggccagatgcttacggcgtgcggcacgcgtaagattctgctcctcagacacagcaacaaacagcgaaagtgagaccaggtcgtagcgcatgaacttccctactctttaagtgtttgctgaatgacaaaaggcaaaataccgccatagcgcagatagcgcagttcttgctgggagtctatcactgcctcaagattcagtgcagcaatctgcctgcccccacggcgaatgcagagcaccagcggcgtcgcacccggcgagatcatttccaggcctgtaatatcaaggacttctgttccatccatctcaggtaatttgttcgcttcatcggcaatgaaatgcagcggaagaatgcccattccgatcaaatttgtgcggtggatacgttcgaaactattagcaatgacggctttaacccccattaatgcctgcgctttagcagcccagtcacggctcgatcccgctccatagcgctcacccgccagcactaccagcggagtatcagtcgcatgccatgtttgcgcagcctcaaaagccggaagaatttgctcatgagacgcatcccatgcataaccaccgcctacgcgtttatctggcggtaacaaacggttggatagcgctttattcgtaaaagcaccgcgtaccatcacctcgtgattactgcgtcgcgtagagtaaagattcaggtcctgtggatcctcatgatggtctagcagccattgaccggcaaggctgtctgcggaaatcgcacctgcaggcgaaatatgatcggtggtgacgtcatcgccaaaccagaggaaaggtcgagcattattgagcgaaagcagtttggcaggatcacgaggtaaacgttccagatagcctggccggcgcagataggttgaggtcggttcccatggataatgtatgctacccggtgcttcaatttgctgccaatgcggggttccctgccagataagatcgcgacgctggatgtaatgttcacgtttcatcacccttgttacccaccgttcaacttcttcacgcgctggcattaagtcgcgcattaaaaccggctgatgatgctcatcgtatccaagcggatcgtccaacatgtcatgctgcatatttcctgcgatagcccaggcaatcaccaatgctggcgaggtaagataaccatggccgaggctgggattaacgcgccggggaaagttacggttcccggaaagcacacacaccgcctgaaggccatcgcacaccagattttccattgccggttgtaatgcgccagaaactgccaatgcaggtcatacagccataacccgccacattgaacccaaccttttccaactcgctaagcaggcccgactctgcaagataatcggtaaccgcccgagatccgggtgaaaaggaagttttaacccacggcttgggttgcagtccgtactttgacgcattcctcgcaaacaatgccgcctgaattaccagccaggggttagcggttgtggtgcagctggtaatggccgcgatagccacggcgccttgttgaatcggttgagggtaatcctcatgctgccacttcaaagcgcgatcgccggctttcaatgtctccataaaacttttcggcgaatcactgagcggaatttgttgatgaggattataaggccccgccacgctgggttcgatgctacttaaatccagttcaatgcgttgcgtgaaatctggctgacgatcctccggatgacgccaaaggtgctgatgttgcatataactgcgaataatgtcctgtttctcttcactgcgcccggtcatgttgacgtactcagcgctacgctgatcaaacgggaagaacaccacggtggcaccgtattccggtgccatattggcaatggtggcgcgcgattcgagcggcatgttgtggagtgcaggaccagtgaactcaacaaatttgccgaccacaccgctttcacgcaacaggcgcgtgatgtgcagagccagatcgctgtcggtaacatacggcgacagctcaccggaaacacaaattcccaccacgtccgggaagcgcaacgtgacaggctcgccaaccaatgcggcctgaccttccagaccacctacgccccaacccaacacaccaagtgcattgatcatcggcgtatggctgtcggttgcaatcatgcaatcggcgtgcagcaaaggtatggcttcacgctcatccaccgtgaccacttcagcaatcgtttcgaggttcattaaatgaataatgccggtgccgggtggaatgacgcggaagttatccagacttttttctgcccagcgaatgaaacgatagcgttcagcgttacggcgaaaatcaaaattgaggttatcttccagagcatcagcactggcataactttcaacgatgaccgaatgatcgatggttaacacagcaggaatgtgtggattgatagcgcgcggatcgccgcctaactcagcagtaagatcgcgcatggcagcaaagtcagccaaagccggtaaacaggtagtgtcatggaacatgaggcggtcgggataaaactcaacctcaccaggggaggactttgcagacagatagttgagaaattcaggcagcgtttgcggtgagcatcgcgcaacgttctccagcagaatgcggatgctgtaaggcaatgtctgcaactgctccagcggtacgatctgggtgaggtcaatataatgatataggcggttatgaataaccagcgatgagcgtttcagcgttaagggcaatgtcataaaaaccttccgtcacagcaaccttgttatgttcgtcgttggataacgtctcatgccctcggatgaatgaaaattgaacattaaccaatgcagcgttctccttttgagaacactgcattaagtttaagactcggtaagatttcggttaataatctcacttatagcgccattttcccgccagttatccaaaaaatggctgatttcaccataaagttggtcatgggcatgcggcagacaaatggcctggaaaatctgcccgaaattatcgggcaatacgcgaaaaccgctattgttactgactgcacgctctaaaggttgacggatcccagccgccatgtcgccttcgccatcgagaaacgcatcgatcgcggcctgtgatgaagctagtcgattaagcgcagcgtgttttaattcgcggctcaggaacagatcgtaggctgctcctttaccgacattgatgaccacatcaggtttatccatctcggccacgctttgccagtcgctgttctctcttaccatcacggtaccttcgatggtgatataagactgagtaaatcgcagcacctcttcacgcttcgggtctatagccaaaaaggcgacgtcccagcgatcgtgagaggcatcatctaccaccttgcctgctgtgggatacgtaacaaattgcgcgactcttccctgttcagccgcaattttttgggcgatctcaacagtaatcccaccaggctgcccatcgggcagcgttttggccaatacggcgttacctaaattgattgcaaaacgtagtggggttgcgttatcggtggctgacatgcggttctccagaaaagtcatcatcgtgatcctgtttcggcgtttcaaaattcagacgttgaatttttccagccacaaacagataacagcacagattgaggaaagcgcagacgccgacaaaaatcaaagcaccattgaatgaaccggtatcttttatgatgtaggcaatgatgattggcgtaaagatgcccgaaatattgccaatcatattgaacaatccaccgctcaggccgaccgcctctttaggtgagaagtctgagactacgcaccatcccatcgcaccaaatcctttgccaaagaaggccagcgacatgatagccaccacaacccaggcggaatcgacgtaattgcaaataaccatactaacggctaacagcatgccgataacgatcggtgttttacgtgcggctgacaggctgaaaccgcgcgccagcatgtaatcggataacacgccgcccaacaacgcgccggcacatccacataacgccggcagtgacgcgataaatcctgccttgagaatggtcataccacggtcgtgcaccagatagaccgggaaccacgtcaggaaaaagtaggaaagcacagtaaagaagaactgacccatatacacacccagcgccaatcggctggtcagtaatttacgggtatatcctttgccagcgttatcgccttttttactggctttcatgttggtcagaccgccgccggactggatatattcaagttcagcatcgttaaccaacgggtgaactttaggcgtatcggtgagtaccctcgtcatcaacagcgagaccagaataccgactgcgcccataaaccagaacactgactcccagccgaacgaataggagaaccagcccatcaacggtaagaagaccaccagcgcgaaatactgtgctgcggtagtgaatccggaagccttaccacgctctttcgccgggaaccatgccgcaaggaatcgagagttggcgggtagcgttggtgcttcaatcaaccccatcataaagatgaagccgaacatcagtgcgcgtgtcacccaaatattgtcaaaagaggtgctgaatcccaccagaaagacgaacagtgaccaggtgaaaaccccggttaccagtacttttttggacccgtagcgatcaagtaaccaaccacctggatattgccccagaacatatgcccaggtgaaggttgagatcaaataaccgagcgccacaatatccagcccggcagatttcaccatatccgtaccggcaatcgagaaggtcgctctatcaccatgatttaaagcaatactgaggaataccataagcaaaatcatatagcgataatgcgtaggtctgttctttttagcagtggagttcagagtaatcataatattcggccttgtctggcatacgattaattaaatcggtaaagttcagccgggttttccacaaataatttgtgtctaacctgatcgttatgcgcccagtggtatattttcgatagtatcaatgcatcatctggcatatttttattagcacttattaaattgggatgtggccagtcacttccccataaaacacgttcagttgcatcgcgaagaaacccggtaatcagagcagccatatcagacacatcatcacaatgtgactgatgataaagcgcggaaagttttacccagcaccggcccttttcaatcagctcccaagccagcttccaacatggatgggccatcggttcaggctgcggtaaacgaaagtagtggtcgatgaccagatttcccggtatctgaagtagcgttgatcgcaattgccacaactgatccgcagtggcgtggacctgcacatgccagccacgttccaccacgcgttgcgctacggggagcagcatttcaggtgtcgttgcattgcccgcaccaagattgaaacgaacccccgttacgccagcttgctgcagcgcatccagttcggcatcactaacagcgtcgtctaccacggcttcacctcgcgcatgggtgccaaaagcacgtaatgcatctgtcagacaacgattatccgttccataagaagagggttgcaccagaatatgacgagagtgtcccaaccattttttaaactggttgtaatcgttgacggttgcgttaggtaaattacgcgtatcatccgttgcatagggataacgcctgtcgaaaacatggtgatgacagtcacagctatcttcaggcaatacgatctcaggcgagtgtgaaatatggctatatttcacatccgccaatatatctcggctttccacgttgatgccttttttaaaatgaaatcgactgaattaattaatgagccattaatattttcagttttgaaacggctgcatgtggactgctcaataccggacagttcactgcagactgaaccttctcccaggcaatggccatcgagaagtgcgcaaggaggatggcatcagcctcagtatgttcacgagcagcctggacaatgagctggttgtggcgctcgacatcaccttgctcaagagcatcgcgcgcccctttaaccaaaacgctggttaacgtggcgtcacgagaacctttgcgtacgagttcattaaattctgcttccatccctgcgacggcgggcgcaaacgttgccagcatgacgatattttcaccctttgctaaagccgcttcaaacatggcttcgtttggtttaagtaccggtatagtgtttttcgctgcgctggcgtcaatcgcttcaccaaatgcagagcaggtaaacagaaccgcaccggcatcaatgttggcagcatagttcaccagtgagtcgatccgctgaaacagacgatcggtcaaaaccgtcaccttccggcgatccaaacttaacgcgtcatcaagcaagttactgatttcagcctctggccactgatgggcaaaagcctggttgatcggctcaaccgccagtggagtcgcgtggattaaaacaatacgttgagtcatcttcggctccattaaagcaggctgccgctaaagtgcggcaacctcatgacgtttactcaggcgcgaacagaagcagccactttgtcagcaaaggctttagtgccacatttgccacccagatccggggtgcgggtttctggattttccagcacctcatcaacggcacggctgatctcttccgccgctttcaggaattttggctggttgtgtttctctgcataccattgcagcatcatggcaaccgaaagaatcatcgacaccgggtttcgccttatcctgattctgaatatccggagctgatccatgctgagcctgcgcgcagcaatgagtatcactggccataattgaacctgctaggccaaggctgcctgacaattcactcgccagatcgctgatgatgtcaccatagaagttagtggcaaccagtacgtcaaaacgctctgggttacgtactaggtgggcggttgacgcatcaactaatagatcgtccagctcaacttcagggaactcttttgccacgtgacgcacggcttcaaggaacaggccatcagtcatatggaagctgttagctttatggattgcggtcacttttttacgacgctgcatcgccagctcgaaggctttgcgagcaatacgctcagagcaatgacgggtaattttacgggtagacagcgccatatccggactaggcatcacttcaccccagccgcgagtcatgttgcggtctggatagaacccttccgtcgcttcacgcatgatcaccagatccatggatttgccttccttcatattagacgtcaggaaaggacgagtgcgcgccggacggacgttagcatagagatccaggccaatacggaagccagcagaaacgttacggccgcctttttctggagctggataatccgcgtgggactgggtacccagaataatgccgtcataggttttggcgcggtcgagtgattcttggcgcagcgtagtaccgtgtaactccaggcttttaaaacctacgtcttcgtagtcgaactcaaagttcaggccatacgctttatccagtgactccagcacagttaccgcagcagaagtgatctcagggccgataccgtcacaaggcagaaccaaaatacgcataaatactccagatggttggtcaattttcgattgcatttttataccaataaatgcactgaaggcaaggtgattgagatcacatttctgatacaaaaaaaacacattacaacattacctcatcttttcagtaagttatgaagaatccctgcgggctttaggattattacccgttgtaacagcctgtccaaagattctactcacacccgtttgttaaccataacctcttattttgtgatctaaagcacaaattaacatcaaccatgattgcacttatatttacataaaagcagtatgggctcaatttgttaccgatttagaggaacgcatatgattaagttgggcgtcatcgcggatgactttacgggtgccaccgacattgcaagtttcatggtgaatgctggctggaaagtggtgctgttcaatggcgttcctgctgaggcttttgatcaggaaggcatcgatgcggtggtcatcgcccttaaaagtcgttcgattctgaccaagaccgcggttgaacagtcattgtctgcatcaaattggcttaagtcacagggctgtaagcgtcagctattcaaatattgctcaacttttgactctacaaaagaggggaatattggtccggttaccgatgccctgatgaagaatctaaatgcgtcaatcactttgatttgtccggcagtaccagacaatggaagaaccattttgcatggccatctgtttgtgaaaggccaattattgaatcaaagcggtatggaacatcatccagtcacaccgatgagagagtcgtcactaaaaaaattgatggaggcgcaatccaccggccgttgcgaaatcatcaatctcgacaccatcaaaaatcatgtaaaagacattcctgatgccttagccaaactggcagaggaaaagatcaaatatgttatctgtgacgtactggataataatgatctgttaaccgtggcgcgtgaaaccgcagattatgccttcatcaccggtgcagcaggtattggctatgccattgcggcactggatacgatgcataaatccgatgataagcctgcatttgctatccgcaaagagggcgcaagcattgtcctgtcaggtagctgctcttccatgaccaaccagcaggtgaacttttatcagcagcgcgcctcatcactggcactggatgtggaaaaaatccttcacgaaccaacgtacctgcagacggttacgggctgggtagttacccaaaagaatgatgtgttggctcccatggtctatgccacgcaaccgcctcagattatcgacattattcagaagaattatggtgcggaatttgtcagtcagaagatcgaaagcttcttcgcttcgcttgcccacaatttaagcaaagaaggtttcaacaaatttatcgtcgctggcggtgaaacgtcgggtgcggtatctcaggggctcaatattaaaggcatggtgatcggcgatgctgtcgcgcctggtgtaccctggacacaggtattggatgaagaaaagtgggtaattctcaagtcaggcaactttggtaacagtgatttcttcttaaaagcgcaggagagtgtgaaatgaacgaagtccaatatcgtcaggatttagtgcgctacgcacgctccctgtttgaacgtggttacagcagcggtggcgctggaaatatcagcctaaaactgcctgatggccatatcctcgccaccccgacgaactcaagttttggcgacctggatgctgatgaattgagtaaagtcacgatgaccggtgagctggtttcgggtcaaaaggcgtctaaagaagtgctgatgcacctggcaatgtaccgtcagcgtcctgcttgtggcggcatcgtacatttgcactccccctggctgacagcattatcctgcttgcccgatctcgactatgaaaatgcactgccggcgataaccccttactacgtgatgcgtgtgggtaaactgccggtggtaccttatattcgcccaggctcgccagaaattgctgtgcatgttgaaaagctggctaaggaacataattcaattcttctcgccaaccatggtcccattatttcgggtaaaaatatccgtgaagcggtttttaacgcagaagagttagaggaaacggcaaaactctatttcgtactcaaaccctatggcatgaaaacattaactaatgaaaatattgatgagctcaataagctattcaatatgaaataaatattgccatggtaaagctgtgcagatttatctgcgcagcgtttttttacatcttctactctcaaaattaaaaggataagtcatgtctttgatgcttatcaccgggattgtcatgtttgttattctgacatggtgcttattgaaaaataagtttcctcccagtgtgctgtttattatcttacctacggtagccgctttagtctgtggatttggctttaaggaactgggcgaatatgtcgcttcaggactgaaatcggtagttggcaccgctacgctagtcgcattcagcgccatgttttttaccctgatgaaagaagcaggtgtgtttgacgttattgtgcgtttcatcctgcgtttcgtcacacaatcgaccttttctgttctgcttgcgacattggtcatagcctcagtctgcagcctcgatggtaatgcgtatgcaaccctgctggtaaccgtccctgcattgttaccactgtatgaaaagatgaacatcagccgtaaaacgttgctgatgctggttaccgttggggtcggcgtaacgggtattaccccatggggaggctcactcaaccgagccattgcggtgacccatctcgatattcttgacgtctattacaaactcattcctttgcaggtcgtgctgtttgttctcggcgttattctctgctggtacatggccagagtagaaaataaaagtggttcgggcattagtaaagaagccttcctggtgatgcgtgaggagatgcttaccagcaaaggtgatcataatccatggctgctgcgtgctaattttttgctggtcattgcaaccattgtgattctggtttctggattagtcgcgggtaacttcctgtttatgatcgcattctcgctggcagtcatgatcaattatccggatgccaaaaaagcacaacagaagattaaagattacgcgttaaccatcttcccggtaatcgtgatcttcttaaccattggcgtatttgtgggcatattgcaaaatactggcattattaaagtattagtgaatgaactcgctgcagtacttccttccagtttaggaccttatctttatataattctggctgctttcagcgtaccgatcgttattttgattggatccgatgctttctattttgcactccttcctctcgcggtaggccttgggcaaagttttgacgtttccccgctgcacgtcaccatcgccatgctcattaccgaacaaataggtttgctgcttagtccggttattccggcaacgcatctggggttaggactgcttaatcttcaggtcggtgagcatatccgtcactccatggtgaaaatctggatcatgagtgtctgtgctctgttggccgctgttgttcttggcattattcctgtctgatgaggagcgatatgattcccgcagagcgtcatcaacggatactcgaggtggtatccattaagcattttgtcagcctgcgggagctgtcagatatgctggatgtcacggtgatgactatacggcgggatattgaacagctcagcgcgcgtggcgtcatcatgcccacgcgcggtggcgtgaaatcacgtgaaaccccgctacgtttgcccgttgaacgccccggggctcattatctggtccgtgctgcgctacgttatttaggtgatagcaaagtgatttatctcgatggcggaaaattgacgtttgagttggccacgttttttccttacagcgatgagatgaccatagtcactaatgactttgccattgcgcagcatgttatgactcactctagcgctgcccttttttttattggtggcaaactcagtcgacatgacaatacttttcatcaacgcgttgcgcttgagaccttgcagagtctcaattttgaaaaggcgtttattgcaccggtatcatggagtgataaaggcatttttcatcatgatgagtgcagagcggcttactatggtgcaatcatcaacgcagcgcgaaaatgtatcatgctggcagataacaacacttacggcagcaacgcgctgtacaagatgttctcactgaccgacatggacatggtcattactgacctgccttcgtcggaggtgattttgagcagacgaatggatccgctaaagctgcatcccgtcgcataaaaatagcattgccatactcaaaacaacgggttagcagcaggcctacagcggcaacggacgatccttaatgatggttttcataaccagggtcgacgttagtctttgtacgccgggcatagcggaaagtttctcatcatataactgctgaaaagcgggcaaatcacgcgttgtgatatgcagaagataatcaggatcgccaaataagcgttgtgccagcataatttggggaagttctttcactgtctcttcgaacgcattgacggccttacggtcgccatcacgcaatgtcacgaatacaatcgccgagaagctataacccaggaaggcaggatccagctgagcacgataccccagaatgacgccactctgctccagcgcttttatcctgcgatggcaaggcgacaggcttaatccaacccgctccgctagctgagttacggataaacggccatcagcttgaagttcagcaagaatattgcgattgactctgtccatgggcaagattgttcccttatcagtgacatcatgcattaaaattgaaagcacattctaaccagctgaggatattctttctacctgctaatgctgtgcgacgccgcctagcatctggagatagattctgtttattttcattattaaggtagaagatcgtgtgcaatataattactttaagtcgtcccgaagtcgctgtgctcagcatgcctaatacaacgagtggggtgtaactatggcgctgagtttttttgctgcgttttgggccgtttcagtgctgtttgtcattacccctggagcagactgggcctatgccatctcagcaggaattcgcgggggccgggtcgttcccgcggtcttgggattgctctctggccacttgattgcaacgttaattgttgccgcaggtgtaggagccgtggtcgcggacttgcccacgctcatgaaaggattaaccgtggccggtgcctgctatttaatctggctgggaataggcatgttgcgtcatcctgccgtttcccaccgcaggtgaaagacagaacgaaggtaatgcgctgcgttgggctgtaaaagggctttgcataagtgggctcaatccgaaggtattcctgctgtttttggcgttgctgccacaattcactgatccgcatggcgcatggccgctctccttacaaatggccgcattgggtatggtgcatatcttaagctgtgcagtggtttatctgatagtaggtttcggatctaaagtagtgttacaaacccggccaagggctgcacgcctcgtcagccaaatttccggcgctctgatgatcattatcgcagcgctattactgacagaatcatttagatgagacattgagatgccagagatcaacctgacccatctgcagaagatgaagaaaaacggcgaaaaaattgccatgcttacctgctacgatgctaccttcgcgcatgagtgcagccgcgcaggagtggatatgctgctcattggcgatacgttgggcatgatattacagggacacgacagtaccctgcccgtgatgctggaagatatggtataccataccctcagcgtgaatcgcggcaatgcagggagtttcattatcgctgatctttcgttcatgacctattcatcgccacagcaggcgctgcacagcgcaggtcgattaatgcaggcgggagcaaaaatggtcaaactggagggagggacgtggctttgcgattctgttcgtcagctgacacagaatggcgtgcctgtctgcgcacatatcggcctgacgccacagtccgttaacgtacttggtggatttaaggttcagggacgtggggagctgcaggcgcaggcacttatcgatacggcagtgcagctggaaaaagcgggcgcggcaatggtcctggtggaagcagtccctgcttcgctgggactcgcgctcagtaaagccgtatctgtgcctgttattggtattggtgccggagctgacactgacggacaggtacttgtcctgcatgatatgcttggtctgagcctttcaggacggatgccaaaatttgtgcgcaactttatgagcgggcaggagagtattcaggctgctctgaaagcctatgttacggctgttaaagagggaacatttccgacagaagagcactgttacgctgaataagaatgcgcagcattaagcccttgtgggcttaatgctataagagggctgtaaaggctccgcgaaattcggaaagtcccgtagccgactgttacgcgcagaggggaagcctttcgttatttaaaatcgacctgataatgcttttattacctccaaattactgcctgatgtgcgaaacgacggatacgcagctcaccactcctccagttaccatctgaatctttatttcctgaaatcaaacgattaagcgcctcttccattagcaagtcgagacgctgactgtaggtggtcagttgccatccgggtgcggaggcttcatcaatgtcgtcaaaccccactacggcaatagcaggctcatgccctgcgtcgcgaagggcttccatagcgcccagtgccagtacatcattctcacaaaacagtgcttcaatacgttcaggcgcagatgtttgcagcaaatactgcctcacaaggttataactcatttgacgatcatagtgttcagcattgagctcaagttcaaggccaaaactctgcgcgcacaactcatcacgaaaaccttgtttacgggtcagatgaccttccccaccgcctgggccggacatataaccgaaacgcttatggccctgttcagttaacaggcgcgcaattacccgtccggcctgataaccatcaatatccacgatgtcaatttcctgccgtcctgtgttacgacagacctgtattagcggaatatcgtgcatttccactgctatcgcaacaaactctggcgtaagtaccgtacccaaaaacaaaatgccgtccacctgcagttgatctgccagcgacataacggcgtaataattgtcacccgtaatattaagcaacagggccatgtatccacgcttctgaagctgacgcgtcacctcatcaagcatcaacattgaatgaggatttttcagttcatcaacagccacgccaataatgtgcgtgcgcttttgagataacccgcgggcaagcaggttagggcgatatcccagctcacgggctatcgccatgattttttttcgtgctttttcagaaatagacgcatcaggaataaaagcgcgtgaaaccgtccatttagataccccggcgcgggcagccacatcactggcggtcactttttgccgctttactgttttatttgtcatgcaggacccggctgttaagttattggaacaatgaatacataaaatcaatgataattatggttaaattttttcccagaagtcagcactgtacgcagtaaaataattcctgcgataccctctccttaatgcacccggttgcaaaaaatgtgatcgggtgtcgctattttattacaactcgattgactaagtttaacgtcttgtacacagtcactgaatcttcaatgcagatgctgtcctgacaccgctggaaaagcataagctcgtttgcacccggttgcaaaaaaatccagtgggacaggttcagtattgtgcagaagtatacctgagcagaaagctgtcgctcttcgcgtcaaggttgcattaatttatcccacaggatccggtaatgaataaagccttctgtttactgatattaatggccctgccgctggccaccccggtgcaggcaaaaatggcacaggttggcgtagctctggctaattttgaccttaattttgtttcaatactgcgtacacaaatgatccatgagctggatacgcagggcatgaaaggacagttttctgacgcaaaaggcgatgttgcgctccaggtacagcaggttgatgattttattaatcagggagtggacgccatcatacttaacccggtcgacacacagggcgtacttccgatgatcaatgcggctaaaaatgccggtataccactggttttcgtgaaccgtaaaccagaagtaccgctgacgggggcaatgagctatgtcggttcggattctgccctgagtggcaaaatgcaaatcgaagcactggcaaagctgatgaattaccgaggcaacattgccattctgatgggcgccctttcaaatgaggaagcgcgcgaacgtacccgcgctgttgaggaggttgtagcacagcacaaagatatgaaggtgattgagaaacaaaccgcaaaatggcagcgaaatgaggcggtagacgtggtctcttcatggctgcttaacggcacgccagtcaatgcgatcgtcgccaataatgacgaaatggccattggtgccatcatggcgctgaatcaggcgaagaaaaaagatgtcatggttgcaggcattgacggcacacctgacgggctccagtttattaaaaatggtcagatggtggtaactgtattccaggatgctaaagcacaggctattggtgccgtgaaagtggcatatgcgctgattaataagcagaagacagataattaccactggatcccctaccagactgttaccagagccaactacgaacaatttatccagcagaaccagaagtgatttttattaaacccatctttgcacccgggtgcaaagcgttaattcggagtatttatgctaaacggtgaaaaaagtatttcccgcccactacgctgggccatgatcggcggcggccggctcagtcaggttggctataaacatcgttcgggtgcactgcgcgataacactgccttccggcttgttgctggtgcatttgacgtcgatgccacccgaggccgtgagttcggcatcaaccttggcttaccggccgaacgttgttatgagaattatggacagctgctatctgaagaagctaagcgtgaggatggtgttgaagttgttactgttgccacgcctaatggcacgcattttgaaatcaccagggctgcgcttaatgccgggattcatgttatctgtgaaaaaccgctgttttttacctcggctgaagcgcaggaaataaaagcactggcggcggaaaaaggcctgatcgtgggcgttacctatggcttttcaggccatccattactgatgcagatgcgcgccatgattgctaagggcgaaattggtgatgtacgcatggttgaactgcagtacacacatggatttagcgcaactgataacgcggacaagttcagcgatgcgcagaaatggcgcgtagaccctaaaattgccggtccgtcatttgtgctgggtgacatctcaacgcatactttttacatctctcagcttgtacttcctgacctgaaaatcaaaagtctgttatgcgatcgtcagagcttcattccgtcccgggcaccactggaagataacgctatggtgctgatgcattatgaaaacggtgccgtaggacgcatgtgggcctctgcaataaatgcaggctcaatggacagccagagtattcgcgttatcggctcccgggccagcctggaatggagcgattataacccgggagaactgaaatttgaggttcagggccagcctaaccagatgctgcatcatggtatgccataccttgatgaaagtgccctggccgatgagcgccttggggcattgcataccgaagggctggctgaatcatgggccaacatctatctcaagttcgccattgccatcagcgcgactcagcgcggcgacagtaaaactcttgaggcgctggtttatccggacatcaacgcgggcgccgaaggcgtgcgctggattgaaaactgtgtgcgctcggcagatagcggttccggctgggttaactacgaataaggaatgacgatgaaactctctttctgtacggacagtctcggccacctgccttatgagcagatgctggacaagctgcttgagctgggtgttaacggcgttgaaatgactaccggaggctggtcttcagcaccgcatgtcccaacggctgagcttctggaaagcgcatcaaagcgtcagcagtttcttcacgcgcttgaaagccgcggcatgaccattgcggctctgaacgtttcaggaaaccctctggatccgggagatcttggacaacgccacagacaggatactgaaaatgcgctgcggcttgccggtgaactcggggtaaaaaaaatagtgatgatgagcgggctacctcctgccagtccccatgacaccattccaaactggatcacctataccgtcagctggccacccactctgaaaaactgcctggactatcagtggaatgaggttgctattccctactggcaggatctgatcgggcaagcaagcagcagcggtgtcgaaaaatttgcgctggagaacttcagttcaatgcttgtctggaatccggaaacgctgttccggctgcgtgacgccgtgggacctatggtcggattgaaccttgaccccagtcatcttatctggatgggggccgaccctatcgctgccgcccgcgcacttggaccggccatacaccactgtcacggtaaagacgtacgccttgagcgtggtctggtgaacattaacggtctgctcgaaaccaaacccgttgaggacgtcgcaaaccgggcctggaactatgtggctgtaggctgtggtcaggatcttcagtggtggaaagaatttttctccgtcgtgcgcatgacgggctataacgactgggtttcgctggagatggaagatctaaccatgtccgttgaagccggtgtcacatcatcaattgctgctctgcagcagactatcagtcagtaattcctgcttcagggctgccgtgaagcggcagccttgtcatcaagatgttcatgcctgaactgaccattaaaaaatgtaccccacatagcccaatcttcagatggagtaagccagatggaacattatatttctaaaaatcctgcctccggccccaacagtaaagtgcgaacccaaccgctcgtgaaagtcattaccgcgattgccactttaggtggtcttttgtttggttatgataccggcgtgatttcaggcgcattactgtttatggggcctgaactaaagctgacccccttctccacgggtctggtaaccagttcacttttagtgggcgctgccacgggcgcgctgatttcaggtggactggcagatcgccttggtcgtcgtaatattatccttattctcgcggtcatttttggactgggagcgctgggaacagcccttgcgcctaacctggaagttatgctcttttcccgtgtagttctaggactggcagtcggtggtgcaggaagtaccgtgcctgtttacctggcagaaatagcccctgcaaaccggcgtggacagcttgttaccatcagcgaattaatgatcgtctcaggtcagatgctggcttacatctccaatttcgcactcaatgcactctggggtggcgagaacacctggcgctggatgctgggcattgccacgctacctgcggtcatcctctttttggggatgctttttatgcctgactctccacgctggtatgcgcttaaaggtcgctttgctgaggctcgccgtatcctgagccggacacgggcaaaaaaagatgtagagtgggagatgatggagatcgaagagtccatgtctgaaaattcacagcaaaaaggttcgctgcaggatttacgtaccccctggatgcgtaaagtcttttttatcggcgtgaccttcgcctttttccacgcagcaacagccgttaacagcatcatgtattacgcccccattattctgcagaataccggcatgagcactaatgcctcactgtttgcaaccattgccaacggggtggtgtctgtcatcatggtcctgattggtattgttttgctgggttatatcggtcgccgcaccatggctgcggtgggtcagatagggtgcacctgctgcctgtttctgcttgccgctatatcagcttttatgccggaacaaattggtactgatataaatctgttacgcagctacttcattcttggagcaatgttactgttcctctgttttatgcagggctgctactcgcctgttatctggctgatgctgtcagaaatgttcccatctaaaattcgcggtatatgtatgggcggctccgtatgtgcactctggtgctcaaatgtaattatcactatgtcttttccggtacttttgtcttccttcggactggcctggacatttggcatctatggcattgtaggggttataggcagcgcttttgttctgaaattcatcccggaaacccgcggccgaagtctggagcaaatagagcactgtctgcgcgatatttacagagataaaaaacagaataaaagacagcactgtctgaacactccagatttataacttcattgaactattgcagaaattgaaccttaactgggaacctgattgacaggctactatgctctcctgcatgagcatagcagcctgtcaggaaagtccgcttctggtacaaggcggactgtgcataggtgatgtccgcaatgagcgataagcaaaacattagagggtatgttagccagcttagcttcgaaaattaaataaggatgggcttcaaatgaaagtgaacaattgccagacttgtcgccagccaatcagtttagaacacgaatcattgaatcttgattgtggcggcgattgtttaagctgcatggcttggcatggtgatccagatgcaattgaagctgttgagaggcttactgtcgagaaggtcaataatactgttcacggagtacaccatgccggagttctgcttttttaaaaagggtgagcatatcgccgccctggaacgaaactgacgtggaaaaatccgctcaactcgccaatgctggctgggaaaagcagtttgaagaggttctcgctgcctatgctgaaagtgcgctcgccaggctagcggaaatgcggaaagaggaagtcacgacggagagagctttcgtaacgggttccgtattcagcagtatcctaacggccattctcaagtaacgaccagctggtagcgttatatgactctgccagtccctcacttttaacctaagaattaggtcacgaatcccatggctggaacaggctgcgagcctgctgcccgtgcgcatccatgataaaggcgtgttacagtaagcggcggtttttcttaacgcgaatttcactgccttactttccttcccggccccgctggccaggtttcgggatttttttcagccatccgggatgtttgtcccggatggctgccccggagctcaccttctgtatcacgactaagcccctgagcttcaggcaccagacagcgaacgccggccgcagcgtgcccgctttcagggcaaaaaaaccgccatcacggcggtacaaggaggaatactgtgactcttgcttttatcgtggtcagccggagccgccggccggtcttaatcatataaaaaatcgccgcgacagcaagcgtgagcgggtaaaaaactggctgtcatgtccgattcccgcttcgcctctgccgatgcggcggtgcctgaggcgccaggattttgcccgtaaaaaaactcgccatctttcggagcggactgaacaatcagttctcgttcacaggttacggcaaacgggccggctccagcatggaagcgactccgcttcagcatggaagaaaaatgcagttcagcaagcaggcaaacgccgcggacggcaaaaaaatggctcctccaggacaggaggagccagaagcaaatcagatacgaacaacaatcagtttatgtctcccctggcgaggcacactatgattatcggcacacaccggccgggcataagggcagccggcatttttctttttacctgccatccgtcacgtgtttaacataacagtgcttatgctacttctgctttggcacaaagagcactgctttggcgcaaggtccgctatgagcgaaaatcggacgttagatcggggaataaatcgaaaagtgtggtaagactgaaataatattgctttcagtctgcgagcgagaaatctgggttttatattccacgatttgttaatggcaggtcgagtgaaaaaagtgcgttataacgggaccggcaggtagacggtatatgatcaggctgcgtatgaggtttgattcgctcgccgccacctgcttttattgtcaggtggcgggggatgcatcggattcgaatatagtgtccgctgtaatggaggatgcctatccttctgactgtagccgtatatgcaatttctccagcatcagaaactatgccagttttcttcctccgacgccgcgttgtccctgccaacacgcccgccgggtaaagacgacttaaaagctgtactggcggtcgccggttccagagccggtacagggctggaaccgacaacaaaggcagctacaagctggtttaggacggaggcctgctccatcagtgagtttgaggctgctgaagcttcttcaacaagtgccgcattctgctgtgtcacgtcgtccatctgattcaccgcctggtgcacctgaccgatgcccagcatctgctcatgagcggcagccgcaatttcattgacgaggtctgtaacctgcccgatggcgtctttcaggctccccatgttattcccgacctcttccgcctgttgtgcgcccgcttccacgaaatgcattgatgactcgatgagagcttttatttcacgtgctgaagacgatgaacgctgggcaagattgcgcacctcacctgccaccacggcaaatccacggccctgctcgccggcccgcgccgcttcaaccgctgcattaagtgccagaatattggtctgaaaggcaatgccctcgatgacggaaattatatcggtgatttttgccgaactgcctctaatatcggacatggtccggagcatcgtggtcaccttctgagcgctgtcttctgaaagactgcgggcgttctgcgagagctggctggccgtgccggtattctctgcggtctgacggaccgtttcgctcagctccgacatgctggccgctgtctgctcaagggaggccgcctgctcctcggttcgggctgacaggtcctcattgcctgcagatatctgcgcagaagccgtgctcacggactgggatgaggtactcacggacatcagggaagcagcaacgttacccgccagctcgttatatgcacttgccgtcatgccaatttcatcctgacgcgaatcgtcaacccggagagttaggtcaaggcgtgaacttgcctgctgcatggtggaacgcatggcattaagatttctccggatgccggttatcgttctgacggcgaaaaaggccagcacaaaaataacgaccgctgaaccaccgatcataccccacaaagaattctgatagattcgggtattctgatcgctgagcgattcaccgatatccacattcagcttaagctgtttctgatagccggcaatcagagcgcgggcggctgaaccactgccattgtttccctggatttccgcaagcgatacggggtcattctgcaagcgtgaggcctgaagaaaagccgggagcctgctgcggaagtctttaatggtggtaaatgctgcctcagtcattaccctgtcttcttcgctggaaatatcattttcgagataataatgattgagtgactccagctgacttaccttctcatcgagccgcttttcgacttcggcctgcctggccgggtcggttgcgctctgatggcggtacatccagataatcaactggttactgccgtccaccagttttccgaggtcgataatggagggggttgcattactttgtatatactggaagcgtgactgaaaacccgtcagcaccagcactgccacgatcaccagagtaataagcgagacggccaataaagaaaataatgtaaacagccgctgtgtaatcgtcatagtttttccacctaatttattgaaaaattcaaagaaccgcttaaacgaacatgcggtactgagagtgcttatcggcatcaggcgaaaaatagttagcactttctgctgttactgtatgaaaaaaacataatttaattttaaatgagatgataactttggttatttgctctgattctagccgcttgtttatgagtatgctcatatgtttgcagtgtccgtttcttgcacaaagcagactgaaataagacgaatttctgctgtgagccaaaagcggatgatcggcatgagctcttcctgatgaacagtaataccagttaatggggtaggcacatagccgcttgtcttgacggccttacaccaggataattatcgctgaggtttggctcggcaaataaagtgctgcccccatttttcagcctccacttccaccatttctactatctcaagccgtttatctatactgactattgcagtggtcatttgcacaggatgccgcgccgtagtcaactttttcatttgcatacagagtcagacacgctgcggcagcagaaattctttttatccggaagatacctgatggaaataactgagtttgtctattccgccttgattggtcttgtcgccagctgccgtttctatgacgccaatggcggccctcgctgcagcacgccttgccgggcatgaaacatcgggcaggcttctgctgctggaccgtccactattcaaatacggtgcgttagcgatgggtataggtgaactatttggcgacaagatgaaatcagcgccagaccgtactgtatttttgggcttgtcagcacgggtggccagtgcagggattgcgggcgccgcgttggcacccaatggagaagaaaaaaccggtgcagtaattgctatttctgccgctgtgccacttacctatgtcacgcttgcggcacgcaaaaaggccatagcagggatggggcagaccaggagcggcctgattgaagatacgctcatcgtcgctattggggcagcggtggtcttctttgcaacgcgcccaaatcgtatttgaacatacaccgtcttcaaaggatgatattggcgagccatcatgaaggtgttagtgaaggcttctggcacaaaccggacagctatcaggctaaagtccactatgagcgaaaagcggaccttaaacatgtttgttctaaagaagccagcccgctaatcagcgggcttacggccattattttttaacatgtatatgcaggaattgacggtttcgccattatccgtagtaacttcgacgggcacgcgctcatattgactaccttcaaattcgtcaagcacctgccagtgacgctgcaagttaacagaggtaaaaaggaatccttgcacgcgattacctgagttatccaaaaaataataccggcataacccgtttcgcctccccatccctcattgataagagagcctgagacatgccctttgcgccatgtaccacctatcttttcgagaatatgagcgttaggacggcctggtcccagcgttccgtagacaaacagactttccatgcatcttcctgttaagcaataataaggatatctcactatcaacttttcatccggaggagaggcaaacccataaagtatgttaatggcacggagccgacctgtaagcacagcctgcccgctatgagcgaggagcggatgtctagcttgcagcaagacggtggcaggatttattggggttatacctactgcttttttagggctacaacccgatatccgtcgggatcaacaaatgtccttccgttgatatttaagtataatgataatctttatcaacaaaaggatattgttatgaatcggtatatgttgattctggctgttcttgtagtcagcgcatgttctacttattcacctgttaaagttgaacaaccaaagccccttcgacaagatcggcccgattacccatactatgcggtcaagaaccgaatagaaggtatggttaagtttaactttgacgttgatgcagaaggcagggtaagccagatgagaattatcgagtctacgccagaccacttattcgataatgctgtaatatcagccgtatcaaaatggcgttttgaaaagggcaaacctgccaggaatctgcccatgactataaaattaaaagtgcaaaaatagatttaatttaaatgctacatatttgaaaattaatgagtgtaattcaggaagttattatgggtgaatgctgttcttctaattattaacataaaatattagccaatgtgcttctggcacggggctgctgttgcagccctcgcgagttagacttcaatcgcctccgatatctcaagggcatcatcgacttcaatgccagggtaacgaactgtgctttcgagttttttatgacccaacagtagctggatcactcttatatttttcagttttttgtagatcagatatggtttagttctgcgcatagaatgcgtactgtaaagcgaatcgtcgagacctaacttctcaatcccgccatgaaaaatacggttatattgcctggttgaaatgtggcgttcagaaccaacgcgggactggatatatagggtcaaatccactggaaaagatagtcgccactgcgcagatgagccatttcaatccatgcagctactgcctctctggttcttttagtcagttcaaactgaacaggattctccgttttttgctgcattactgtcgctctacccgaaacagaatgtccgtaggctacatcagacaccttcagcttcaccggatcacagcccgaagtttactgtccagagccatgttaaacaaagccaggtcgcgtacttttccttccagctcgagacggatgcgaattcctcagatatgagatatctgaagaggtcgcttctggccaatgatacggcttttgttccaaggatattgtcatgttcaatctccattaggtcaggagatgtgattatggatgtcccgtatgagcgaaaagcatacatagcagcccctttacaggggctgaatgagtcatattcgtggctaacggacacccgtaacccgtaagtaacatagagcgagtcactcagtattatcgggttgaaacaggcttctcgtcgattttcacgcgcatgagggtataaggttttttgcgcatatctttaccaccatggaagcccggctgccggtgcagctggttcacggtaaagtaaagatatccgtcatgggcaacagaaagtgtgtccggccagagaatttccggcccgtgaacaagcgtggaccaggttccctgcttatccatttttcggacagcattacgctcgtaatctcctgcgtaaacattgcctgcagcatcagattcaagaccgtcagaggcccctttttcgccccagtcccggacagcagcagagaggctctgctcactgaagtgactgtctctcagcttcgcggtttcaactgaataaagatgacggcctgacagcgggctgtaatagagcgttttcccatcggccgataacgcgattccatcagacgcaacgctgaagggagcagttgatccatccccatggcgctgcaacagggtttcgccctcgacaaccggtacaaagcttttttcaggtgaggtagaacggtcgccggtcaggcggcgcattgcctcacctgatgccagatcgacaataatgataccgccagttccggaaagggaagaatcagtgatgtaggcgatccccgctttacctacacggtaatcaatacgcaggtcgttaacataggtggcgggaaggataacttttgccggtaacacaagcgtttttactaccctgttactgctgagatcaatcgcaaccagtttaaccccgcccgctaccggccggttaaagcccggcgatgcggtatcgagtacccagagttttccctgcccatctgccaccacgctctgtacgctcagaaaacgttcagccggacgggtattgtcagccacattaatagccacatctggataaggaaccacttttccctgtctgagctcaccgacggtaaaaggcacatcgtcaccccagcgcggaaaattcacgaatatgcgtcccttttctgacaccgtaatcccggtcggcatggcgtgccagaaagttgcgaccacttccgctttccctgatggctgatcactggccagctgaacaggggccatagaaacgttcggaaggcgcagcaaatattgctgcagacaggacacttagtaataaaccggcagcctgaatcgtatatttttttagcattattgtttactctttttaatttttctgcggtgccaggaatatgtcccggagccataagtgcccgtaattggtgtatatgagagctcgccggccagcccagcctgctcatcagaagtggccccgaaaaggggccatctcattacgctacaggctcgaaataggcgacgctggcctcatcgagataatccagaatcgcagcgggcagtcgctcggttggcttggcctcaccaaacagggtatataacgtttcgaaatgggcatgcagatcctcaacgctttcccactgctcattcagcagaaaacagcgggggtcatggatatttttatgccactgatagacaaccggcttatcctggctcattgtcgcctgctggctgacccgggcaacatttttataaaaatcatctaccttcccttctttgatctttccgctaaaaaccagatataacatttttttctctcttttttacatgtaaagcccggcatcttccgtaatggagaggcgcagccgggcggtataggtttcaaaaggtgccgggttgaaaaagcatgcagaggtttaaaatcctgccagcgctatctttccttttgctttaccggattcaatcacggcatgcgcgcggcgaatattttcagccgttatggttccaaaatgttctcccagtgttgtacggattatctttttatcgatgagctcactgaggtccgtcaggatgtgatgctggctttgcatatcaggagtggtaaacatcgatcgggtaaacatcagttcccagtgaagcgaaattgattttgtcttaagcggtatagcgtcaagcgtttcaggatcgtcaattaccgcaagccttccctgcggtgccataacttcaacaatctgatgatagtgtttgtcggtatgcgtcaggctggcaacgtagcgtaccctgctgattcccagctcgttaagctgaggcgcaaaaggctgtgtgtggtcaataatatggtgagcgccaagcgatttgacccattcagaggtttcagggcgtgaacaggtgcctacaatagttaggttagtcaggctggcggcaaactgagtcaggatagagccaacaccaccaccggcaccaataataagcaatacgtcgttattaccttcatccacctcaagacggtcaaacagcagctcccaggcagtgagagaggtgagcggcagcgcagcggcttctgccatggaaagtgacgcgggtttacggccagctattctctcatcaaccagtgcatactccgcataggagcctgctcgcataagagagcctgcatagtaaacttcgtcacccggtttaaacaggctgacatcttcgcccactgcctcaacgatgccagcggcatcccatccgagtacccgtggttcagtcacggcagcattacggcgcactttggtgtcgaccggattaactgcaatagccgcaaccctgaccagcagatcatgcctgcccggttgtggtttagggaggatggtctcataaagtgaattcgcatccgtaatgggtaacttattatctttataaacaacggctttcatactgtgatcctttggatgtcggtaagtaactgcttatctgttgttaaaactctaaagctaatcttccgatataaaaaccaacaaatcagagtaagatttacacgtttaaagtgtaaatgacgcatgctcctgtctttatgcccccgtttatatctctctgctgaaggtagaatgcagtatgctcagaattgaagatgttagaatgtttgtgcggactactcagctgggaagcttttccagcgtagccagagagtcaggcataatgcctgcacaggtaagtgctgcgatattgcggctggagaaaacgctcggcgtcaggctttttgtgcgtacaacccgcagcctaagaatgacgcgagagggagcaacctatcttccctatgctcaggagatgctggaagtgatcagggcgggaagtgaaagtctggtgaatcagactggggaaactgaaggatgagttgcgtatttcaatgccgtcagacgtcggcagaagtactctgctgccgctgatcacggcgttttgtaagaaacacccacaggtggcggtaaacctgatatttacagatactgtcagcgacgtacatcagcaccctgttgatatcgccgtgcgttacggaattctgccggataaaagctacgttgctctgccactcgcggaatacaataaacgtatccttgtcgcatcccccgcctaccttgaacatcacggcgcaccgcactcactggaggagattgctgaccgggattgtattctgtttacgctgaatggccatccctatgccagctggtccttctacaataaccagcaaaagcataccctctcggtgaaaagtcgctatgtctgtaatgactctgaaacttcacgcagacttgctcttgagggcgtcggtatcgcctataagtcctggcttgatgtgcatcaggatattgctgaaaaccggctggtgccggtactacctcatctgacaggcgtaaaaaatccgcttagttttatctctcctcatcggagtcagataacccccacgtccagagcattatatgcggaattcaagtcgcattttgatcgtctgagtgtgcagtttccttttacgcattagattagttcagcgccaaccaaaatgcgatgactggttattttttagtggccagtgtccgcttctggcataaagcggacacggtaggctaaggtccgttatgagcgttctgcggacatttccaacagtactttgtgtaaattaatagggggcatgtcaaatctgcattcctgtcataggttcgaactgctctccattgctgaagaggctttccagctctgcgcgtgccccaacgttcatctggctgaaatcctgtgtgcggtaccagattgcgcactttttcattacaatatccatctggcgcctgaattcagctccctcgctttccgtcataaacttccctcagcgatgccttcgctggtttgcatatactgttaagaaatatcaaatgcccaagctataactcattctttatcagccggctgaaattcaggcaaatgaaagcaggatgcttcaggcatcactgaagctctcagccagcagatggtgcatctggccatcctctcccgccggtacccggcgccagccagagcggttcagtaatacatccagcccggtaagttcaccggtgatgcgcaccggcagggcaatgcgctgccggccatgctcgtcaaaacctgtgtcaagcgccctgcgctccaggtagatacctgacacggacgggctgagcctcagctggcggcgaccgctccactcgctctctgccagcaccatgtatatccagccggtgagctttaccgcatgcagggcatgctgcagccggaacaggtcgttctgcgcctgcaggttgccgttgccggcgcgccacaggtagtcaagcttaccggggaggtcagcacgcaggccctttccccggccctccctgagcagccagctgatgtcgctggcgagcttcctgccaaaacgcctctgcttctcggcggtggccagccagcgggtcagaaacaggttgtcctgcgcgggtgaattcacaaacccgtcctggcgggcggtatgcagggcaatcagcccgcaccaggcaaggtgactgacgttcaggttttcgcctgaccacagtatattgtggtgctgataaccggtattttatgacatcagcgtctctcagagaaccctgtcatcaccgtcgcggtgtaactccacgatttcctggtcgggatagttttcaagcgtatcgatcgcataccgcatgaccgttttcatatcaggctcatctgttttgaccagttcttcacggatgaatccggcaatacgcagccgtgtggcttcgagcccgtcgccgaccattgccatgaccacggcgccgattatggtgtaaaccttttccaattcatcatactgctgttcagtagcctgtatagcatgtacctcacagacgcagcctgtcccgtgaaacgccgcgtcagcggcatggaggcgccagaaactgtcaggagcggctcagatgccatctgttatgggcagcgttgtgaaagcagaaaagttatcgtgagagacagaaagatcagcttagtgcgctaggcttggtggcgaatgcgatagcgctctggaacacgcttaaatgcagaaagcgctttcacatctaaggatgatgggggaaacgccagaggatgaataaattacccggctttcgccactgatgcacgggcacatcaatatgctgggcattatacgttcacgctgcaggaggatattctgaagagagagttgaggccattaaatttaaacaatgaattatttccttagcgtggttttttacacaactgtccgtcaaacccatagtaaatatccaaccggctggccctgctgaccagatttcgtctaatgcagtaactaaaaaagtatcagctgtaataaaataataaaagacatttattcacataacatttgaggaagcggtttattctctgctaaaagcagcaacaggattcatatgcgcggccttgcgggaaggcaaataaccaaatattaaaccaattatatttgagaagaaaaaggtcagtattgccacagaccaagagtaagaagaatgcaatatttcgccagcagtaaaatttaaaacttcaactataagatatgaaagaaaaatgccaatcaaaccaccaataacgcatatcagtattgcttcaatcataaattgcaacataatatctcgttgccttgctccaattgcaatgcggatacctatttcgtaggtacgttctgcgacagatatcagcatgatattcattactccaatacttccaaccagaagagagacaaatgctacgataacgattaggaaattaaaaactttagacgtaaattcgacagaattccgaacttcaccaaaatcaaagatatgaaaatctttgctacggtggatgttcagcagtaactctgtaattgcttttacagcagcagagctgtcgacattatcctttaaacgaacactgatactatctaatgaagtcttaccaacgattctgtacatgactgcgctataaggcatccatacattaaaatggtctgaatcaaaatctcgatcatttgattttactattgcaatgatttctgccgggactgaacctataaatataacattccctaaggcggtatcagatttatcaaacaataaatctctgcctttctcatctataataacttcctgcaaggcgtttcgatcatcactgaagttttcaccttccaggaaaacaatgccatttaccctgaaatactcgtgaccaacaccattaatggatgcatcagctgccttatctttgaatcgaactttatttgaaccatttatctcggggcttatgctatctataaagctctgtttggttagtgctgctgcatcccgcaatgtgagggtatcaatactctttgaatttgagtcaagataatctttaccgggaaaaatacttaccaagtttacacctaaattttgaattttttcaagtgtgcgctgttttgctccgtctcccagtgcaataactgtaacgacagcagcaagaccaaaaactatacctatcatagtcaagacagttctcagacgatgtgatatggtggacataaaagcaatttttattgagtcataaagcttgtcaataaagtttttccatctgctttgtttagttaatacaacaggtgataacttcaccagttgtgtttctttaattatcttatctgactcaataactccatcattaaggtgaatgatacgctgagcatgattagcaacactcaaatcatgcgtaattaaaataactgtatggccaaactcgttaagtttttttaataactccagcacttgatttcccgcttcagaatcaagagctcctgtaggttcatcagcaagtataacctcagcaccattcacaagtgcacgtgcaatactgactctctgctgctgaccaccagaaagttcagatggcttatgatgttcccgacctttcaaaccgactttatccagcaagtctgatgcccgggtactccgagcatcacgtatgatcccagaataaatcaaagggagctcaacattttcaatggcagttaaattttttatcaaattataacgttgaaaaataaatcctatatgcaccctccgtagctctgagatacgacagaaagaaagctggcttaaattttgaccatttatatagcagtcacccgagcttggtttatccagacatccaataatattgagtaatgttgatttcccagaccctgaaggacctgttatagccacatactgtccagataaaattttcaaatcaatatttctcaagacttttacttttttttctgcaactaaaaactcacgacacactgattttaactcaatgatatttttcatagagaaaatctcacttgtttcttaccttccgttgaaccagatataatcaccatatcgcctagcgctaaaccttctaatacctgagactctactccattagaaaggcctaaagaaactcttcttttttcaattatgttatcttcatttaatacatccacatatatttctgagttattgatcttatgcactgcttgtgtaggtatcaaaatggcgttgttagctttatctgagatcaatgtaacctgagcgctcatggctatacgcaatttattatctaaattaggtacatctaataaagcattataataaacagattcattagaggagccaccactttcagccaccgaccctgaaacaagggtgtcatcctttaaaacagattcgggggccagatctaaagacctaagttttgctatatagcgacgctcaggttcagagaaaatggtaaagtatgcattttgtcctgctttaaccctagtaatgtcagcttcagaaacctgaacctttacagtcatgacgtctagtctagctaactttatgataacaggcgcgctctggctggagttcacagtttgtccttgttgagttataacagcaattactacaccatccatgggtgctgtaactctggtataacttaaatcgacaattcttttttctacttcaatagtagcctgaatatgccgcgatttgagagactgaaactctgcacgtaaaacttccgatttagttttaaatgattcaaaaagatccagcgagactaactcctttttgtataagacctcattcctttttagattcttttcagattgactcaactctgcctttttcgcttcaagctcatacttaatcacatcgagcgctgactccgcattacgaagtttcgttgcgctgaggcacatcgtcaatttctgcaacgagttgtccttttcttatatgctctccggcatgaacatgcagtaccttaacctgccctgatacctgagcacccacgtttacgcgctcaaatgcatctaaacgtccagatgccagtactgtgctttcaatggcccccagacgggccctgctagtgatgtatgagacctgttgtgagggattgatgtaaaatttcattagcagaaatattaaaaaaacgaggaaaataataaatatgatgaagtagtatttgaatttcatttttattctatccatagttaattctgctacactaaaatgcattagaccagtgtgtgattcaggcatcaaattgataattatcaaaaaaaattcatgaacagtgattttttttgcttgccttgtcactatctaatttatcaatatctatcaatttatcacaaagacttagaactttttgattgtgagatatcagaaccactgttgcatgttctctacgaattacatctattagcttaattgccagcgactctccaatggcactggttggctcatctagaatgattatttccttctttctgagtagagcacgaccaatacaaattctttgtatctcacctccgctaagattgccatgtaaatttgtttctctgtataaaaaactgtagtcagtaatatgttcagaatcaggaatcaaatcaagaaccatcagcagtctcatcatttcttcgtcagttactggtctttcgagaccatacattagattgtttttaacattcccaggtatcaacctaggtttttgaggaacaacagatatcattgaaagaagtgaatcactgttatcaatgctaacaggagcacctttgaagtaaacgcatccgtttctcaggactttcaatcccaaccaaataatttaaaattgtagacttaccaaaacctgacggtgccgacaaggcagtaaccataccttgtaaaattgagaacgaaactttatcagaagaaacttttatcgtattttttatctgaacacctttaatttcaaaaagcacagtattatctgaaatatagtcttgaattatattacacttaaaaccagactcttctaattcagtgtattgcagaattgacctaagataaacaacttgtctttgaatatcgatgcatgcaccagcaatgagcctaagttgcatcgttaacattccaatatacccagcaatcattataaaatcgccggtacctattccgttcttgtttttaaagaatatcagggcaaaaacagatagtgctaacaagatacctgtcgctacagcttgtataattaataaaaaaccagattttttattagttgctataaccgttttaacgtaatttgaaagaatatcctggcgtattacggtctcacgcgtatttgcagtattgatcctgacttcgaaaggcatgcttaaacgggaaacagaataatctgaaatttcattcatggcatccatcaggttttcgtgtatgttcctgcttttaacagcaacaaaaactgctataattaccaaaaatataatactagtaagaaaaaaagccgaatacgcaaaacctaaagaatgatacagaaaaattatagctgtgaatatttcaaatccgataggaataagagtccagaaaagagaaaccgttacatcgcaaaaggctactgaacctctgcttatattagaagttatggtgccctgatcaaaattcttttgaatgacatactttacagaaagcaattttttcaaagcaatttcaactagcgccgcttcgctcctgcccaaaacgtgggctgaaaaaattcctttcacattttcaagcacttcggttaacgtccacaaaaatgcatatgtaattgcagcccaaaagaaagccgtgacatatgaatcgctatgaatgtatgcttctgcagttttcttaagaaaataaggcagtgtagctgtaagtacagatatagatatgaaaaagaaggaaagcaagaaaaatgaagttctaaaatttttataagttccaaccactacattgtaggcacacgtgtagtcggaaatacccgatctaaatttatcgaaaattgtatcaatcattttctataccctaattataacggctaatttattttcaatatctgtgtcatcctgaataacaacgttatgaactgttatccaagcatgtgaaagaaaatcataccgctgaaatcctattctcagctctgtcctaacccttaacgttactaaaacaatatatagcgtaatggaatactctaaacacttaactttaaaacacattaatggagaaacaaatcgtatcaaggtcgcgatttgattcgcaatagcaatatcatgctcatccgatgtgaaatatggttctttaaggtcctttatttttctgcagtgctctaaacagaaacctaatcctttttttttcaggttcttattgacccaaaacaacgttttcaatactgcagcaagatagcgtaaatcgcatttagcccttgctcttaaatgagttgtccagtttagcatccccgcaccgagaggagagttttccggactcttgagggaggttccttggtatctattcagcacacctcgctcaagtagaactgatgaaattgaagataagatcccttcttccataaataattttaaatcagaagattgcgattctgataataaaaaatattcatcactcccctcatctaatatggttatttcattttctatattaacatgatgaactttttctgagaaataatatttagacattcgaaaccttcttcaaaataagttctgctattataaagttcattaactccacactaaatccgccagcgccccttgaaaccatttccacgctccttatcatatcctgtgcatcaaacagcctgctcttgataaggaaaccattctcaattaagtccagcattttatcatgctttaatctgattgcatgctgataagcacctgttatgtgtcctttgttaaccctggaaattctgaaattaaaccttctatttatggattttctgtaatcaagtcttcttagttcagagttaaaagatctatatacatcaatattaactccgtgctttatcatttccagacaagtgaatgggtgatatacctctgcgtttttaaacagcatttcatcgagagagttttcaaaaatagcttcttcaatagtattcgcccttacttttctgacggtttttatatcctttttaaagaaccactgcaaaatatttaaattctttttattaagcccgcatacactagcaaagcttctgccttcaagcctgcttaatttgattgctgcattaagtgcatcgtaaggccgcatatttcttgcaagttcgcctattaagtcatctgggattgtttcgcaaaaaacatggtcccctccatgaccgtcgaatattataaattcacttttaagtttaccgcataaaaaatcgaactctgctttgaaaaaatccccactcacatatgctgtatcaattattggtaatggacactcatcaagctcgttaaacaataaatttgggtgatattctatgaacaaatttcttatgcccaattcatgacatatattctttgaaaaatgttcatcttctttacaggacccatactgaaaggtatatgttaatgccactatctggcttattggtactgactcagccagagcaagaagtataccagtcgaatccagtccgccactgaatcgcacgacataagttgtattaccaggatgtttttttaccacagatgaaatatattcacacaaaatatctgcgccatctttcatgctgacatctgtatgtgcacagctattccagtcaaagaaaatttcaccatcaacttcggtgtcttcatttattcttaaactaaagccgggtgggattatttttataccttttaatagcgaaaagtcatttaaaggttgtctacctgtaattatcctctttaaattagcataatctatttcaagggtatggctatctatctgactttcagtaacgctctcccatacgtcattgtttttttttacaatcaataacctttcagaatttaatttatttttataaatacgctctcggcttaacatcatgacacacctgttttattcattaaacccacgcgcatgcatttgttacccaaaaggaggggctggctttattgattaatgcaaatttgcagcccttggataaaaaggcattcacgtctttaaatgttgaatttttaaggatgagaatcattgatgattctcatcctttttttaaaaaaggctacttatcactcccaactggaaaaatcagcaaacactgaaaccgataccgcttgaacttgagcaacgatatacgcgccgacgtccctctaccagacttccagatccattaccatttgtagcaacagaagctttgacactgacaagcacttcttttcgggatggctttgaaacgttagttttgtttgacattttttatcctcacttatttagaaatgttttactaaaatcgtaaaactcccgctgacaaattcctacatatgtaagttaatgtcaatacaaatgacaatagtaatgattgctattctcataaatgagatttaactcacaagtgccaacagaaaagtatatatatatcaattacatattttttataatggtgtttattggcgatttttttgtaggagacatttacatttaatttagttaaaatttttataattagtttgctaattttatgaatcccatcccacaaattgactcaaaagtaataaacaaattaattattaatgtttttacgtatgctgaaccaacgtgatagagcagatttaagcgttagcgatctttaactagcaggccctctaccaaaaaatttttcctcgttagaagatccatatgctattgataataaataacttttattaattttaggtatcatctccataacttcgttttgcagacatgctgttacctgtttatgtgtatgccttgcgctctcttccgacatttgagcaaacgaacgcgccgaatgaggcgctttaatggggcgtccaccacagccggaaatagctataaacgctgctcggcataattaccagggcagtagtgcattcatcaatgtcatttccgcgctcaactgggctgcgttgccgggaatttacagcgcttctaaagcaacaatgtgggtgtttaggaaagtaattcggcaggatttaaacgtgcagggaacagaagtcctgccgctgcatgtcgcgtttatggaaaccgacatgggcagaggagtgccggatgaaaaagctgcaccggatgatatcgcatgtatgcccctttcttctcttgaagccggggagtccgagcttctggcaaatgaactcaccccggcagtacacgccggccttatggcatgcccacctatgtatcttggaatgctgaagtaagcctccgcaacctttccagttttctcacgaaaactgagtttctgcttcagtgttcctgacgatcttcatcagcagtcttcaggacagtaaaacttagccgggctgtttgcctacgcgctgagccaccttcaggcggtacaggctacgctgctatcccgcaatgccgcaggccttgacgtactgaagccggattctgtgcatctaaaagagaagttccttcaaagcggctgacacctggaatttggatcgtaagaagaggtttccgctatcaccaaagccgataggcgtttcggcgtggtcgggaagaaggcctcgactctccatgcgcagctgattgacgcattctacaccagctactaggctgttcttgcccgagagcaggggcagtgcgatgcatcaatgtaataatggttattgtaagcacgattaaaaagtagagcattatggctttcaggccttaacggtgataactggctttggcgtcttatgtttcactcatagcaccgtcgcctggcacgtgctgacttgatcaacatctactgtcgccagcaggcgctggagaactatgatgcgtacgcgcagatgatggcctcagacgtcgcgccgcaggctgaggctgccccgcacagagagatagcgtccatcgatgctggtcctgaaaaaagtgtcgctgtctgcggccgcacagaaggcctgatacacctttgccggcacggccagccagcgccggcacgcgccgttccggtactccagctcaagcacgccggtggtcgcatcgtatcccgcgctgctgaaaagcgcagacgtcacttcatgtctgttcatggcgttattcctggcaggtcccggatgaatgaaatcgttaatcgtaaaaatgtgggtcgcacgtacagaatgcccgtgcagggtaaaatacaacggtatatatccggctgttcactggcggctcgtccgctgcatgtccgttattctgagccaccccgggcattcactgtagcctgtaaaaagggaacccgaaggaacagggacccggcaatactgactgcttcgctgggatcgacggctggatatcagcgttcacggtttttaagcgcggcagacaccctggcctgtacccgcgccagaaacgcctgcgccgtggtgtcccagttcgccggcacaaactcccccttataatgcgcccggaaatccagctcggtatcgtcgcacccgtccagaaacagttcaatgtctgccagcagggcatgaagattcgcgtcgggcatgtcgtgaatgtaggcctgaattttgggctctatctcatgcccgggttcggccataacgtagtcctgaccgaaatagacgccgataaaattatccagttcgctgatgctgatacggtccactatacctccggaaacgcagtcagaataaaatagggtttaccgttaaatgacctgaaatcaatcaccacgcggacggcataacaggtaacggtctcctgattccctttgcgtaccataatccccgtggggtgcgcaaaccgccggctcaggcgcatgcgggcccgcatgccaggcggaacgttcttcacccacatcgctatctgatttttattgtccgccagcacccggctgatgattgcctctgcctcacggagtgatttaaagctgctggattcttcaagtctgggctccctgacaagcctttcacgcagctcatccggcgacttaccgatgtgtcgcccgatggtatgtccgccgggcgcacgtcctgaaagtgactcgtgctcagcaattctgaaccgcccgcggcgtaccgcaatgacccgctctgcgccggccgccagtgcaaacgccattggtatggcgatatcgaccgtcagaccaaccttcatggcggtctggcggtcagcaccgagcgattccgcgagcgccacggcggaattaaaggtatcggtactgacctgcctgccggtccagacctgccggagactggcctgaatggtatcaagtccgtgcgttccgacaaagacgcatccggctttggtcagcatggtgggctccggcaccacgcacagggcgcctgcaccgaacatttccaccacgccacccgccagcgccagcccgccggatatacggttactggctgattcaccttcactgacgctgcgatcagagagtacggctgccagctgcaccggcgaaagcgctatcctcagtccctgttcttcttccacagcatcctccctccgtaaccggtacgtcatttactcaatttataaccggcacggcatcaggttgcaaaccggtggcgtttctccgcttatcttcaaagggcacagtgaataataacagaggtacggccatcggtttcaataccagtgataaccggagtgatatcggcccgggctttaagagcggctccgcattgttcacatccgggagaatttccagcttatcgataacgatctgtaagacgtccgccatgcccggtgaccatttgccgggtatatcgagctccgagcggaatatccccgcaagccgtatccgggtggtttcgagtcccgcatcggccagcatgagtacagcttcacccagcagacggtatgcctcttctgagtcccgtttttctatttcagttacttgcataataattccctcaaatataacgcatgatgagcgtgaaatttgttgaaacctcgctagcggcatctaaggccagaaagaactaagtgcagattaaaaattagcataagaattctccttgtattaattgcaactgataattagcattcatcccaactcctgagttatctcttgctataaaaaatactccttaattttcaataggtaaaatgttacactcagagtatggttattattaattccactatttagaacactttttataagataacgaatttaactgaataacataaaaatgaaataaacaaagtttatatttactgcctcccataattttatatctgcgcctcggaggtttgaagcgcagacagattagcaatagttaactttctttatctttatctttatctttatctttatctttgtcttgaattgttgaatcaatctcccttctttcaattgtctttgagatattcatgaccaacatggctttagtttgccttgatgatgttctaattccaatttcgctggccattctctttaattcgacgaggggtaaatcgtttaatgactcgtcaggtttactgctcaacgttgcactttcgtcatgggggtagctatgtaaagaactttttgaaaaatatttattggcattgtcatttttatgagattgaaaattttttttaagcttcttattagagcctgtttcattactgcgcttattcaacatactcaacacatcatttaatgcatattctacacttttgtttggatagtaagccattatcttagatatacattccgccagagaaattaattcgtgcgttttcattatacattctccagcttctgataaagctctttaactacctgagttatatataagcgctgcttctcagcatttggtttagaacgaggtaaagagtcgtagctaaagacagttaaattattttctgatgcaaccgaaataccatcgccatcagtaatgtaatgttcaaacaccatgtcgggatgttgtttacttacatcatttatagtcgcctcatgagtttctttaggtttttctccatattcatcaaccatattgaatataataccaagcattttagtgtcattaaaatcaatggttgagtttgaatattgaatcatgcctctaaagtttttattcaacttatccatttcagattttattagagatataccaaccgtagacagaaagtcagggattgcaggtataagatataactcactcgcaaagaaagcattttgggtaacaaggttaatattaggtgggcagtcaagaataatgtaatcgtagtcatctgaaacttgatctatggcatttttaattatagccatcttttcaagttcaagttcggtttccttttgatgagttgacgcacttttcttctcccttgccaacatcatatcaataagaactaattcatgatgagaaggcagcaagtcaacattccgccaaactttccccggattagcggctataggagtctttattatagcgtctcgggtattaaatactttaccatcaaaataatcatcaaatatattctttaatgtaggttttttctgagtataaacatgattaacatacttcccaactcctagcgcaagatacgataagtttgactgaggatccaaatcaataagtagaactttcggcttcgcatctgatccaagcatcaaaccaagccccagatgcaaagatagtgtggatttaccaactccacctttccaattaatcatacttattatctttgccatatgtattccttttcaatttactaccattaaatcaatggcatacttttgtatttaagtgtcaaaaaagtttactaaagcttgacacttcacgatttaaacttctatttatataaaacatattgtaaatccaacgtggatctatcaaaccctaacttaagcagtatcttcgtctttgaaagtcgaaaaccgtgacacttagcacattctttctaacagaacaaatcagctatcagcataactctttcttttaaaaaatgcgtaatctatctttggggggattaaggctaattgaatactgcagaggaagtttgtataaaagcgaatatctgcccgcaccgcttacgtcaactgacggtacataacggttttcaggcggcaaagggttactgtaaccatataaggaaatttacgtgcttgaaagaatcgagaagctgaccggtataggtgtgtttgccgacatcagagctagtgcgcatcgcttttgcaaactctcattaatatatgccgataatgggcgagggaagtcaacgctggccgcgatgctaaaatcctacgcaaataatcagccccggctgctagttaagcgacgcacgattggccagactaagccgcagcacgctgaactgctttttacccacggaaaccgcgccaccttcagcgcagggcagtggaatgctcagcatgaaagcgtacatgtttacgaccttgattttgtcgaaagcagcgtttattccggtggagagatcaacgcatcgcaccgcaagcgcctacttagctttgcactgggtaaacctgccgttaccgcgatgaccaggttcaactgcgctacagaagcggcggcaaataaaacacgtctcaaaaaagccgcagaagaaaagctgacttcacaccgtgaaagtacaccgttagccgcctatttaaagatgaaagcagtgagcagtgttgaacaagacattgcgtccgtacaagagcagctgcgtcaggctgagaatatcgcctcagtaaaagcgcgaaaagcgcatgcaacattccccctttatgcacccgatctggatgctcttaactcagtattaatctcaactcaccaagagttaagctcgcgggcagaagaagcggtcagggaacacttggagcatattgataaggctaacttccggaaactgggcacatacaggtttgggctacataagaaatgataagtgccctttttgctcccagagccttgccggtattgaactcattaattattaccaggagtgcttcaatgatgaatttcgccgcctttcagcgcaggtcgctggtcttgacgatcttcagcgccggataattgacgtaatcaacatgccgctacttcgaagccgcatggagcaagctgaatcaacatctgtcatctggaacgatgtcaccggtacaactgtagagttaatcgatttagcgcaagctgaagccgaccgggtcagtttagataatctgctgtcatcgcttattgagcagaaaaaggcatcaccactgacggcaccagacgctcagctaattgcgcgcattgtagaacttcttaatgtagtgaatcatcatattgagcgctataacactagcgctacagccgcaaacaaacgcatagaggaataccgggaacatctttcgcaaatgtccgtggaagaactgaaaggacgcctgaaggcactaatggcccagcaaaatcgtttttcaattgaagttagcgcattggtaagcgcttatcatcaggcaaaggacgcagaaaagcaggcccagttagaaagagaaaactgccgggaagcattaaatagcgttatgaagcaaacactcggtcaatacgaaacagcaattaatactttgcttgataactttggtgcacgttttcagattcgggaaattagctataactacagcggtggcggtgagcctaagtcagaatatgcaattgaactgcggggcgaacggctatctatgaacggcgaggaaggatcatttaacacgtcgctgagcgagggcgataagcgcaccctagcctttgcttttttcatcgctgtcgtcatgaatgatccggatctgcaacacaaaattgtagtcattgatgatccgatgtgcagccttgaccggcatcgccgaacgcagacactgagcattcttaaaacaatctatgactcaagtcagcagcttatcgtcatggcgcacgatgtttacttcctaaaatccctgcgcgatgaattcgaaaagcgaaaagagctgcagaacgttgcctgcatgcaggtaatgcatagcggtggggattatagtgactttgcatccttggacgttaaccgtgagtgcgagtccgcgtattacagcaatcatcgaatggtcagcgggtatctgaggggcgaagattatcctgcgagggacgtagccatcgctatacgtccactgctcgagggctatctccaccgccgttaccccggtcacgtaacgccaggattgctctttggggatattgtgagaaaaattgcggatgcggcagcggacagtccgttggttcacgctggggcgctggtgcaagagcttaacgaaattaatacctatgccggtagatttcaccacgacactaattcctcagcaaatagcgaagctgtagtgactggagagctactcgcctattcaaggcgggcgctgagtgtcatctatggcggacgtgtgtcttaaacacgtatatggaacgaaatcaggtattccaccgctgcctcagcacatagatatggtaaccagtcgcagctgtgcgactggttaccggcaaaagccatgtttgcagtgatgcgcagcatgccctttaaatgccgcgtcagcggcatggaggcgccataaactgttaaggacggcttacagatgccatcgggcgccgtaagcccggcagagccggttacagggctgatggtggcaaaattcccccccgttcctgccagacgccgtttacgcagcggcctgtcagcagcttatcagcctgacggtcgtagacgaaagaaagaaacagcggctcctctaacagcaatgagagactaactagttacaacacccatttatcagccactgcagttccggccctctgggccgggcggcggcggctgttcagtgggggcaaccgggtttcaggtactgctccgggttttgccggagaggggctcttgttttgtggttctgctcggagtggggttaatagacttaccattgagtgttgtaactaatatgttctgcccgccgcttgccggcgggagctaccttaatctttagattctgagcggcgcggtcgcgtgcggccgctgcaagcgaaggcattaaacttatccacgcaaaatgtcggtatgaaaaccttactagttattttgattatttctttctgacgtaagtcaggattattttgcgcgtagcgctgactgtaattgcttgtaacctgtggatattaattgcgggtaactgtggctaaaaaaagcagcacgctgttttgcggccacgattcgtgaattttctgggaaataccggctcagaaaagggcattcagtgcccggcacaaacgactttaccgccagtcaaggcggttaaaatgagtgggtatgtcagtggactatatcgggtatttcagggagtacgggctcatagtcgagacccagctccagctgtcgcagacacttccagaccaggcggtcaaagtcttctgtcggaagattacgccagacgtgagccggacgcttgcgcagcagcttggccatcgcgttacgcctgtcatcgagcggcagtttgctcaggcgcttgcggcgcttctgctttgacgctttttcgcgacggcttatcagagtggccatgcgcatattttcataccagcgccggcgagcggcgcgtactgaggcgtgcgtgcctggatcaatgatgccatcagcctcagcagcgagacgctcattgcgctccgcaagaaacttattcatatcgatgctgcacagctgccagaaccgatcggtcagcacgatatgtcgcggcatgcagtaacccgtaaccgggtccatttccagatcaggacgctcaatcaggccgtagcgctcccattcctcaaacaggcgggagatccggctgggttcaacgcgtgtttccggaatgacgtcgccattttcatctttcgggctcagctcatcagccagtttgctgccgttaaaggtgaccactgacgtggccaaatctgcgcgctgcacgcacagcggccacattgcgtcatacaacgcctgcttttccggccggaaatcacgtttccggcctgcagcatcacgaaggtggacaaaatagggatgccgggacatgcgctggcgtagcgtcattttgcctgtgcgcttgtctttggctacaagccggctcatggcgtgccccatctgaccgggaagacgtctgtaatttttcggtgcaaaccactccggattagagcatttgcaggcagtggaatgatcgccacggtggcgtttgtcaggtcgtgaagatgtagtgaacggcgtctgcttaaacatgcctgccggcgcttatattgcgcaggcggagtaagcccagaacggattgtctttttctggccataaatctatactccctgcacagggcaataatcctgtgcactataagagtgggaccccgttaatcctcatccgtcgccaaactgaagggattttcggggttttttcttttctgatttggtcttaccgcctcagatccctgccaccttcaggcgtggccagccataaattcttaactgtccgtaatctatcactcagaaacgctttgggcaataacgtcaccccggctacagtaattcactgttgcgagcttcagcctcaatcatcatttccaggaaatcggcctgcgttattccttttaactcacaaattttcaccagagcctctttaatttcaggcctcacaaaaacgctgatttctttatgagtttcacgctttctcgccttataggcgcgaacgcgatccttatggggagttggctgctctctgttacgggtgcgtttcttttcgggagctgatgtttctgaatcacgggggctcatgctcgtaccctgctgcaaaataagactttccgcagaataccataagccaaatcagtaatgccctttctttgtgataccacagcagcagctggcgaactgactgctccggcgttacggacgataagctgcggctgtcagtacgacagtcggtagtctgttccggcgtcccagcgggattgccagtgctgaagataacgatcggcaagttccggcataccctcgatgaccagcgcgttttcgctgttgtaccgggcacccgcgcgggtgtagttgacgctgccggtttcgactgttcgcccatcggcaacgataaacttgtcgtgcagggctgcataccggccattccgccgaacaggaatgtcacgcgccgtaagcacattgatggccgcctggcttttgcgattctggttcgctttttcatcaagcaccacgcgaacgtcaacgccgcgcgcctttgccctgaccagagcagcggacacatcaggggacgtgaagctgtagcctgcaagccggatgtcggcctgggcgcggtcgatgacgccgagcaccagcgcttcagcgctgccttccggggaaaaaccgacgctgataccgggtgcggcgctggcgtgccccgcaggcgacagcagcgtcagactgctcaggagcagtggcagaaaaatgactttcataagggttctccgggggtcgtgagcgtgcgggattttcaatcctggacgcgagggaccggccaaccgcagggcggcaggccgtttgttcagtctgccttgccggtaaccagcacgttcagcaggaccaggtcggaatacgcgtgacgcagcagctgaaggccggcaaaaaacaccgccgtgttcagaaagggcagcagccacaggcttatgttatgcatggccatgccggccagcggtggcatgataagcgcgcttacgcctgtagccacaaacacggcggtaaggtttcgcccgcgagcaaagcgtcctttttcccgtgtcaccagctgcggatgcagcaacagagtcaccggcatcatacccgggcggattttcatatcccggatgcgcgctgtttccgcatcggtcagaatatgcatgtcagaaaaatcctgaatgaacgcgtctactatgctctgcacagcttcactgcagcggggctctcccccccctttactccagcggcgaagcagtgcgccttttgatctgaactcaggcatccaggccatcagcatcatcagggaaacggccacagtggccgcaatcagcagtaatgtcataggggctactccagggttttttgaggtttatggccaaactccggctcaggttcgctgcgctcgtggcgcattacgttgacttcatcgttcatcattgcggagcgctcctcccgctccggcgacaggtcgtagtcgcggtaatcaaatgcctcctcttcctgcagctcctccagcgccgctgccagcgcggcttcgcgttcgcggtctttgtcttccggtgactccctgccgtcatcctgcaccgcaggctccggctctttctcctcctgattcagcgcggccctgacggctttctccagcgcctcggcttcgcgacgatccagctcctcaccgcccgatgtggccgttgcagcttctgcaggagcgcctttatcgcctgaacgttcactgtggtcagcagagagaactaccggactgtccgggttatccttcatcagctggagcgcctccgcgacgtccgcggcttccagcacctttccgtgcttttctccgcgctgcagaacaatacgtctgccgtccgcggccccttcatagtgggcggctgaaaaattcacctccccgcttgagggcgacaccggaacgtgccagtttccgcgctgccggccgtgctcgttaatgaccggccagagcatctccggcgttttcccggccataaagcgcgcgtccgccgtgaggtcctgatcgacccggtccgccagccgcgtgccggataccggcaggcttttgtcccacgcctgcatctcccggtccgcccgcacatcctccgcccgcatcagcacatcgtgcaccgtctggcgccggccgcttttgctctccacctttgccgcccagccggacagattgtcgaagtaggtctgaacgtgctcctttgcccttgagagctctacgtaggtgctgtccagtgccgccatgcggcctctggcgccctcttcgccaaacaggccgataaggtacttaaccgatgcgccctgcgagctgtaggtggtgacggcgtagccgtagtccatgtggcggtcggcgtagcgcgcagcaggatcgaatgacagctgccggtcgccggtgtcgatcagaatctttccctcctgcgtaatgcctgacaccacggccatgtcgctggcgcgcacgttgcggtcgcggtccgttgccgtcagccggattttttcgccggggctgatttcccgctgcacctccctgaacacggccacctcctctttgcgcaactcggcgggtcggatccagcggtctgctgtaccgtccagcccggccatacgcaccacgccgctctccgcgtcggtttcgccgacccggtaatactgctcgccccggcgtaccacgttgccctcctgctcttcccagaacgtctgacggcccagatcggcgttgctgttgttcacgcgcaccagcagcggcaccgtgacaccgtcacccagcgcgccctgctcctgaagtcgcgtgtgcaccgcattgttgatggcttcccggtcggcgttcagctccgccacgataagcgtgttgtcacgcgcctccggcgtccggccggcgtagtcgtcggcaatcatgccggtcaggtcaggtttttcggcctccccatctgcgcctgcaggccctgcctgtgccaggctgctaccgtccattgcgctgctctccgggacgtatgcgcccggctggcgcggtacgctctgcgggctggtttccgccgagatgcgcaccgcctcccgcacgttaccggcgatgacagcctctacggcgggcttcagcgccgggatctggcgtacaatttccttcatcaccgctacgtcggcggcgctgcgctccagcgccagcgcaaacggcgcgccggactccagggacttcagctggtcctggtcaccgctcagcaccgcacgcccgccgccttcggcgatcacgtccatcagagaggccagctgggcgttgccgttcatggaggactcatcgataacgaacacggtgttgcggaagtcgcgcgcctgccctgcggcctgccactggctgctttcgctgagaaaactcgcgatagtctgcgccgggatacccgcgccggacagctcgctgacggcccggtgcgtgggcgccagcccgcggatgtccggggcattgtctgcggcagcaagtgctgcagctactgtgcgaaactgcgtggttttccccacgccggcatatccctggatagcggtaaagcgatcgcgggtcgtcagaatgaggttgcccgcctcgcgctgaccctccgtgagcccggtggccttctcctcattcaggccgccggccaggaatggcttcacgctatttttgccttcggcgacgtgtcgcagaatggatacctcgttctcaaaattctcgcgggagatgtacttcccggccgcgccctgctccgcgctgagttcaaaaatctccccgcgctgcaccatgcgcgacagctcctcctgcgcgcgctcgggcgtgatactgcggtcagtgttaatcaccccggccagcgcccggacgcccgtgaacgtcacctctgtgccggtggccttctcaatggccagccgcatcgcgcgctccggctgcgacatcttccgggactccagctcgcgcagggcgtctgtcagatcgctttccccggcgagcgatttgatgccctgcgtcacgctgaccaccgggcggttttcctccagccgccgaccgatagtggcctcgtccagcggcgtgaacgcaattacgtccgagccgctgcggcgcagcatgttgacggtcgcgtcgtttacctccttgcccgccagcaccgccaccacgctgccttcggtgcgccgggtggcgccgaaagattcagcgtaggcgtaatccgcgtacagaggggcgttgcggtcgagcctgacgcgctctcccttagcgttctccatcgtgatggtgtccttaaacagccagcgtccctccttcacgccggtgacggtcagccgctcgccgctgccggcgcggctgccgagatcggccgtggcgcgcagctgctcgccctcccgcagctcaagctttttctcccggtaaagccggtagtggctgtcgatgctgctgatgctcacgccctgcgtctgccctttttcgtctttcagggtcagcaggttgtggcgctcgctgacgccggcgatggtgaataccgttttctgtccctgcccctcgtgatgctccagcaccatgcccgcgcggtacacgctgcggtcgttgcggcttgtcgcatccagccacaccggcacccggacggtggcctcgcccagcacccgcccgagctgcccctcgtcggtcagaatttcccgggtgcgggccgtgagctggtcgcgcgtgcgcgcgtttcccgcctgcagcgaaaccggccgcccctgcgccttttcctgcgcgtagtagcgcgccgccacgctcagccggtcttcaaccgtgtccttctgcaccatcgtcacgcgcacgttctcggtcttcggcgaggcggtgaactgcttcacgcccgccgcgctcagcacttccgacgcaaatcctgccgtgcgccgggcgtgggtatcggtcacaagcgtggtgccgtcatgctgcgccgccgtcttcagcacatcgtgtagcccggaggtgttaaagcgctcggcctcggcaaccagcaccagcgggcgcgccggcaattcggcctccttcatttcttcggccgtcataagctgtacgccgggcttatctccaaaggtcgccagctggcgcttgcgcgcggcgccgtctgcggcaaccactatcagcggacgcttgctctcgctggccatcgccatgatgctgcggttcaggtcgctgataaactgcgtgccgccgcgcacgtcaatcagcgacaccgcccgatcggcgtcggccacctgcgccagcacgccccgttcacccgccggcgccgtgagcccaccctgcttttcggccagcccggcggccagctgcgacaggcgcgcctcgtcccggacgtgggcggcggtggtgaacagcgtctggtttttatccacggcgataagctgaccgtgaccgatggcgttatcaatggccttacgcgcctgcccgtaaacgccctccctgacgggtacatgattgagcacgctggtcatcacgtcgtcgtaggtcacgcgcacgcttttagacgacagccgctcgatagcctcgcgcactgcgccctccagcaccggcggcgtggcggcttttttttcctgaccggcgctttcggcttcacgctgctgacgccgctccgccagctcttccctgaacgtctgcgcatcaaacccggtatccttcagcaccgactgccagtgctcacgcagggtttcgggatcttcaaagtgcttggcctgtcgggaatccagcgcggccatgctcttctgcttcgccgtcgcgttttcgccgacccgatcgagtatgtcctggcgacgcgaggaaaaaggcttcaccggcacgccggtgatgtcccattcaccgcgcgggccggtgtcctcggtctggtaaccagcgggctcaataatggatcgataatggcctcgatagagcgccccgatgctgacctgctcgttccagaccacgtcggtaaagccctgtttgccattaatgtcggtggagagcgttttccagccgttttgcgagagcgtggcattggccacaacggcatgcgtgtgcatctggggttcaaggttgcggctggtatcgtgcatgaaggtcgcaatcaccaggttgccggttttctccatctctgtaataccgtcggtcatggtgcgcgtagtggcgagcttctccacctcgtccagcgtccggcgtaccgcctccttgtgcgcatccaccaggaaggtgtcaccagtcactagggcgagcaccgaggcgctcttgggcgcggagaaagtcaggtcatatccgggacggtgtttgttaacgccgccctccatgcgacgcatgtcggtgccgtccggcaactggccctccagcactgccacgaaggtatcgcggttaaccgggccctcaagacccagattttccgcgccggtgccgtaccactccgtggactgctcgccgagaaagtaatagttgtcttcgtttgtgtaataggcgccggccttgccggcgttcttaacggatgaaactgacagcatgattcacctcagttgcggtccagaccaaaatccgcgctgttatgtttaaccacgtccatgacctgcatccgcggctctgcctcttgctgtgcggccggcgctggcgctgtggttaccggggaaggtgagggtgacgattccgcaacaggtggcggcagcaccacaacgcgcccgcctgcttcggcagccgccgcctgtgccgctgaagaggatgccgtagcgttttcagcaggtgccgcagcgctctgcgtacctgcagcggtcccggtgttgccggtacgctgttcctctgcaggggctgccgcttcagttgcgtcaccaaacagccgaccgacaatctgaccggccttgttgtcggcggtttcacctgcaagcgttgcctcgatgtccgggtcaaacacatcttcgacgtcgcgtggaatgcgcccttcagcaatttcgcggtagggtttccagggcagcttcatgcgcaccaccggccactcgcccggcagggtgatatagcactcaaggtcgttgaggctctgcacgtcggaatagctgaccaggaactcatttacctcgtctttggagaactgcacgccgtcgcggatgatgtcgatgccgtagctgtactgatctttgaatttcttgtgacgctgttcgccgatttccttctgtacccagtccgcaatcgagccgctgggggcacggtaaaagacgcgggtgttcagcaggtcccagatggatttggcggcgttggtgccgtaagtctcttcaagctgcgggaagttctgcaggccgacaacggtacagccaccaaacttacggccctcggcgcagaactccggcagaatgggcagcttgtgcagtgacggcagctcatccagaaaaatccagatgcggcggttacgatcggctttcaggcccagaatgccggacatggtcatatagagccacgcgctcaacagtggcttcagcgcattgtggttctggccgtcactggagatgaaaatccacggattatcgccgctcgcgtcttcggtgtgcagccagtcgcggatgctgaacgggcggcggccctgctcatccagcccctgcaggtagcgcagcgagcgaacgtaggtggtcagaatggtgcggatggtcatcgcggttttctcgatgctgccatccaccagatttgccgcgtccgtgccctcaagatactggcgcagatcagccaggctgatggacatcagctttttcaacagctcaccgatgctgcggtttttatcacgtcccatccggcgggaggcagccacaaacatagaacgggctgacagcacccagaacggatcgctgctgccactgctgtcaggtagtaatgaggtagaaaagttctcaaaatcgcccaccgtctggcactcttcccacagatcccagaacggacagcgtttatcgaaaggacaaaggatcttgtccttatcctgccgatagaaggttgggataaagttattccctttgtcgtagataatgacgcggtcgcctcgcgcgcgaagctggcgcagcaggtcgttcagcgcggtacttttgcccgacccgacggtgccgtggaagccgaagttctgcatttcggagtctttaaggatgtgcagaccacaaatgctgagcggggacatcacgtcggcttttttgagcaggcggttcactactgcagggcttgtcgccagaatgcggccgccggtgagctcactctcgcgctgcttcgcgcctttactcccgagaaaccaggtaatgccgagaatggcggctacaaagcagaatgtggcaatgccccagccgtaaaatgcggcgtctttaacgctttcgcccatctgcacgaagtacggatcgttcatcacctgctgagcagtgtgcttaaatgccaccacttcgccgctggggcgctcaaagtgaaaggtccagccgcttttagaattaccgccagagaatttcgacagtggcatgacaaaccacttaaccagccagtaggcgctgccgtgaatgaactcctgcatcgtaaggcgcagcagcatccaactgaaaaataccagtgcagaaaacagcacgacccagtaggaggcgatattcataatctgcacaaacatgccgatcatgtatttcatcacctggccgccctgggtaaagtcgcgggcgttgaggctcattgaaagtcctttatgtggaaacagagacaggcgcgcagggctgcgggcaggcgaaagccaggcagaaagctgcgcggggtttacttacggtgcgaacgtgcccggatgggctgacgtgatgttccgcctcctccgccagacgcagggcgcgtcaggctgtgcggcgggcggtctcagctgactgaaacctgaaacaatggctgattaatctggtcttcaacaaaccgctgatcggcgtcactcagcgcgctaaaacgcgtggaaaaccttcggatgtagttcatcaggttggtcgtgttggtgaaaaacaccggacacaccgtgcgaacttcctgcagaaacgggctgaatgatcgaagtaaacgcatcgagctttccgatctctttcaggtcgttttcaataagctcctcatgctccgtcagtgggcagacggttacgcccgggaagggatacaggacgcgcagcgtgtccgaatattcccgtactttgcagtcaaacgcgtcttccagtgccggtaaccggttattgctacgcacaggcgaaagcaggcgttcaggctctacggtagcggcggtatagtattcggtctgctgccggataatcccggccggatcggcacgacgccagatagccggttcgcgtgcggacggcctgtcgccagcgttcacggtcaggcggggctgacaggatgccggtatccagtttctggcctcagccggggttttatcccggaagggggtgttgaaaacgccgctccacaagtgaataacgtccgttactgcatcgtcatcgccgacgatgtgcatatgcacgcggtgcacggacacctcaccctgaacggcccagcgggttatcacggttatgtccgtcacgtcagtgtccgtattcagcagaataccgtgaatagctttgcgtccttttttacggcagacgtaatgcagacgtttattaggtgacgggaaccggacggtaatatctctttcagcatgaaggtgcagacctaattcagggatttcgacatcaattaagttaacagagatattggagtaatttaaaaagaaagaaggtgttaagtgtattagcattttttcctctaaatattctggttaagatagagatgcaaaagctctcgcctgaatttaatcaggcgagaacactttattagataagttgttttacgctttatttcttacagctttcacagctccaataatggaagaaacctgatagcgtgatatatccatattgaagacaatgaagatcaggaacgtagcaacaaagttaccgattacaagaggtagtatgctccactcagtaaggactcctgcaagcccgcatgtaaccaaggctacgaaccaaaccaccccatacgctctgacttttcctgatattaattttgttagctctaaactttttaacttgtcagatctaatcatgttgaacaggcttgcatatgatgcagtgaatgaaaaaatcacaagccagtggaagataccgaaagctacaaaaaacagccataatccaacattctttggttgaggtagcgaaaaataacttaatacgccgagaacacaatatgcaatgaagtgatatttaaccttactgaacatcccaaaaaaactaggcacctctctatcagacgaacctattgagtctattatttctttggagtccttttcaatttgtgcatatgtcatcatattaattactccttaccatcccctttgtaatctttatgggtgtgattcttaaaagggttcactaataagtcgtcttgttgcttatcagcagcccgcttatcatccgcaaagttattcgcgctcgacgtatactctcccatacgtgacgctataccgctatctgtttcacctttagctttttcaatagtagcatttgcgtcgttggctttattgttaactacagcctgctgttcctcaacatcattgataacgccagtgcgtatgttatttctggctacacctgcatcaatgttctgatttgcactatcgtatgctcctccgaactgagcgcctgctgtattcgccggtgcgcccataccttcacccgtgcttcctgagttgcgcgcatagtctccgtcaatgcggccctgcaacttctctgcaaagaactcctgcacaagaccgtcacgctgcttctgaacgccttcatcggacgtgttagtaaggatagtttcggcattacccggcgctcgtttctgtgcccactcaacaaactgttgcgtgtagttgtcacgtgcgcctgcgctgagcgtttcagtctcagaggccattttctgcagttcatgcgtatgcgactggctggccgtgtactgcgcatattgggtgtcagaggtggtgatgccagaagagatctggttcatcaggccggtcgcattgttatcaacgtgctgtccattgtaggtcgtgctgtaattacgcagcacatccataccctggctgaagtcctgcgactcgcgagcggagatagtttgcgaattatcatttccactttgtcctccctcagaagtctgagatgttgaaccagttctccctgtcaattctgtaccgccatgaacatcccctttgaccgaagcacctgtaacccactctcctgctttgccccagagtgatttacttgaatcaatacccgcctgtgttcgtgctccagtattcactaatgcgctccgggatttatcttcaagctccgagtacgcctcattcaggctgatgtggttgcgggtcgcataatcctgcgccacgttctgcattttgtttacgcgctcagcatcagtgatgctcatgccggttgaagccgacagcgttttcgagtcgctattgccaaactgctcatggaactgcttaagctgcgagcccgtttcctgcaccgagtggttgtagccctgcgccgccatctcggtctgcgccatactgtcgcgaactgagcgctgcgccgcgctcgccagattgcggtcaagatgtagatcaaccggcaggcggctggttgcgccggacgcgtcatacaccgtctgcccgtcctgcgtcatggttcgcatggcaccattgcccagctgcatggtagtcatcccctcgcggtaggcgcgattaaggtccgttttgtgcccgttgatattatccatctgcacgttacccacgctcacattccccgacgccaccgcaccggagtctgccgccgacgcgctgctgagggcgctgcccaggcttgagctgaggcttgcaaaactctgacccagcccggtgaacaggcggaacgcaaggaacggaatagacagcatcagccagccggcgatgcctgccgtggtggtgctggtttccatcaggcggttcatgttggagagcgtcgggcccgttgcgtgaaaactgctctgcgtgctgtagttcaccgcaaagttaaagatggcgaacatcaccggccacagcatcaggctgcccataaagttcagatagctcttgatgacggaccaggcaatttcccgcacgtagagcgccagcaccatcaccgggaagatgcagatgcagaacagcagcagcaccgtgtgcagctgtggcagcacctccgtcgcaatggtgtagctgaccgcgtgcgacaggcgcagcttcatcagagactgctcggacgcgatgtccaccattgaggcggtgtcgcccatacccttcacgtagctgttcagcccgcgacgcaggcccgccacggcgatgttctgcatcatgatcgcctgcgccgacttgctgctgccgagaaagtattcataggacccggccagctgctcagcgtataccgtctgcggcgcgttgttgcccggcagcatgcgggccgcgtgggccatgaacgtgctgccggtattgttagcctctgccgtcagcagggttttcagacgcggcgccgcatcccggcagaccataaacgtagtgccgttagcatcgcgccagtagatggcgcgcagcgggctcgggttgccgaagatctgcgcctgcacgtcctcggactccatcacgtcctgcatgctgtacttgtggttcagcatgatgtccgggaccacgcaatttttcgcatactcccccatgttataagccagcaccgggttgcggctgtcgatggtgaagctgtcctgcatcagcttactcgcgaagagcatgccggtttttgtgtaggaccgctcgtccgggaagtgaaagatgtcttcataggttgtcgtgagcgtgtagcccacaccggtagccagatagagcggcagagcaagtcccgccggcacgttatcgacgcgcccgatagtgtccggggcggtcaggtcgttgaccaccaccgtgacctttggcgtcagcagcagcgcggtgaccagcacgaacgtcattccccagccaaacatcgcgcccagactgtgcgtgcgcaggtaggtcatcacacagaaggcaatgcccagcatctccgccacccagatcgtgcttttccagccgccgttttccatcaccgtggcgaccgcgttgaggcccatcgtgatcatgccgccggagctgaccacccatatatcaagcgccatgcttaccccccgaactgatagttcgacagcacgctgtcggaaacggatgacgagagctgctggcgcgtttctgacaggctgcggtcatactcggccagcccgttctgctgaacctggatgcgcgcgacgcgctggctcagctcattgcgcacctgacgcaggttctcgcgaaagtgtttgttctcttcttcggtatcgagcgtgcctgctgccccgctcgcggctacgtcgatcaggccgttgatgtaggacatcaccatatcggctgcgatgtactccgccaggctgctgaccacgctctgatccatgcctaccgacgcggagtcgatggtgtaacgcaggatgcgcacgcgggtgctgctgataagcgccttttcgttatcgttaagcgctgtgtcggtgcggcttttgtcgaagatgtcgttgagcatgtcccgtacccggccggtcatgccctcatcttctgagagcgtgagttccgcgattgtgggcgacaggcaggtggtgttgtcgttacagcggtagattttctcggtgccgccgttcaggagcgtattgaacatcgactcgctgcccccgcgcggctgcaggaacgtcgggttgccgttcgcgtcataaatcaccgtgccgaccatcgacataatgaactccttcagcgcgcgatcgttgctgaaaaactggttgagcttcgtgaacgtgtcccaggtcaggttgcggttgcgcgggatgcgctttttctcttcgtcggtcgccttatcgaacacgctgttagtttctccgccgacgccgcagccctggcgggaggcagcccagtctgagaacacatcgtgcttggtgccaaggtcctggcaaatctgggaactcgctgcctgtgtctttggccacagtccgccgacgatggactgcgcggcctgacaggtggaaatattcatgttgttggtatccgccgcgagcttctgcaggtagtccttaaccgccttacactgcgggcagatggtttccagcccgaggtcaaaggcgtagccggcggcgttgctcaggatctgcttacccatgattttgatgctgtcgctgttaatgaagctgaacgagccgagataagcgtcgatgccgccgcagcccgacttgatgtccgggagcgtgaccgatatcagctggatgttgcgcaccggcgtgcggataaacaggttgccgccggtgaggtagcccgctgactggccctgccaggcggccgcctgcgtgtagtttccgccgccaccgcccatgtcgttaaagaatttgttgatgtcgttctgcacgtccgcgctcgccgcagcggagaacagcaggccagtggccacgcctgcacttaacacaaatttagtcatcacagcacccccagacgcacggccagcgcgaacgattcatccaggcgctgcctcagcgcctcctcactcatttccccctgcgacagcgggatggttaccagcgactgcgtgttgataatgaagtcggtgggcgtcgcctgcggcagctccgcgaagaagtctttcaggatgccgtcattcaccggcatgaccttcggaaacaccgcatcgcccttgccgtcaaagctgtaaacgaacacgccgatgccggtctgctcggacactgacttaagagtcggattgaagcggtggcagtacgggcagtcggagcgaacaaagtgcacgatctgccagtggcccacgtccacgcggcggccgtcgctcaggtgataccagatcggctttgcaggcgtaggttgcgcgtcggcagcaggcgcgcttttcgctgaccggttttccggctgcgcgggcgcgtctgcaccttctttcgcctgctccaggcgggcaatgtcatcaatcgtgctggccgtggccagcaccggcgtaagcatcagcaatacggcaaagagttttgacatcatggattaatcctcgggctggaagtcggtaacgatgttgagcatgcgacgcgccaggtcgtcctgtgtgataaagccgtaggccagcggctggtatttcttcgtgcgaggttcaaccaggtaaatggcagggaagtgttcgattttcatcttctctgcctgcccggcgttctgcctggtgtctggcaggtccgggctggcgcgcccgtcaacggtcacggggatgacggtcaggccgtactgctcgctgaactccttcaccaccccgccgagccggttatccagcggctcgttaccgcgatagaagaaaaacacgccgtagcgctggttcacgtagcggatggccgcctgctgcttctgacgctgttcggtgtactggatgttggctgtaccgttgtagaaacggatgcttcaggctgtagtccagctcagggttatccagcaacaccttctcccagcgcgaggcgaacatgctcgcctgattgaccatccagtcctgcacgattttgtagcgccggatgttctctgttgaggggtgcagcatcgcttcgttcatcaggttgtcgcggaacgcctgcaggcgcttcatcttctgcgtgggagtctcctgtggcgcggcaggtggtggtgacggctgctcctcctcttctttttttaccggctcgttgtaccagtaccagccgaccgccggatcgtagttgtagccgtcgggctttgtttcctctgccgcgtgcaacggcgataccgcaagcagcagcgtgaggctgatgagttttctcacgtcagtctcctgatttaaggctgttctggatgtcggatgtgatgcgctggttcagcgcgtcctgatcgagcagcttaatgttgctgttcaggtcgtcgtaaaagtcgctgaagtcgatatgatcgaacttaatgccctgcagctcagccacccttattccccggcagtccgggttgctgcccgaaccaaagctgatgcccagctggtcccggcgtccctgctcctgcacgatgcgggcgagcttgctgtcgaagacgcagtagccctctttctgctgcaggcagacgccgagcacttttttcgaacagtaagagccgaccttcaccacaagcttcttctccttgccggtgccgatttccttttcctcggtgttgcactgcgcaagtccggcatcctgaccccagccgccgcttttacaacagttgctgaagccagccgcactcttgcggcacgccatcgccttgccggtaaacgccgtgaccgaatccgggtccatgcccgcgaagtcttttcccgcagcggcgagtgccgccagctgtgataccgcagcctcaaagttctgattctgtcctgcctgcatcgccgagcagctgccgtcggagcagtaaaactccgagccgcagatatagccggtgctcttaacggtgtgcgcacactggtaggtcagcttgctgtaaacgcagaggttgccgattttctgggtgcaggtacgggtgccttcactgcagtttggattgtcgatataggcctggcaggtattggtgtcgtcttcgaaaacattccactgtgtggtgtaaccccagcagtcgctgtaaaggctgtaggccttgccgcccaccgtgacagaacgtgtgccgcccggatcgctgcagacctcactcatcttcaccgcgtcgcccatatctgccgggcagctgtccgtccactggatcccggcactgaccgtatcccggaccgcctccatcggaagggtgatgcggacaatcatttgtccgctggctaactgcttcatgaaattatcagcggcctgatcgttgtggccatcgctgttattgcgtaccagaaggctgatgatctgcccctgctttacttcctgcgtggcgacgctgaatgcgccggaggagtttattttggtcctgaaattttgcccaagcacctgaatggagtaatctaggcgaccaccgtgataaccgggggcggacggatagagaaactcccacgtcccgctgctgatagtgccatcctgcggcacggtgatgtcgtactgaatccagtagttatcgatgcgccttccgctgacatcacccgcattcagtaccatctgagtattaaaggtttcacgtgacccggtcgtcacaattgtggccttacgcgtacatgactgtgagagtggggatgccatctcacaactgtgcgtcgtgtaggtggttttgttcagctcctgcgccacgcactgattgccgttcaccccggtaatcgcattcgcattttcccggatctcatcgctgtgtttcatcatgtccgagtcgtagctgagcttgtccgccgggttgttcacataggattcccgggccgtctgcccgagttccgactggctcagctctgtctgcccctttacgtcgatgtttgttgacgtctgcgtcgggtcgccgtagtagtcgcgctgcggcgcgtcagaggtgtagttgtcaaaataactgttcgggtcggcgctggttgtgccgttagccgacttcgcggcgttaatgccttcctggtttgaggcatccattgacgccgccagtgcacccgctgaagcgcaggtcagcagcaggcccagcagcttgatgcgggttgcttttttcatcgggagttccggtcagagtaagagaagggcccgccgcagcgggcagtggtcagggcctgttgcggcactcgccgcgctggctaatcatgtccagtgcctggttcagcgccacgttgccatacacgatgtcgaagtggtcaccacacttcttaaccagcgccggcacctgcttcacgctgtagcggtcaaagcgcaccgggtctatctgcacgccgcgcaccttataggtggtgaccatgtacatcatgtacttcgcggtctgctccatgctgtcgccaaccagcccgcggaagtacaccggaatgttccgcgcttccgccgctttcatcagaatggccagctctttttccggcaccgaggcggacaggaaataggccgtctcgttttccgtgctgccgacctgcgtgcccttcggcgcgtcttccgcctgcgcggacagtgcggccatcagcccggcggcaagccacagcgtgttgcgtgttttcctcatatttcctcacttaaagcacgacacagttgcgctttttccagatgagatagccgtagttctttttgctgttcggcatttccttgccggtctgccacagcatcacgttgcgccccagcgggtgacacgacgccacgtccggtatggtgttcaccatctgatagcggtagcggcttttcggcaggatgacggacggatattcgtaacagacggcggtgttatacggcacggtatcgaggatcagcccttcgcggtgcagcttgaagtccatgcgctcagagagcagcaccgaactgttcagaccgctcgactcgttcacaatgttgccggtaaacgggtacatcgagccgtgtgagccggcacaccagaacagcgcatcaatcggcttgctgacacctgatgccaccgcgtcggccgcgcaggccatctgcgcaaccgggttcgcaaacagcatcacttccgggttcaggaacagcgcaagattgtcgtttctgccaggtcgggtccagctccgagaggtagccgatgtcatactcaccgccctgcatacacatctccgaggtaataatgttgagccaggagatcagcgggtacttataccagtggacgtgatagaaggtgccagggtgctcattcgccgttttggtgccggtgccggtcccggtgttcgggatgttgatgttgaagcctcccatgttcaccatgcagccgggcgatcgcgtcacatcagtcattgcaaacggctcccagaagccaatcgcgatgcccgggcgctcaaaaatgggcggcggcaccggacagaactgaatgggcgatgacgggttttcggtatccggcagcgacccggccgatacctgcacgctgccgatgctcatcgggaacaggcactcccagcacacatcggtgatagggttgacccagcgaccgtcgcaggtcagggacgtattgccgttttcagcggcgttagcggactggcagaaccacaccgtcagcgccagaaataccgtgcgccagaccatgtcagccccctttcttaacgccgccgcgtgctttttccactgcagcctgcagcccctgcaggcttgtcgcacccgggatcacgctgatgttctcagcagtggcgcccttcactggcataatgaagaaggccggcgtgccctgaataccgagctgcttcgcaagctggtcattagctttaagcgcagcgtcagtcgcctcaacctcctcacgcggcgtgtcagtcacacccgcttttaccgctgcctgacggatatcctcatcgagcagctttccttcatcatgcccggtcgcgtagagtgccgcgtggtagcggtggtatgcctctgcaccgccctttttataaacagacaggccgacttttgccgcctgcacggacgccggccagcggctgccaaagatcggccactccttatagacgaagcgcacgtcaggatttttactgatgaactgctccacagtgggagcaaccttcgcgcagaaaatgcactggtagtcaaagaactggatcaccgcgacgtcgcccttcggatgcagcaccggtgaggaagggtcattcagcagcgcgtcctggtttgcaagcgccgcaccggctgctgacgccatctgtttattctgcgcctgggcctgcagcttctggctcatctcgatcaggatttccgggtgcgcgcgcaggtagtctgccgcgatctcgccgatttgtgccttctgcgcgtcgctgaaggcagccgctgcagtgccggtcgtgtctgcggtcgcgtaccctgtcaggctcagcgtcagggcggtggtgaggattaactttttcatgtctggctccgttagcggtcgggaagaccgaattcagtaataaggaaaagtttttgtcctggcgcctgcttcacctccgcaggcacctgagtgataccgaactttttcgtgatgctgccggtctggtcgaagtagacccggctgccgagtgcctgcgcactgtcgcgcacgttgccgtttacgagaatgacgcgggaggtcgtggtgtgcggcacctgctgcttcacccatgcaatctgccggtcgtcgtcggcatcgatgaagtaaagcgtctcgtcaaacaccgggataacgtcaaacgggttcaccacctggcctttatgcgcaaacaccaccccgttctggtcggcaatgtcgcgctgcaccgtgaacgacgggtcaaacaggcggctgtgcgtctcgcgcgcggtggtgagccccggaaccggcggcgggcgcatcgcctcgtcttcggcctttttctgcatttcccgctcaatgtcggcctgcgatcggccgtcaaagtgctgcttcaggttgtctttcaggacagcgatcaggttgcgctcgcggatgtcccaggtatcgccgtacgtgcccagctcagccgcgcccgcctgcaggctgagcatggcgagcagcgcgccggcggccagtcgcgccagcggagttgcgtgtgtcatcgggaggctcccgttggggtgatcggacagggttactgcggcgggttgccggctttcatcagttcagcgaggcgcgcctgaatctccggcgtggcgtccggcaggccggtaacaactgcggggctcaccagaatggccgcaccgtgttcgctggcatagtccgccgttgcagtgatgacgctgcggtcaaagcgggtcagcagcgcctttcgctggtcatcgttcaggtccagcttcgcggtctggcgtataagcgcgttggtcgtgcccttcatatcgaaggtgacaagctcaggcggcttcagccagaaaaaccaggcggccgcgcacgcacccacgctcagcacaaccgacaggccgcagcccgccacaaggtgtcttgtattcaaagttgcatctcccgcagcatgtggatgatgtcgcgcttgtgcgcgtcgttattagccatctcaaacaggatgtccttgatgtccgcgccttcccgcagacgcttctcgcggtaggtgaagtcctcgcctttggaggaaaacagcccgtcgctcagcggatcgagaatgaggcggtggaagctggaaaactcacccacgctgagcaggaacgagctgtagcgcgcctttttcgccggcgggaactttcggatcatctcccactccagctcgctgaaggcgtgcggttcctccttctgaaaggtggtgaacgacttggcgtcctgcatacaggtgaacttgaatgagctgttgtcgtaggctgcaagcgccgccgtggacaggtttttatcgcgtatcgcctgcgtcaccgtgccgtaggagccgttgtggcggcgggcggtgcggtaaccctcttcaatgaagtccttaatcttggtgctcgacccgccgagcagcttccagccctcgtcgatgatgttcatcttccgcatgctgcgtggcgtggtgtacatcatgttctcgttccagatcatgatggtgaacaaaatggccgacagcaggtcctgttgtttgcgcaggtcgcccagctcggtgaccacgaactgcagatcaggcttcagggtcggttcggacgagttgaagaacttaccgtaaatgcctgtggtgctgtacttaccgagcagcgtggtaatttcgtcaatgcgcccgccaatcagtgaagagtgctcgcgtgtaatcgcgccctgctgttttttgagatacgcaatgacgtgatcgatacgcatgtcctgctgatactgaggccacgactcggtgatggcctccagaatcagcgactcgtgcacctcgtcgagcaggccgttggggctggccagaatgcacagctgatcgcggatgcgctcggcggcgagcgtaatattcgtgacgttcgcaaacggattaaaacgcagcgagtcgccgttaatgtaggtgccgcccagactactgcaggccgccttgtaggagtcgccgatgtcctgcaccgccaccgtgccgcccttgtccagcaccgaacgcgcaatggagttcgccagaaccgacttgcctgctcccgaggtgccggacataaaccagttgaagtttgtgttcggcaggctttcgtcaaacacgtcgataaacgcgacctggttgcggtagctcggaataagaatgcccgaggcgcacagcttgttgtcaccgatgaccggcatgagattcaccgcgtgaaacgactccgaacgctggataccgccggtcttacggcagtcggcgcgcagcttcttgttcaccatcgcaaacggcaccgtggccagcaggttgcgcaactgcatgaagtcggcacgcacgaaacgcaggccctgcgccgcgaaggcgttgcgcgttttctcggtgtagcgggacgtcaggtcgtcgtcgtccgggcagaacagcgtgatgccgtaaaagtagctcgtgagggacgtctggttcgacagtagtcgcgcgcgggcgtctttccactcagcgtgctgacgcgtggtggacggaatgtatttggcgtaactggtgttcacgcgcgagtccagcgccaggaatcggctgttggcctcaccctggctcttcatctgctcttcggtggtcagcaccatcgtgcagataaacgggcagggaatgccgttggtcggcgacatcaggtcctgaaaaatattgccgttttgccacaggtaatgctcctgcgggttgttgtcgaggttcaggttaaccatacgcgcggcgaacggcttactgtctctgtcgctgccctcgatacggatatgcgagggtttcacccgccaggaggtggtgcggtccacaaactgcgtgttcagatcggccgccggatcgtactcactgtcgtatcgctcaagccgcgcagggtcatggttaaagaactcgcgcagtacgctgctgaactcagtcacgccgatggcctcagaccagatgtcggccgcattaagtgcgttcagcaggttacggcgtacgtcgcgcacgcgcaccagatcggtttcagagagacttttaaccggcatgccccagacaaagaaaagacggtagtcgcgcagggtcagtggatggtcaagcccgttgctgtaggtatagcgcgccccgttcaggtaaaagcgggcggtgacgtcgttacactcgtccgcccggtgtcctttccaggcaaagtttttcaggccctgctcgacctgctctttcaccgcccgggacgagaccagcatcacctggagcggaacgtcgcggggcgccacgtctcgcagcaggtactccaggctttctgccagcttctcgttggcgccaatcagtggctgcgactcaatcacgaagcccaccgactccttgttcacccagatctgactttcgctgtcatagtcctggtaaggcagcaggtcgcggatatgcgggtagtccatgtcctgcagcttctgacgcgtttcattcgttgtgtcgcgctcccccagaatgcccgccactgtgtccaccacgttcagcgggtcaaagcggaagcctttcagaaatttcatgcggacctcacatcagaatgccgctccagtcgccgtgactggagacgctgtaaatgacctcacccatgtggacgttgctgtcaggggaaacgtacggtgcaatccagatgcgcgctacaccgtcaggacggcggaacgcagcggctggttccgggaagcagtgcgaggcgctgcagtacgcggtctgtcgggcatcggtgcgcagaacgccgttttccctcgtgaacgggcggaccccgccggatgatgcaagccgtaccgggatgccgtcgttcaggccgctgtggcccgcctgcgcctccgtctgcgggtccaggcggatggtgccggtatctatcaggcggtagtcgtccaggcgaatgcccgcaccggtaaagccgcctgcggcggaagttgctgacggggcgttgccgctgctgccagcagacatgtcgtcggcctgcgacatccagaccccggagtccttcgcaggcttgtcgaactcaaagtcgctgttcatgccagcgcagccgctcagaaccagcgccagcgcgcagacggataaagcatgtgacttattcatggggctctccgttgagatcagatatttcggtaacgtcgataaagaggtcgccgtgtttgccgctggtcccgagccgggacagcatgttaagggcgaaggtgtcgccgggtgccacctccagcaggcggcgcagcgtttccccgaaaagcgcgacgtagccgtcgtcaggaatgagtccgggtttgcagtagagcttcttgacacggtagcccagtgcctgcagacccggaattcgtgcatcggcctcacgcccgaagcagctcaccgtcctttcggtaaacaccatccagccgcagtgctctgcgtgacgaagccggatttttgtgtctgtcattgcgaaacgccctgcggagtcatatttttcggctggctgcctgaaggagtaacaaagtcattcatattgaggcgcgtcgcgtcgccgagtttgccgacaaggtccggcggaagaccgctgttgccctgctcacgcgtctgcgtgtcctgctgatgtgcgcctgagcgctgctgctcttttgccagcttcgcggcctcttcatcctcgataaacttcgcgcggaagccttcgataaacaccacctccacgcggttcgccgcgcctatcgggataatcgggtgatactgctcggcgcgctcgatgtagtagtcggccagcttgtccgcagccttgcccacgccgccgccgatggccccgcgcgccacgtctcctccgcttaccgtgctggttgcgccaataccagtcaccgtctgaccaacctgcgaagcgctctgccccagcccacccagcgcgccggcggtaaacgccagcccgaggattttgccgttgcgcattaccggcacacccttgatgccgttcttcccgtagaaagcgacgtgccccttcaccgcctgatcgatatgtttaccgtcaatgatgcaggagagacgctgcagctgaacgatggcccgctcgctggagatgtcgccataggcagcggccgtcacgaagcagttatcgaaccggtcgaacttgttgttgcccggcaaatgcgcttttcccttgagcttaaactgcatcggcaccaggttattctccccgcgaaccgaggcattggcgtcggcgccttcaataacgatggcgtcggagaacgtaccggtcggcacccagaaggaggtgtctttcgctttaggctcaaacggcgagtaatcaaacgtctggttatcgatctggcctctctgcacgggcgcaggcgcaaaggtatattccgtgcgcggcggtgtataacctgcgctctgctgaccgcccggagcggtcttaggctggttctgctgatttttcagctgttccatcaggtcgctgacattttgctgcagggacttgttgttgttcatcaggtcggacatctgttctttgagtgacccgaaatctttcttcattgcggtgagctgctcccgcgcttccttctcgcggttctgcgcgctgaccagcagcgaaccctgcccggagccgtcaaacgtgttcaccacgccgccgccggtcaggtccggctcggcggcagctttatcgggcttgcccgctttgttcaccgcatgaccggacacgccacggttggcaaggtacaggccgccgatgattacggcagcagcggccagaatgatggcaaacagccggcgctgcttgctgcggaccaggctattaaggttcatccgggcctcctcgggtgcggaacacagtgatcaccgatacattcgcacccggctccagcacgtccagctgtggatgaaaagcgacggccattacgcccggactccagaagtagcgctcactcaggcggatgcgctgcgaagagaggctggttaagtcggtgcgcacgatgcggacccggtcgccctgccacgcggtcaccggacgcagggtaaaggcgcttttcaccgattcgctgaccggcacgtcggtatttttgctgaacacatagccagcaggcttgcggttggtgataaagcgcccgaccaggccgctgatgagcgcgctgtaggtgtcctgcttctgctcgtactcccgcgcctcttccgtaccctgtacctcgcggttatccaccgtcaggctcagccccgcccttttgccaggcgtggcctgcacagagaaggcaaagcctgactctgtctgaacgaacatggtgaacggcttatcggttacggtagaaaatacaattgcgccttccggcgtaggtgatttggcgctcagcaccccctgcgccgcctgtacgctcagaatacggtcgtcatttacgcgcaggtagtttgggttagtgttgcttactgccgcgtttacgcgggcgccagggttaagcgtcagctgttcggcgcgggcaccgaaggcggtaaacaacgccacggcgctgattaacagggatttacgcatcaggaacctccaggaaagcgctccagcagagacggttgtttcgggtatcggtgcgcaggcggtagtgcttcttcaccggctccgcgtcatgcagtccgtaactcagctgcagatcgccgatgacgtccacgatgcccttatctggccagacgctgacatccttcggatagaacaccgagccgccgctgtttcccttcacgcgtgaggcttcgtctgccagcacgcctttcagggacttctctgcgccgtcgcaggcaccggccagcagcatttcgtggctggcgtctgcgttactgtcggaaatgttgaggcgcaggttcaaccacgccagcgccatcaggcgcaggtagcgggcgtcgccgcgctcgccggtaaagctgaacggcgtgtccgcgccgtagggaataacaatggtctgtcggttgttaacgagctgattcatgagcgcccggttatcgccgtaaatgcgccagcagagcgccagcgcgaggatcgtgataacgagcagcaccagaatagccacggccatattgcggtttcccgccgaacgcagctttaattccatgttgtctccggaggggggtcaggcgacccagtgccgtttgtagctgtcaggcaggatgctgataaagaagcgcatcactgatgtaggcaggcaccagtacgccaggttgagaagatactgagaaccgcggcctttcttgagatgacgaattccaaccacggcggctaatagcgtggggccgaaaatccacatgttgaggaagattgcgagcagtgccagtggcacgtacaggcagaactcatcaggtggcagccccacgaaccgcttttgctcggaaaacgtagccgcaaaggtataccggtcacgtttatccattagcgcgcgttaagacgggatgatgccgaaggcaacgttgataaacaccatgaccgcggcgataccgccaaacatggcaaggttcttggttttcacataggtaaacacggcagcgatgatttcgagaatatacagaatccacaccactgtactaccagatccgaatgtatcgttaatggtggttttcccgtttgcgaaaaggtcttccgcgtgcgctggcatagcagcagcagccaggatcgccattccggtgaacagagctggtttgtttgctttgttccacgctaccgcccctgccttgcggcagtaatttacacacgaagagagagtgcccttcataggatatttcctcagttagggttataatgatcagttggttgaactatcttttgtcactacctgtattgccttaagtcaaattcctgttttgccggttacgcctcctttacacatcaatggtattgcaacagatgcttacgtttccctgtttggttgacgtttttttacgcttctggatcacgtacttcaatttaagttattgatcttactgatcaatttcacttatcgtcatagccagcaattttacttaagtccataactggttgaacggaaatgaaaaatcatggctgacgctgccgacttaattgttcgagtcgccgaaccggcgggttttgcggcgaaagtttttaggaaaaatgatgaggcagccttatgtaagctgcttgaagaagcaatttttcgttacaaacgcgacccgggctggtttgaggtgatgacggcagaaggccgtttttatgcctgccagctggtgactattcccctgctcgcctttatttcaaaacgcgttcccggcagtcagctgcggactgcagcaaaaaaagcactcgcctacataagagagcattatgatgtgtgcgatccagacacctggataatgataaatgccgatttcttcactccccttccccgccccggcgtcaacctctggcaggctcgaaaattaaagaacagtctggataagacgatatttattgagccggaaacgggcattagcccggagaaaaagagttccccgtcagttttaaaaaaatgtgataaacaggccacaggaaatacggttttctctgcaggaaaaagaaagaacagtcccgacgcagaaaaagtaatggagcgcgtcatgctgggctggcgcgtaaaggatatatgcgaagaacagcattgctctgaagcctacgtctacaaacttataaagaagctgaaggggaaatcagcaatggattatcgctggaagcagtgggaactgattgcagcaatgtatcatgctgaaccgaagatgacggttgagcaaattgaaaaggcatacggtgtatcgcgagcagtgatttaccatgcagtcagaaaaatagccgaacgggacggaaaagaagtcgcaccgagggaaagagagagaaaactttcaccggacgatgttgaattaataaagaagaaactagcagatggaatcctgagaaaagatatctgcaacgattacggcattacccttgatacgctgattaaatacattggtacgcgtgaagatcacaaggttattccctgtgaattaaaagactatgcggttcgcctgcgcgtgcagggtaaaacccttcagcagacagccgatattcttggggtgactgtagcgacagtaaaaaaagcatggaacaaagtgaaaaactcccctcagattaaagaaaatcgcgtcaagtatgataaccgcaatgtactgtctaagcgcgaccgcgatcaggccgtaaatgcagttctgcgggatggacatacccgaaagcagatttatacgcagtatggaattaatgcactgacactgcgtcgttatatacgtgatgcgctgaagagagaggccgatgcattgagggaagatgacaaagaaacggatggacaagataagccataaatatacagcctgatgaacatgtgcagacatcaggcttttattaattatttaaagtattcctgcagcttacccgctacacgttcattaacagctttcacccactctggatcaagaaccatttcgtttttaatgaccctggcgggatcaacggtctccttctgaatgccaaaaatagcgtcagtgataaaaccactcaccagtacgtttttggcgataaactccagtttctggtcaagcgtcttttctgaagcatccttgtttattttattttcataaacacgaagtccaagcttaaacatttccatcacgaacgctgaccggttcgccgtatcgcgtgactctccgtcttcaagctttttctcaacgtgggcatcaatcttttccagcagggagaaagggatggtaagattaacccggttacgtttacctgaattgtcttcactcatattttttctctcactaagtttttattactactaagaaatcgcacatcggaccagttagattttctgacatactgcagagttttgctggtaaccatcaggtaacaacaccccgaaaaccaagtaactatatggaaaccaattaacctaaaaatattgtaacttactgattaaatgagaacaaaccataaagttacctatttataactttatggattccatatggttaccagatggtaaaagtagtacagcctaaatttgctacgattcaaagctaaattgctgtttctaatgaatttaatcagcaaaattaaatttgcgagtggtgtgtaaaaacccaactcttatgatattattgagcctgacatctcctccgaacttttcaaatcaggagccgcaatgcgtttatttactcacgctgcagccctgctggcgacaggcattttctccgccagcgtgaatgcggactgttttattaaagctggcgaatggtattccatcgatccggactatctgcgcgctatcgcctggcaggagtcacgctataatccggcggctgtaaataccaaccggacgaaagatggaaaacccggcagcagtgattacggacttatgcagattaattcggttacaatgcgccgcttacaaaaagagtacccggacctcagcaaagaaaagctgctcagcgagccgtgtctgaatatttatattggtgccatgctgctgcgtcgtaatttcaaccagtacggcacaacgtggctggcggtgggtatgtacaacgcgggaatgaaaaacctgcctgtgaccgtaacgaaccgctataactatgcgatgctgattgataaacattacaaggccatcaaggcaggtacaattccgcgcaaggcattcagcggctgaacggtttttgatacagacgaagcgcgcaacccagctttatctttctgcgcagaattattttaaagacaacaacaaagcccgcgcgcagaattacccgccccggctcaatgccgggaacgggtaactggagtaacttcacttttttctttcgtgcagcctgctccctgcatcgcactggttttatatttattcgtctccggctcaatgccggcggcggataaaaggcgaaaaaaagggaaccttctggctccccgatgactgttactttattccctcaagcgttctgtttatctcaccctgcacaccctgattatgccagaagtaatctcgccccaccctgtaaagatcgccgctattaaagcgcgccagtgttatttcctcaccctccaggctgccaccatattttttagcgatcatgttcaccgccttttccttcatcccgtccgaataatcccggtcagtaaaaacatatcccactcccccataaatacggttaaagggagacgcacaggaaacggacatatcctgcatgccatcaaaataactgtctttatacttatccgttactgcttttacttcttcctctgtaggcccgtccatccagttaacgcttacgctgtcataactgcgcttgcgaacggaaaatttaacgcccgcaaatctggccttcagctccttacgaatattagacgttacctgcatagcgccgtttttatcctgcgagagcgcagcatattccggggccgtttttaaacgctcgcactcagctgcataaaggcgttctgcctcctccttttcctgctccttgcggcgttcttctgactcggcatattttgcaatacgcgccgtctcttccccgctttttatttccggaaatatgctccactgttttccgtgcaggatactttccggcagcccgcgcgatattccgccactctcaaacgcaatatctaacgtggcatttccgccaaaagatacgcaacccgaaagcgacccgactgatgccggtttctcctcgccgtgaacggcgaacacgacgccccgcccacgattgtaaagaaccgtgctgacaacctgtccgataaccactgcctgcgcattgtgcattttcatttcagttttccttaaatcagttgagacgaaaaagcggcccgcctctacaggccgcacaacgatttcagaatgggatatcgctcagggtggtatcaccggcaccggcagttacctgattttcactcgccgggttcagggcattttccagtgagatgatcccacgcgcgacgtcgcttgcccggtaataatccaggcccgcatcactcgctgcgtgaaaacggtcaaaaaacgctttcgcctcttctgccattaccgcagaggaacgccggatatactcccgacaggcttcctgccatgaggctgtgcggtaaaaaatctgaccacggctggcaatgatgtagcgctccgcagatatatcccccgcgtcatagatcgcagtcatccctcgggccgaacttgccagacacggcaacgaggtatgtccggcatccatcagcgctatgacatctgtttcatcgagtaggagcacgtccgctccatagctgccgtttcgcgcttgatagtgttttcctgcagtgggcgtgaccttttcgccgttttcgcctgtgacgtgccagcgcgtgcgcagatccttcgcgctgacgcagatttttcggcccttaacccatgttttggaagattctgaagcggcgacgttgacgttttgtgtgtgcatgctggttatcctgtcaggtggttaattcatgcttcggttagttcctcgcggcaaagggctgagaagcaacggcaggcagcagatacaagggcgccgcaggcgtgcatttcacccttgtatctgatgaatgacggtgctttgattcgcccgtcgcgtggaaccggccggaacataaccaccgtgccggaaatgagcatgcacacacccgaccgcaacgcgggcgtcctcagcggccacggattttttgtggccagtgaacgcgcgggcgcacgcccgctgcaggggttgaccttgacgttgccatcagaccccagccgtcaggcccggaacgcttcgcggtccggcggagcttaccggcacagccggttagcacagtggggctgacgacccggcaacgccggggagccggaggtggccatcatgatgttcatgacgttgacctttatggaaaggaaaccggagaagcagctgcagcacagcagaattagcagcaggaagcaaagagagaagaccgtgagacagcctcccggagtgagaaagcgcaggcgaagggagagagccagtgcgtcagcacgggttttccccggcccgcagggccgtccgcctttgtgggctttgtgatagcagtgcgggactaccctttctttcgatacagcgatattcacgcgtatcatcacttctaaaccaggaggtaaagacttttagccggtctgccgataacgggtaatgtcagcctcaaggagataacagacatgccgtcatttttgaataattcactgtccctggtcgttcttatttcaaccttagtactttcaggatgctcaaatctggtgcctcgacagcatagcgattacaccggttctgatgctgccactctgctcatacatcagcagggaggggacggatattttacccttcttaactatgaaaataagggagaatgttacgacagaactgagactcacacatttcagtccggtagtttggatacaagcagaagaattttcaccctcaaaatacaacctggtaaacttttagccgttcagcagatttatgccgacaaaaaacaattttatcctttgggaccatatgcctcggtccaggtgataaagaagtttccttttatccctcagcccgggaagcgttattattttgctgttaaccgcggcgtacatgaaattccaaatgattatgttattaccagttatactgatccggaaaaggtaaccagcgaatttccaaaactggcgcagcccagctgggatcctaccagactctgtcagcatatctggggtaacgagtagaacgcagtgcatcagctacttcctggtaatgtcagactaatgcacatgtgataccgggcagcaggtattaaaaagcccctttcggggctgaatgatcaggcctttcgccttttttgtgctctctgcgcgtctctatgcaccattgaagattgtcggctaactctgccaggccgtatatcagcattactattgccacggcagctataattttaaaccctgtagctgatccggggtctgcgaaatgctcaagcataaaacctccctttacactcccagcgccttcataaccagtacggtcacagtcgccacagctccgatcatccctgttgaaaccgcaacgggataccagaacgtctcacggttcagcttacccgcctctgcgttcagtttttgcgtttccgccattagcttggcgatatccacattaattcggttactgttaagctcgttcatatcggttaccgacatccgtcagttctccctttcgggcagggccgcagcctttctgcgctctgctgtcagtttatcccgcaggcctgtcacacaccacgccagcggacaaagtttagtcaaagctgataattgccctgttgtcctcagctttgctgccagcggttggtgatcatgccggggaccactctgtagcccacgtcgaactccagcactgctaccggccagctatcacgcagataaatgcgcagcccttcaggttcgtcggtcggctcatggatgacgtcacacatacccagttcttcccacggtacggcgctgaatcctgcaaacattcctgcatcgcagatgtacgcgtacagatccataaattgcatcgtcgtaagggtgtcatgctcctgtgcgggcgttgccagtgcagcgaggtttacagccttgcttacgtgtgcgaggatgcgtgtatcagacataaagttaactccttcgtgttttgatgctggccggaccgtgttgctgcacgcccggccgttaagagagcaggcttatgcctgcttttttaatgcgcgttttccgccgccattgccagcactgcgctcagcaccagatccgcgtgtttcttccaggcatagtcccggcattcaaaataacgaccgcgaatgtgcgcaaaaatatgcgtcaccttgcccgaatacatctcacagcacttgaacgtctcgccagcgggcgatgatttccagtccagtggcggcagcacggtcagctgatccatccagcgttcctctgtaatttcttcccacggtctgaaaagacgggtacagaacagggcatcggcctcagattcagtcatcagtgccatatcgtcgtactgcatctgcaattcatcgagcgtttcaaaattaaaaagcgacacaatgctcccgtcattcattctgattgcctgactgaacaccttgcccgtatcgattcgcacgaataccagatcgtcagccgttttgttcgggccgttaacccatgttttggaagattctgaagcggcggtgttgatgttttgtgtgtgcatgctggttctcctctcgggtggttaagtcatgtttcggttagttcctcgcggcaaagggctgagaagcaacggcaggcagcagatacaagggcgccgcaggcgtgcatttcacccttgtatctgatgaatgacggtgctttgattcgcccgtcgcgtggaaccggccggaacataaccaccgtgccggaaatgagcatgcacacacccgaccgcaacgcgggcgtcctcagcggccacggattttttgtggccagtgaacgcgcgggcgtacgcccgctgcaggggttgacctagccgttgccatcagaccccagccgtcaggcccgaaacccggagggattcggcggagcttaccggctttgccggttagcgcagttgggctgacgacccggcaacgccggggagccggagggggccatcaggctgttcatgacgttgaccttcagtgaaatgaagccggagaagcagcagctgcacggcagcagaacagacagcagcaggaagcagagagagaagacggagagacagcgtcccggagagagaaagcgcaggcgaagggagatggccggtgcgtcagcacctggtttccccggcccgcagggccgcccgtcgttataacgcgactgacgtccagaggcagaccggacctgctgcgcccggcttgcatcatttcttaactcaaacgctcaggttcacttattaagacaaaatatcggtgtcgctgatccagcagatattctcgcgctttttcgcttatgtatggccgtgccgcgtcttctgtatagcgattgtaagattcacattccgccagagtcataatgtgtcctgagtaagttacatagcctgccttaagcgggtttttaagcgctgccgccagacgttcctgtgtgttcatgatttagtctcctggttccctgcggcatgccgcagggattaaatagtcaggctttcaggcgggaaaactgccagtgacaaaatggactgtattcgtcagtcagaggcaggttttgctgcgcatatttactcaggccttcatgctccgaccagaacaactcaagtgccgcgacattcagatcacctgcggctttataaacgttggttgtctggtattcggtattttctgcgtactcttcttcgccgatcggattagctgaatgcacgatccgggtttcataggtttctggtgcagcgcctgcctttggagcatacacagatacagtgatgagcagtttttcgtgcgcgttaatcagcagcatctcgattcccgagcggtacttacccgtatcaaattccacttgatcacgcgtaaatgttgccgcggtcagatattccagattcatagaaaaatcactccgcagtgctgcagtatttacattgaactgcggatagccaaagtaaaaaagattgcgacggaaggcgcgccggatagcatcatagttgataccttctgatggttttgcagtaaaagaagatgattctttagattctgaagccgtggtgttgacgtttctgctgtgacatgttgtttctcccgttcaggtttaagtgatgtttctctgagttcctcgccgtgagagcagaacaggcgtccgggcatcaggctgaacgcagggggaaacggcaaagccgcagcccggagggaccgggtgcagccgtttagcgtgcgacccttgcgtgaaggcgcccgggtgccaggtttctgcacggcgaagggattcagggaacaaaacagagtgcgggtgatgaacagggcacagccccggacggcggctttctgccggtccggtcctcagcggccacggccattcgtggccagtgaatgcgcgggcgcacgcccgctgcaaggggtgacccggccgttgccatcagaccccagccgtcaggcccgaaccccggagggattcggcggagctaaccggctctgccggttagcgcagtagggcttgacgacccggcaacgccggggagccggagggggccatcaggatgtagatcttaatgtccgcttagtgccagaagcggatattgcttacatcgtgctatattagtttactggaagcaggtctggatgagatgaccccgaggtcgtgacggtacttagagatggattgacgcacgtatgctatgaaaaggttttagcataaacgttgaacatgacgaattgtgttttgataactcgaccatctgaggcaaacaaaatcaaaggcgatagtgtggtttaaatcaatctgatgcgagctttaaatacatcctatctaatttttaatagaatattatctgcaataaaaaaaatatacattttaaataatttctatatgaaacttaatgagttctaaggcttgtgtctaatgataaaagatgatgaagggtagagctctgggttaaggtaaagaaaaacatacggttagtaatgtctatcaaaaaaaccgtagaaatagctagtaattacaactgtatttatatacagttattagcgtggttaacatagttatattcaatgctgtaaatgtgagcgctctggtttactcactatagaacaaggggttataatctgaaaaagtaatctctatggactaggaatgtttactgacccgaacagcgacccgaaagtatgggagcaatattttaagagcattatccgtttacactataagccagctaattgctgcgatttgcctgattcgcaaaatggtgatttcggcattgaatgttacactctatcaggccatgttttccaatgctacttgcccgagcaatcaagcgatgttgaaaagctagttaaagcacagcgtagaaaaataagtactgacattttaaagttcacaactaagtataaagctgatcttgaattgttgtttggtgaaactaaagttagtagatggattttggctacaccttatagtaaatctgcaaaacttacgcaatattgtactcagaaatccttaaaagtaagaggactgaaattaccgtatgttacagatgacttccagattttggtgcaaacagatagtgactatataactgagagggcacttcttcgaagaacgaactatcagttaaatttagatcttagtaactctactattgatcatgcagtatcatttattaatgagcatgttgattttttgaataagttaaatttgaaacttccaaaaattgacctttcagaatcagtacaggaaacttacagacgttttctaatacaaaaatatcttgattatcagaaccttatcgatgaattaaagcagaattgggttgatatttatgaagttgtatacaaatgcattcaacaaagagaaacgaacttggttggactttctatgcttacatcttcaagtgcgcaacctggcgataagatgatgaaacaaatggaagttctcaaagaaaatatcgaaaaggaaatacccacgctcaaagaatcagatttagaaaaaataaattggggtgtaatatcggattggttaattaggtgtccgttagatttttaacatggtgaaaaatgaatattaaaatagaagatatcatcggacgacctttcacatttacgcggaggccggaacatctcccatgtgaaatgagacctatgtggcgatctagccttgttttaataatattcttacttgttgctgcaagaactggttcatgcacattgaaaaaacttcatgttgtcaattggttgttaaagtcagaaaaaaacaccactgattttgcattttgggttttgaataaagatagtgctaagcctgaagtcagaatggatccgactttggatagggccattgagcttttactggccgatggttttctcactcgcgaaaatgacaagatgaagttgacagacaaaggcgatatttgtgcgatcaatttacttgcattagacgtctttaaaaaggaatgtatttccttaagaaaacttaaaaaaggtttgacagagactaatataaccaaaatatttcaggcgggatgatatgtcttttgaaataatttctcttaaaataacagttaatactatagatggactatatggcattgatatccctttctcaaccggcctgtttcttttacgcgttgaaaactcacatggtaaatcaacgtgcatgaatgccattgcttatgcacttggaatggaaaaggctttaggtttaggtggtgctaaaatacccttccccccatccttaactagagcactgactaataaggatggtaaagaagtcagtgtggttaaatcatatgttgaattaacaataaaaaataataaaaacactgttgcgaaactaaagagaaatatagcaggttttgaaaatgacaatcttataaatattgatgaggttagttctgggggcgatcaaactaatggctcatattttttacatcttgaaggcgatactaaaagagaaaggggcttttacttttggttttctaaattccttggttgggaacttccacaagttccgaatcataatggtaaagatacccccttatatccgtcggttctttttcctgcatggttcgttgagcagaaaaaaggttggtcatctatccttgctacaataccaactcaatttggcataaaggaatcaaagaaaagggctttagagttcttactttctttagatgtcaatgataatgtattagagcgaagcaccatcaaaaatgaaatagatgctataggctttcaatggaagcttataaggcataatgcggagattgttgcagctaaagtttctgcaattgtttcaggaatccctgagcaacccgaagtaaagttcgatacttataaaatggatctaattttaaaggaaaaagattccattattgcagcgattgattatcgggttaaactcgaagcccagctaaaaactcttaatagtgagtatgttcgtcctgtggatgatgaagaacttcagaaagaggttgtcggtattattagttctaaactggatgaaattaattcattagagctcgatttgcaaaaaataagcgatcataagagctacatagcgcatcaaatcacctctacaacaggcaggctaaataatcttttggatgataaaaggaaatatgaagatcttaaaaaaatagcttcctcaactgtttttgataatactcatttgaacagtaatgagtgcccgacttgcggggctccttacagtgataacttgctagatctttcaccgcaagataatctcatgacttatgaaagtagtttaaatttcattaaagatcagattaaagcttttgaatttgttttggaagatagcaaaaaccaacttaaatttaaaacatcagagcagataaaaacacaagagacaatcgccgccataaaagtcgatataaatagactaaagaaaagagatgactcatcacttgccttacaagaagatattttgagaagaaaaataaatttagaaaattcaattgataatataaccaatgcctatgcggcactggctgaaataaaacttgaattaaatgctttgcatgcaaaatacgtcaaacttaattctaaaagaaaagcactgccgcagagcgtactctcagctaaagatgttgaaaaattgaatctactaaagtccggaatggtaaatagacttaataagtataatttcaccagctttgctgcaagtcttattagcatctcagaagatacatacctccctactagagagggctatgacattggctttgacacttcggctagcgacggaataagaattatctgggggtatttgttaagcttgttctctgttagtagagcatattctacaaatcatcctggggtggttatatttgatgagccacgccagcaagaagcaaataaggtgagttttgcagagttattaagagatgcggcgagatcggcttcaagtagtggacaaataatttttgcgacatcagaggaagagagtgtgcttgttgatgcattgaaaggccataactacaagatagtatctttcgataaaaatgacggcaagctgattcgtaaactggatgcataaataagctacatttctttgcatgtaatccgaaatgactgatctattatgctctgccagctctgaggctggttagagcacataatgccactgcattaaaacccatctctgaagtgggcaggcgtgatggggtgctaattattatttattcgtgtctgagcgcctcgctgtgaggttgtttagtattgctttttgcgcagtgatgtcggcgtgtggcgttgctgaagggcttctgatgcgggatagttaaaagccctcttatagcggctgcgcggttttggttgaacatgcgtagaatgatttctgtacaaaatgtccgcttctcgctcatagcggaccctggcctgccgtcagtccgctttgtgccagaagcggacgttgacagcccggcactgcagtggctgccctgaagctggacgcaagtgattcttcagtttcaggcctgactaaatttggctccgcaatccaaaatatataaaatattttcatttaatttgtgacattcatcctctccatattttcataccctcaacaaaaaaacaccttaaaatcaggctctatttggcatttaaactataatcaggtctcatcacctggattcgtacggatgatttttcactgacctgatacagttaattgttaaggatatatcatgaataaagtgacctctgccctgattagcagcagtatttttctggctatgagtgcggccggcgcggcctcaaacgatgttcatctggagcatcacacgcagtctttcgttgaccagctgaacagcggtaatggaaaacccattgagaaactttcgccggaggaagcccgcaaggttctgtccggtgcacagtcttcagtgaaagttgacctctccggcgtgacaacctcaaacaaaaccattcaggtcgatggtaagcccgtagaaactgaccatcgtcaggcctgaaaatgcctcaggaaagctgccggcctttatgtttttccacggaggaggatgggttctgggagatttcccgacgcatcagcgcatggtccgggacctggtccttgcgtccggtgcggtggccgtctttgtaaactatacccccagtccggaagcacactatccggttgccataaaccaggcctacggtgccacaaagtgggtcgctgaacatggcgatgaaatcagtgtcgacggtaagcgcctcgcggtcgcgggaaacagcgttggcggaaacatggcggcagtggtaagcctgatggcaaaagaaaaacacggacctgacctgcgttaccaggtgttgttctggccggtaaccgatgcaaaatttgacacagcctcctacgaaaaatatgcgacaaagcgcttcctgacccggaatatgatgaaatggttctgggataattacacaaccagcgatgcgcagcgcaatgaaatatacgcttcaccgctccgtgcttcagaaacccagctgaaaggtctcccgccagcgcttgtacagacggcagagaacgatgtgctgcgggatgaaggggaagcttacgcccgtaagcttaacgcagccggcgtggacgtggttcaggtgcgttataacggcatgatacatgattacggactgctgaatgctctcgccgaagttcctgaagttcaggcctcactgactcaggcgggtagtctgcttcgcgagcatctgaaatagttttagcgggctgctcagaatgctgaccagcccggttttactcttcctgaacccttcttcatgccgtagatcagtgcgattatggcaatcacagatataaccccaaatcagacatttcatcccgaaagactattacgccggaaaaaaacgtctgctgttcgctcatagcggacatgggccaacgtgttagtccgctttgtgccagaagcggacattggcagttttcctgctatgcccctttaatggcaatttcaagctgtcagtgaagatactgttgaattgcagcttacagcctgtaccggtcagtcagtataagagggctgaaagtcaggtattgccgtacggaatttcagaacttacttacttaatatttctaactttaaatccatctggttgctaaagtctggcgatgctggaaatcagctatgtgaatgcccatatcaatcagccaggatggctctgtgaaaaataaaatcctctttctgctgtctgtcttttccgcctttgccgctgcaacacaatcccctgatgaaatcgtggtggccggaggtagatattatgccggtaacgtttttggccaacatgactatgcagcacacgccaacatcacgctgaataccttctggatcatgcgtactgaaattacctaccggctttattcagatgttcacgaatgggctgttgagcgtggttatgtattcggtgtcggatgtaacggagccgcttacgaggactgccggccggcggatacagacaacggtgcacatccggttaccagtgttgaatggtcagatgcggtgatttttgcaaatgctctgagtgaaaaggcagggctgagaccagtctatctcaataataatggcgtcccggcacgcgacagttcccgttacgaatttaccctggatgcccgggctaatggttaccgcttacccacggccgaggaatggcagattgccgcccgtggaggaaaggccggactggaaaatggctcgtatggtttcagatttgctggcagcaacaacgcaaatgctgtcgcctggttccctgacttcaacgatccgcatttcggctctgtccgagtgaaaagcctgcggcccaatgcgctcggtctgtatgacatgagcggtaacgtttcggaatgggttgatgctttcgacaccctttccggtgtgaaaatgtactatttttgcggcggcagcttcttgttgcatacgggcagtctgaccagctgcgacacgcacagtgccggatacgccctgccggacaccggcttcagactggtgcgaaaattttgaacctgaagatgccttttattatgctgacgaccattctgataagccttccggcttcatcacaggcagacacccgcgttcacctgaataaggggctgaacagcattgatttgaatggtgatggcatacccgacaccgtcttttccgccacttatgacaataacacttctcatcccagtgagaccctcaacgtctttatcagacagggaaaaaactggtttatcgtaccggtttccggacgacgatggctttacgtgggcagatttaagactgtcagcatctgcccttaagataagcggcacagaacttcaccgctataaagggcgggtttaccttatcagggctgtcaaatatgccggcagcgccggtggcggagaccttaccgataaaacgcgagtcaggttttcacgattccggctggaggaaaataacgaggatcccgggacgtctgttttttactgggatccggcaggaatttatctcactgaacatacttttgatgaagtgaatgaagcttttcagattctggatatggagaaatttcgttgaaatgtatcacagggcttttgctttttttcctgtcgttctgctgttgtgcgggatacaaaagtcagtaccgtgagcttatacagcagtcacttaatcggcagtctctttgtctgggtgaaaagcagtggccggtttcaatcagaacaggtaccgaccggtggattaatgcaaaaatggaggcgcttgttgatgccggcctgattacttctcatgtgaaagcaggaagaaaaatctgggagctgaccccatacggtcaagcttcgttcataaagcatcatgatttctgctatggaaccatgcgtgtcagaaccataaggactatctcaacagatcacacaggcgttacttatgtgaccttcacctattatatctatgccctgcccgcctgggcgaagaatcactcagtgcgtattgccaataccgacctcgataatctggtcatggggattaattcagtgcgctatcaggccctctttgatacgaacaaacagggaacgccccgtcttatcagtgaacctgaacagcttgatctactgtattaagggatattatcggataaatcctttgcaatgtttcaaggtttgctaccgcatcttttccaagagtactgaaactaacgtgccggtagagaatcttcacagccagtctagactctttctgaccgcttctactgctcatatattttctgggctaacgtccgcttctcgctcatagcggacctcagctcagttagcttgtccgctttgtacctttgccgtttcgccatcagaccttagccgtcaggccaggaacgcttcgcggtccggcggagctaaccggcgcagccggttagcggagtggggctgacgacccggcaacgccggggagccggagggggctatcatgatgtagatgttaatgtctgctttgtgctgtgagttcaatcgatggatcccacacactaaattaattagcagtaagtaggtcaaatacggggaatacgggccgtaataacttaagtagatggtgagaaggggcgctgggattttagactatggaaaaaaagatttacttgaatagttccctcattaatgagggaatcatagaatatgtggctgttgtaaaaataattcttcttactagactttacccgattagtttcaggtcggctttccgatgccgcttttgctcgtcatagtaattctcgtgcgttcccaggctcaagagatagatctccagtttttggtccagccaagtgtagccgagcaggtattgctgcttccccatgtaaaacttatgcaccaacagatagctaagatcgcccttcttgcgctctcctatctccggatttgcgatgatgcggtcaatctcttcatcaacattgtcctgttccgcttttttcaggcggttaaaggccttctcaaaacgacttgactggtaaacatcaatttcctgacctgtcttttctgcgcacatatttcttcattctcccgttatccatttctgatttcgccagcaggatttcgttgatgaaggaaaacggcagatcagggttgtcctcagcaatgcggccaatcttagcccagtgctcaatctgtttgggcacgctacgactcattgcgtctgcgtgtgttttcacttcttcaacaaaatcatcatctaagcggatgcttgttgccattttaaacctcatgatgtagtcacccatgccagttaggtattggggtggtttcaatcgatacgtcagtatttgacgcactacagacaagattatgcgacaatttgtcgcgcaatgcaacctagtgacgctgaaaacttactaatcgtatatgtccttttcgctaatagcggaatgtgagcaatctgatgaggctaaaccggacgttgccatcagaccccagccgtcaggcccgaaacccggagggattcggcggagcttaccggcgcagccggttagcgcagtagggctgacgagccggcaacgccggggagccggagggggccatcaggctgctcatgaccttgaccttcagggacaggaaaccggagaaccagcggcagcatggcaacagaacaaacatcagcagtaagcagaaagagaagacgatgagacagcgtgccggagagagaaagcgcaggcgaagggagatggccggtgcgtcagcaccggcttttcccggcccgcagggccgtccgcttttcagcggcacccgatgcaggcaacaagccggacacgatgcgcccggcttaacaggatcagggtcggcacgttagcagcacaggcagcgagaaccggttagtcattctactgaaggcgctcatttcaccggccagaatgctgatgtcgagcatcacgcgccacaacggttcgtcatgccactcccacggatcgatatgcctgcatgacacaaatcgcttcagccaggtcagaaccagcgactgcagatcgctttcatagatgtcccggccctgccagtgaacgtaccagcgccctgccgtctgcggcgtatgaaataccagctccagcgccgcctgcgccaggcggttttgataacgtctgcgcttctgttcgcgctcacgggattcccggttatattccctgttctgacgcagtgagagccgcttttcccgtcgctcagtgaaacgggcggcggtcagaggaaacaaccttgagccagtatcctgcgacagcggcgaggggcagcgctcgccgcgtgaggcgataagcgtatcgagcgcggccaggtactcccgcgcgggtggcgcggcacgatcgcctggcgagtattcgggcataacccggcgcagctgatcggccctaatggtgcgcgtcccgcagtaatggcgcatgaatgcgctggcgtatgggtttgcaccgcacgttgccctgccctgcaagcgcttttcaacctcggcgacggccaggctgaccgcaagggtatacgggcaggcgggaacgagcgataaatgacgggggatcatgttcatgggatttctccttgtctttaatgaccgccccgaagggcggtctgacgctgtcagccttcgctgcccgtgtcgtctgcgctgtcatttactgccgcaggccgcagaggtttcatccacgcgggcacccagcgggagtccttcatgaccccttcggcaaactcagccgcgtcgcctttcttcattttctccgcgtcgctggcgttgcccgttttgcctgcctccgtcagcgtcccggtaatctgctctttgcttatgcgcttaaagaaaccctcagcggtcggctgccaccactctgccaaatcaaagcccagcgccgtttccagcgtatcgaggttgcttgtctggctgcggccataaatgcgatcctgaaagcagcacaccgccgtggagctgcagaatccctgcagctgcagtatctcgtccgtgctccagcccatcagccagcggaagtcctgcgaccagttttcagggagctttgcctcccactgcgctttctgctcctgaagaaaccgccaggcttttgtctcctccttcgcaaccgttccggtaaccagcgccgtgctgttatccgtgaggctgattttcatcggggtcccctcataacttttatggctgaaggtgctgcggcacagagtccaggtcagcatggcaagcgcgatttccggctccgtgctcagcgccgcctgcacggccagcgaacgctcacaggacatcgagcggaccagcgtcgcggaatagtcttcggaaagggtctgcagatcgcctttgttttcgggtttttcttttttaggtaaatcggcatgacgctgaaccccacgctgaatgaagcagcttcctcgctcgaagcaaacaattgccccgaccttatccttgtccgcgttcgcccagctgcgcttcaggcccgtttcttccagggcggcgattttctttctcagtgtcacgtccagtgcatcgtcttctgaaagcttcaactgtgcccgcagctcgctcagctctgcgtcttcttccgtcgtcagcttcgggcagtgctccggcatcaggtgataggtttttttcacctcgctactccagctctgcaggcgactatccatcctgacttccgcccaggcaaatccttcctcactctgcacggcataggcaatttgctgcagcttatgcagcgccagctgctcgaccagcgccgtatcgatgtagccctcgtcgtcgcagctgaacaggtcggtgcgaatggtgccgcctgccgcgagataggcgtctttgccgatgaaggtaaactttggagagtggctgatcgccgtctcggaggaggtaatcagcttgcgaatgacttcagcggaggcgttgtagtacccggaggcctgctcccatacttccagctggcgatcgtgcgtatcagccagcgccagcgcctgacactgctcaagcgtaatgttatcggcggccagctcgtccaggatggcaggatcaagatcgataagcttcaggcagcgctgaacgtggcgcgagctgtagcccatcaggtcaccaatttgcgccggtgttttgccctcctctgacagcgcccggaaaccggcaatctgctcggcggggtgcatatcctcgcgctcgccgttttcgaccatcgaggccgcgcgcgccagctcctccgtcacccgcttaaccgggatcagctgatcgggctgataaacaccctgtgacagcagcagctgcattgcggtaagccgacgaccgccgcaggccacacccagcatcccgtcagccatatcgtgtgtaatcagattatgcagcaggccgacgtttttgatggtggccgcaagcgactcaatacgcgactgcacgtaaattttactgcgtacgttcaggggcgaaatcgccaggcgtgaaagcgggatcatttcgatgtcgattttttccagcgcctgctctactgcctccgccgcgactttgtgcgctttcgctttcgcgggacgacgcggggtttttgtctttaaagaagatgattctttagattctgaagccgtggtgttgacgtttctgctgtgacatgttgtttctcccgtgtggtttaagtgatgtttctctgagttcctcgccgtgagggcagaacaggcgcgcgggcatcaggctgaacgcagggggaaacggcaaagccgcagcccgaagggaccgggtgcagccgtttagcgcgcgacccttgcgtgaaggcgcccgggtgccaggtttctgcacggcgaaggggctcaggagaacaaaacagaatgcggaaggatgaacagggcccagccccggaacggcacatcacggtgccggtccggtcctcagcggccacgtctttttgtggccagtgaacgcgctggcgccagccggttgcaggggttaacctggacgttgccatcagaccttagccgtcaggcacggaacgcttcgcggtccggcggagcttaccggcgcagccggttagcgcagtggggctgacgacccggcaatgccggggagccggagggggccattttatagttaacaaatttatctataacgtgtttaagttgggaattgataaatatctgggttaggtgtaaattgttttaatatatgtagttaaaacgccatgaaatacgccactttaatttacgcagctaacaataaataaaaacctgaatggaatccttttgtgaaaagtataaatattttatcattaattcaaggctatgaatcactttctgatgatgactttaaagcctttaaaagccactatggcatacaaataaaaaacgccgagcttcaggatctaaaaaaattactagaatgcttatgtaatgaggatgataatccatgtttgtttagtggattttatgttggctataaaatacctcaaataggtaaagaatttgatttactcaaaataggaagcaacgctgtcattaatattgaattaaagagaacaagttcacctgaaaagatcagaaaccaattacaacgaaaccgttattacttaagctttatcgggaaggcagtgttcacattcagctatgtttctgacacgcagagcctttattatctcgataaaaattcaaatcttactgagacagatattaagtgtgttattgacgccttaattaaaaattcagacagcctaaacactaacatagacaatttatttaacccttctgactatctagtttcaccttttaactccactgataaatttattaacaacctttacttcctcactcatcaacaagaagaattcaaagataatatcttaaaaatcatttccacatctttaaatgcaaatttcatatctgtcacaggcgcggccggaacgggcaagactcttctggtttatgatgttgtgaaaagaattttatctgaaggtcataaagttttagttgttcattgtggaaatttgaatgcgggccatcaccgtttaaaagagctcggctggaacattataggcattaagatgcttttatctactgatttaacccattttgatacaattttggtagatgaagctcagcgtattaaggctgatcagctaattaatttaatttcctctgtcaagtctaataaaacaacctgtattttttcttatgataagcttcaaactcttgggcggggcgaagaatatagcggagttaatgaagttattgttaagagctgcgatacttgcatcttcaatttatctgaaaaaataagatccaacaaagaaatcgcaagctttattaaaatgttatttaataaaaacacctcattggatcaggttagttctggaaacatcgttatcaactattttaataaccttgatgatgcaagatcctatctttacaacttagatcatcatgaatgggaagttctacgattcactccttctcaatatgataatgaacaccacgaagattactcttacttcacacataaaaaatcacatgaaattatcgggcaagaatttgacaatgtcgcagtaactattgataaacactttaaatacaatggaaatggcaaactaatttactctggctatacatattacaatccaatcaagatgtttttccaaaacataacccgcacccgaaagcgtttaaatttaattataatttctaatgaagaaattttaaaaagatgcttatcaattataaaataaacgctccctatttataaaatttatttactctcgacttcttttctttctaggaatatggattgtaattttatcgtttctcataatgcttaaaccagccatcagaccctagccggcaggcccgaaccccgcagggattcggcggagcttaccggcacagccggttagcgcagttgggctgacgacccggcaacgccggggagccggagggggccatcaggctgttcatgcttttgacctttatggaaaggaaaccggagaagcagctgcagcatggcagcagaacagacagcagcataaagcagagagagaagacggtgagacagcgtcccggagagagaaagcgcaggcaaagggagagtatccgccgtggcggcgcagccgccgcagccgttattatccgacgttgacgtttgcggcctcagctggcggcactaatccggccccgctggcgcgaagccggtaaggcaggcgatcaggcatgaatgcggacaatcattgttgaaacgtccgtatatgcgaacgccccgcgtggcagcacttcctgatgcgtcgcaatatccttaaattctcgctgctgacgcggaccgcttgcgcagaccgccaccaggttaccgcccggcactagcattttcagcgcgtgccggatgtgcttcaaatcgtcgccgtggcgaaaaggcggattcatgataatccggtcataaaccgcctgcggggcgcagctcagaaagtccgcgcaggtcacggccacttcaggaaacgtcgtgctgagatgctcagccagttccgcgttcatctctacgcactggcatattacccccggtacggccgcaagcaccgcgcggacaatagcgccggtcccggcactcggctccagcatccggctacccggccggacatcggccagggtgacaagcttccggcacaccggatcggacgaaacaaacagctgtgtatctgcatgaacctgtacaacaggctgcaggccgctaagcttctgttgcatctgcgcaattcgcgcgctgagtttcggtacgcattttacgttctcccgcgccggcaatgccggcattttgtacatacatatcctccccggcagcgccagggagtcaaaatttttaccgcggcacttcaaccgttttcatgtcggtgatgtaaaccggtgacagggtgtagcccgtggacatcacgcggcgtaaccgataagccttgtgatcatcaccggccgctatgcccttcacctgtttaaaatcggcgtgcttattactccactgctcttttgtcatgtactcaaagccttcccccggataattcacaatcggcgggcgcttcgcggccgccttcgccgtttttgcttcctctgcgctgggcgctttgtattccgtaatgcgatcgggcgtgatggtgatgacggcaccgtttccccgtgacatgaatgaatactcaggcgtaaccagcgagctgattttcccgccgctgcggtttacgcgtatgatggtcagccactccccgcggcttttgacctgtccgcccggcaccatttccacatctgaggccagcacgccgccatgctcgtccagcatggcgcgctcataggcaatgcggttgcggtagtgcgctgtccagcggcttaggcgtgcgatggtgcgctcatggcagggtatgcagatgtcccgggcctgttcggcggtaataatgtcatcttcaagggctgaccagatgctgcggctaccttcatactggcttttctccggcgcgcgcgggtacttctctagggtaaagcaacaatgaaggtgatcgatacctgcaataacaagggccattgcccggttaaggttttcagatgaccagagtttaataaacttctgcacatcctgaagccggcgctctgccttgcgcaaatcggcctcaatcttcttaatccggcgccagcgcacgtccgggcgctctttgtaggcagcatgacgcagcgaggcctctgcgcggcgttcccagtattcagaggtttcaaacaggttgattgcgcggcgcatgccgttttcaatttttttcgcgtgcttacgggcgcggcgttcgctgtggtgtccgaccagaatcggctgcccgaagggaatggccgaagccaggctgtccacggctgccagcacctgtccggactcgacggcccgtttttcgctgtactcttcaaagcgctccgcgcgctcctcctggcggtcaaacagtgactgatcttcatcctcaatttcgcctgccagctcgatcagcaggtcttcacgatcgggcgtccacatcggcgcaacaaagagcccctgacgtggcgcatgcttaaaacccgcatccttaacacgcttatacgtttcctcatcaagacggtgcagcgggtacaggcgcagcttgttgtcatccggcgaatacgttgcacggtaatcctggccattaaaaaaagatgattctttagattctgaagccgtggtgttgacgttctgctgtgacatgttgtttctcccgtgtggtttaagtgatgtttctctgagttcctcgccgtgagggcagaacaggcgcgcgggcatcaggctgaacgcagggggaaacggcaaagccgcagcccgcagggaccgggtgcagccgtttagcgcgcgacccttgcgtgaagacgcccgggtgccaggtttctgcacggcgaaggggctcaggggaacaaaacagaatgcggaaggatgaacagggcacagccccggacggcggctttctgccggtccggtcctcagcggccacgtctttttgtggccagtcaacgcgccggcgccagccggctgcaggggttgacctggacgttgccatcagaccctagccggcaggtccggaacgcttcgcggtccggcggagcttaccggctctgccggttagcggagtgggactgacgacccggcaacgccgggaagccggagggggccatcagggtgttaattctgttatcggctgcatgtgatgggtagtgatcatgagtactgataagatattgtggtctttaagataatcaggtcgggtttgacaaacttcccgattctgcgctcaacgttaccggagggaataatgagtttttcaaccttacacgaccttttaccgcgacattttcatgccacaaatgctgtaaggcttaccagagagcgaaaaaaagccatccatgaaaagagcctggcaaaggcagctgtaccacacgtgaagcgaatgattgaagagattgagcaggccgctgcacatggttccggccgctgtgattacatacttgaaatggcgagtgacaccgatacagaaatgctggggtttgcctgcgattatctgagaatggagggttacgcagttgaaaccagcgaagacagcaccagtgctgttaagaacataaaagtggttgtaattcgctggttagactgagattgatttagaggcgttttcatatggaatttatgcactactttaaagccagccttcatgacaacgtcagtcgctacatatcgcacataatctttttcctttacgtgccgatagttacctctattcctctataaatggaaacacccaaaatgaatagtattgaaggcgttattgttaacgaccgctttctggaatccatagcgatcaatctgcatgaagaagctaaacatgcaaaagcaggtgatcgctttaaaaaaatcatccctgcgctggctttttattgctttacgcttgaatcaaaactactgacgtatggtaaggccgtttttacaaaaggaagtgaatacaagcgctacaccaatgccacgttatccggtaaatttgattggttaacaaacagattagaagttccggatattgaatcgattcgaaaatgcaaaataacaatatcagaaatggccgcattcaggaacgctgtcactcattcaaaaaatatcgatgttaagctggatcgcgaactgactggccttgaattgtttcacgacagatatgtgcgcatatatgatgacgaaaaagattttatggcgtcatccacgctggaaaaaataaatgagtttagccaagcaatctggatgcttgaacaggtctgggtggttaacgggaaaaaacattttaagggcgactgggattctctgttagtaggtatgaccaagagaaaagttattaaccgagatcagaaggcttaaccaatggcaggattattgcaaccctgtcaagttcagtttacagctttatgccttaccttttcaaaacacatctctcccatgaataagagacacacaaaatgtcacatcagtttttaaataaagaagatggttcctggatatatatcctgatgagtggaactaatatcaacagattcaaagtcggtaaaacaatacaacatcccgttaagcgtttgaaagacctccgaaccggagttccaacgctagcgctgcaagtggcttattttgtgccagcatcattaaatattaaactaggaatattagaaagtgctatccatcaggaactttcagcaggtttaggaaggatatgtttttatgatgaagctgagtctgaatggtttcatggagatgcgcgggacgcctggttacagctggatatgatatttgaagagttcgagttcatagttacagattactatcaacccggtgaaactaaaattgtacgcttctggggcgcagatatggagacagagtatccgcgcagattcgacctgtacaattcagataatgacgaaattggtttttaatctgttcggcgccggctggttctttgttaaatacaaaaaagacgatgccgcgaagcatcgtctaaacggatttgccatcaatgtatatctctggtgaagcacctggacactatcggcacgacgaccttaaacattatcaggtctgtccggttgagattttctgtctgtaatcagtgtgttctgccacgctggcgccagacccatgtcatatccagcagatcgttcacacgcacgccacgccgacgccagtgcgaataccattgccggtatgtgcgagcagtctggctggccagcgccgtttcggcctcacagatgagtttttcctgcgtctcagccagatacatcatcgcctgcggcgttcgttctgacgccacacgagcgggccgtgcgatgattacagtcaggctatgcaacgtgagcaccggcgcacctgccctgctctttgtcagtgtcctccttaccggtgctgaaatctctgcagggcatgaagctatatcgtgctgcctgcagcccccatgcagctgcgcataaaagcgtggcgccattgccggcatcatcatgactgtattcatgcgagccctccctttctgcccagtaccgccacgatttccgctggtgtgacgcctgctgacaccatctcttcaatacgtgtcagcagccggcctatggtttccggctcaaactgttcggtgttcagaacgtacagcccggtgtgatcgggatttatccagattaggccgtgccagaacggagattcgctgcccgggctcagaatgtcgagcgtgacgagcggatttttccggtgcgtcaggcgcaggtgaaccgggaacaccccgccccactctccccggcattcgcagtcggtaagccaggctttgctgagctgcagggcattcagcactgtcccgcacagtcgccggcgaaactcctcgccgcgcgtgctgtaggcctcaaaatcgcccggcgtgaaggccttaagacgttgcagtgtcacgctctcatcgcgtgtcagttcgctgccgcagcagctgcggtaacccccccgccggcgaccgtaatatgtggaagacttgctgttacagattttttctttagactgattcgctgacatatcggattcctcataatttgattgtcatgccctgcgcggagttacagctccgccagggcaaccattccggccgttcctgccgccttcctgctttgttaccttctgttttcacctctgtgacagccttgcatgagcaaagccgcgtcattcagaatgggatgtcgtcgtcaaaatctgccggcggataattaccctgctgctgtgcgtgtggttccggctgcggctgagcctcgctgcgaccgcccttgcctcctttaccaccgtaacctgacgctgctggcgcctgctgaggctgaccgctctgctgcccgctgaactgctgtccggtctgtgcgtctgtgttgcctccacgtccgcccagcatctgcatggtgccgccgacgttcaccaccacttctgtggtatagcgatcctgaccgccctggtcctgccacttgcgcgtgcgcagctggccctcgatgtagacctgcgaacctttccgcagatactcccccgctacttcggcaagctttccgaacagcaccacgcgatgccactccgtgatttctttgttctcaccggtctgcttgtcgcgccagctttccgacgtggccagcgtgatgtttgcgaccgcgccgccgttcggcatgtagcgcacctccgggtcctgtcccagattgccgaccaggatgaccttgttgacgcctcgtgaagccatgttcgttctcctcatgcagttgggttttaaccacgtcacccgttgagtttcgggagccgcggtgttgacgttttgtggaaatcggctggttttttcctccggtattcacttcacccgtttgagatccttcgccgcgagggcgtaaaccagcgcgggtgacggcaggcgtccggggcgacggggatatttatttccggtctaacgcagtggccggaaataaattttcccggcgttcacttcaccctggacgaccacggcgcctgtgcttgtctcagccccggcgaaaggacttaaaccggtgaagcccggcggaaaagcacagcacggtgcagcagcaacggcggctgagcggcagcgaaacggcgttgcgcctcagagcggcggcgatttctggccgtcgcggttcgcgccagccacgggctggctgcaggtcctttaaggtcccgctgtctgattctgttttagggtgtttgtctgcggcagaatgccgttatctgaatgcgtcagtgcaggcccgtgcgccgtaagcggcagtcagtaccggactggtgtgaggaaataatggttttcataacaagctccctgtttatgtagtcccttaagtgagcgctaatcatacacatcaggtccatgataaaaaggctgctgacaggttttcagatgagcgccagcacgtaatgcgctgtttttgcagacatcagaccctagccgtcaggcccggaacgcctgcggtccggcgaagctttccggctttgccgggtagctgagtagggctgacgcccccgcaaggggaagccgaaggtggcccttatccacatcttttctgcacatccggcgcataaagctgttgataaacttcggcaggccgcgtcagcagaagcctgaaaggaacaggctaaatattgcactaccgcttcgctgtaactctatataaatcaatggtcccgaataaccagtacgatagtgctgcatctgccatcttgcaccttgcggtaagccagttaatactactgtaaatacatacagcattttgacagggatttttgctatgtttaacgcctttgagttgatgcacccggcggacaatccgccgcccagcttcaggcctcttttcctggaacgtgtgccctgcgggtttccctcaccctgtcaggactatgcggagcaggagctcgatctcaacgaatatcttatagcccacagggcaagcacctttttcctgcgtgcgcagggtaatagcatgcaggacattggtctgtatgacggcgacctgcttattgtcgatcgctccctgacgccggagcacaacgatgtggttatcgccgagctttacggcgaattcacggtaaagcgctttttgcttacaccgaaaggacccgttctgcagcccatgaatcccgcctatcccgttattattccggacccggacacgcttgagatcttcggcgttgtggtgcacttcgtgcatacccctcgcaaaaggaactgacatgtttggcctgattgacgtaaacagcttttacgccagcgcggagaaggtattccggcccgacctgaaaaatgcgccggtggccatcctgtcgaacaatgacggctgcgttatcgcgcgcagcaaggaagccaaaaaatatgtgaagatgggcgatccgtggttcaaaataaagaatcagcatttccctgagaaaatccatatattttcaagcaattacgctttataccactcgatgagcacgcgggtaatgtcctgcatcgaggagatggtgccccggctggaggtgtattcggttgacgaagggttctgtgactgcacgggtatggaaatggctatgccatatgaggactttggccgcatgatccgggcgcacgtcaggacctgtacaggcctgacggtcggcgtcgggcttgggccaacgaagaccctggcgaagtcagcacagtgggctggtaaggaatggccacagtttggcggggtgctggcgctcacgccaggcaatccggggcggaccgaaaagctgctgtctcgtcagcccgtgggtgaactctggggcgtgggttccaggcttgaaaaacgcctgcagctgctcggcgtgacaacggcgctcgatctggcacgcgcctccccttccttcatccgcaataatttcggtgtggtactgtagcgcacggtacgcgagcttaacggcgaatcctgcatcccgatggaagatgcgcccccgcctaaacagcagatagtcgtaagccgcagcttcggcgaacgcatcacggaatatgacgcaatgcgacaatccatctgcgcgtatgcagaacgcgtggcggaaaagcttcgcgaagacaggcagttctgccaccacatctctgtgtttatccgcacctcccctttcgacaccgggcagcctggctacggcaacacggcattcgttaagcttcgcgtgggcacacaggacacgcggaacatcatcgaggcagcagtgaaatcgctggataccatctggcgcccgggctatcgctatgcaaaagccggcatcatgctgagcgagctgcgaccgaacggcgtggcgcagctcaacctgtttgatgaggagacgccgcgtgccggcagtgaagtactaatgagcctgatggattcgatgaaccgctccgggcgttttagcataggttttgcgggtaaaggtttcgaccctgactggaagatgaaacgggaaatgctgagtaaagcatggacgacgaactggaaagagctaccagttgcaaaggtatgttaaaggcacaaattaggtatttaaaatgtacatattaaatacctaatagacattgattatgtctgactaataaaactaacagtgcttagtttggcacactcagcgcctgtgcccgtcctcctggccgaactcaactgcaggccgggagttttaccacgcatccgtttcacaggtgtgagtttgcctggtaaaattcatcaagtaggcgaataaaaggccctggttttttcccgacgaaatagcggctacacggcaatttgtcaccatagttaagacgctgctggcatttatcgaacgcgtgccgttttctgcggacatgacatatgtatatatctgcgcgctgggtaatcaaaattcccgaggcgccgctctaggataacctgtacatctcgattaacagctgattaatacatcctctttatccggcgtttcgcagggccctgagcgtctctgtaagagttcagattgatgccagccacgagcttaagtgcaagcactaacacaatacatttaaagcacacaaaaagtattcaaaatgtacgttttaagtactttaaacacactcaattaataaggaatcccctcagtaagtggcttccttattaagccttatttactatcgaaagcgccatcgcgtgcaagcttctcgcgaaacgcctcaagtatataaggcgtcatcagcagggatgtaacgttacgctctttgagtgagtcgtacgcgtcccacaggtcttccgggatctgaacgtttttagccctgcgcacagcttttgctttccggcgtggaccagaggattcgttttcaaccggcttctctggttctgcaggcctgacggcctcggccgcgacaggctgttgttcagctggtgcagaactccctgcttcatgcaaaggtgcgttttttgagagctgtgaaatacgttcgaacattgctgatttaggattagccatcacatacaccattcatatttaaaaagtacatttttaatactcattgaatatcttaatcataccttttctatagcattgcgcatatctaaaaagagcgagcgcatagcgttaccaacattgctgtagcgtgttgtcatgtgctcaacaacacccataccctgaccaaactgctgcggtgcagctttatccattggaatagccgtctccatccgaaccagattgtcgaaactgggcaatgtagttatcgatgtcgctgtaattgcgtcgatttggcgggaccttattcatcaccacatgagcgatttttttctcgcccagctcagctgagatttcatccagtaccttactgaattcgtgaaggcccagaatatcggacgggtcatccttcagcggagaaataatgagatcagcaagcgctacagcagcacgcgtgatcgaggagtcaaaaccaccacagtcaaccagtacggtctgccccttctctttagcttccagaacatcggcgataaagcggtccacgacattttccatgtcgtcggtgaggcggactacattccaccgaatattctcatcgcggaagccattaaacgtcgtcacggccggagtagggtcagtgtcataaaaagtatcaggcttaagctcgggcgctatgttcagactgataagcgatttgcccgtgccgccctttttgattgccaccgctataacttttcccgcgtatggatttgatgcgttattcataccttccccatccctaaagtgtacattttcagtatctgtttagcaccttatcagtacactaactgaagcgcaagaaagaatacctccaaaataccaaaagtgtacatttttagtatttaaaacgtatgctagatatacaaaaatataacacgcatattcattagcattactctacgaaacggggcaggggaggggtacaatcgagttttacaggcgagggctatatcagcaagatacctgcgctcccttcagtttttggagtagatatatggatatgtttttctgggttttgatcgccatcgcggtggtcgcttacctgatttcgggtgcaaaacgtaaaaggaaggggggtgtatacagacccaaaacagattatcagccaccgaagcgtgaaagtcatgaacgtgcaccggaggttgtcagggagcagtctgtagcagaacgccagctggttacggtcaggggcaacgaattttataaacgcccgctgatgaataaaagtgagtacgccgttttctgcagacttgaaaagctgctttcaacttcacaccgtggctatcgtgtattttcccaggtatcacttggagagattcttggctcaaatgaccagcaggcttacctggcaattaatagcaagcgggcagacttcgtgatcatagactggtcagggcagccgaaagccgtcgttgagtatcatggcagtggccattttcaggaagatgctatcttacgcgactctgtaaagcgtgaagcatgtagcagcgcaggtatagcatttgttgaattgttagccaactatactgaggcagatatcacagccatcagtgtcaagttaagtgcgaataatgcttaataacaaatagagataagtaatacgctgatttattcaaataatgaatatgccacaattactggttgtggcattttaaaattcacagatagacacttatattgatattcaataatctttacagcaacgattatccttggctaaatatcaatggaatctgacatttctataactgattttctgaatgatttattaatcaaaaaccataatacaagtttgaaataatcatttcccgtcgatctctctacgattatactccctcattaactcaccataacacatttcggcataatctttatctcgaacaagcttagccctctcgtaatcagtgaggtcatctcgctgcatttcaacttcaatatcgctaatcgtcctaattaaattaaaatgaacaaattgtaactgtttgtcagttttttcatgatacatcaattgagtttgtaattcattcttggtatcaatgtaactaggacttctttttataacatcaaggtactcatcgggagtcagccaaccagaagatccgtgtctatttttatttaactcaccaaccaattttatatttaaatttcgccttctcgtttcgttatccaagttagtatataacaatccagagtgaccaattaagctctcatgatttttatttgtatcggctgaaactctctctatttcaaggattgcttctttggatgtggatgcgccttttagaaatctatttgcagcatgtaaaaaagacgatgagttatataaaaaaagtatactaccactacctttctctgccagctcagtctttagcgactctagtggacctctcgttcttcctccaacctcataccaccagtcaggtttctcatcgttagtgacgtagataacagaagatgttaccttactttcaacgtaattaagtatttctttccaaataaaccaatcaccaaattttcttttgtaggtaattccgttgaaggtgaaggtttcatctttttttgttttctcgtcttcaaatccaggtggtatttttttcttatatctgacttcgccttctttttcaagttggtctataacagtttggtctggctgtgaacctatcctgttatcagataattcactaattctgtcacgaactatgtcatgattttttaaaaaatcagcttctccaatacgcgtagcaatttgctctttaacgaaattatcaactgttgttctaaattcctcagtaagatcctccagtttttctttcaaactttcatagcgacgaattgttgatgcgtgctttttatcaatggattgtaatgttaaagcctcttgagctttgacagtgagatgttctccggcattttctagctccagcacatgttctttaattgctgtaagacgatttctttgatattcaaggcacacatgataaggaagccagactctttctttaattttttcccactggctgaaaaaagcatctcgagtttctttttcacacctataaagaagcagaagagcattggtatcgaaaataaaaacagcgttaatatcattccataaaactttagcgctatcatcgtcaacactatagaagccaccaaataaatttttcattttcgtcttaagtcaagtttttcacccatcttactctcaatttaaagacattgataaatttaaattgaagaattttttagcggctttaaatcattactgctcaatcttaaccacctaatattaaatgtcagtactatttaagaatgtaattatgctcatgttatatatatcaataaaaataataaccaaagaaaatcaatgtcgccataattcaaatctgtcggtgtcctaatatggttggtttcggacgcatattgcagagactgtacgaaagtaagtgtttttttgtttagtacatgcgttacaattagtacaccctttaagtacatgttgtaacaccatgtcacgagtttttgcctactgcagggtttcaacactggaacagaatacagaaaaccagcgtcgcgaaatcgaggctgccggttttgctatccaaccacggcggctgattgaggaatacgtcagcggttcggttgcagctgcagaacgtcccgggtttatgcgactcctggacgggatggaaaatggtgacgtcctgattgtcacaaagctcgatcgtctaggccgtaatgcaatggatatcaggcaaacagttgagctacttgcagcatcggaaatatgcgttcattgcctcgtacttggcggtgtggacctgaccagcccggcaggcaaaatgacgatgcaggtgatctcagctgtcgcagagtttgaacgtgatttgctgattgagcgcactcatgccggtattgccaaggcaaaagcctccggcaaacgttttggccgtcctcctgcgcttaatgaggaacaaaagcaggctgtgctcttacgaattgatgaaggagcaagcatcagtgcaattgctcgtgagtttgagacgacccgtcagaccatactcagggttaaagcagcgcgcccagacgaagaagggtcgtaaaacaggattcaaaacagaaatggcaggcaaccagactctggtaacacatttagccgcgccattattcagagaggacgcgacgatggcagaaattaaaacatatcctgtctgctttactggtcaggtaaaaaccgtggagtgtgatgctgcatttcagaaggatcatgcggacacgttcaaacactacatccgttttgcccgacaaaataaggcaaccacccttattacttgtcagtgcatgaagaaagatgaaggtgaaaaccgccgccgtctgaaagcctgctattcatcatcgcacgacaactactggctggcccgctggtcttacagtggttcagagcacgcacctgactgtcgtttttattcggtatgggcagacgaaaagcagggggagatttacacttctgacgtagttaaggcactctctccgggctatttccgtatcaagctacctaccgggttacagaaaaaagtgcatacggagcgcgatgcctttgagccatcagcccctaaaagcggaggaaaacgcaggcgtcagccagccatgcgcctcctcggcctccttcatttcatgtgggaacaggcagaaatcaatcactggcaccctaattttgacaaacgtacccgcgacgatgcctgggccgcatggcgcctgaagcaaatggcagaaaaaatcagcgtgggtaaaacgtctctgaaatcggtcctgctcataatggcgcgacccggcactcaggagattaaaaataactgggcaatgattgatgcggccgctacatcgaacaagcggttaatcatgatcacttatctcaaaccctgcacaaatggggaaggaggcagcctgaacggcacactgccgctcactctggccgcaggctttccgtctcttgatgtacctgcagatcttattaaccgactcaaccgaagctttgcccgcgagctaggtgactggcgccgggggcaaaaagttatgctaatagctgaaaccgaaccaccggtaaaaaaattcaggcagcgtgacggcaaacctgttccgtataacacctgtaccgtcattgatgcggcactgatgacagtcagtcccagatttattcctctcgattcatcactggaaggggtcattgaggagaaactctggcaggaaaagcgtcagttcattaaacctctgcgctatgacggcgaggcggatgtgtttcctgattttctgctaaaagacgtgcccggtagggagatcgtgccgcttgaggtgtttggcatgaacacgccagactatcttgagcgtaaagccgtaaaacttgcacattatcgtgaagagttcggggagggtaactggtggagctgggacgcgtataaagcagacgccctggctaacattccagcttttccggttaaaggttaataaaactacttatccgcttctggctttgcgtacacaggatcattcccgcgaggaaactggagagcagcattcctataaaatgccagacgttcgcgaaagttttctcgccacttctctggctgctgaagttcaacctctgcagccaatactggtttgttcatccgctctttatatgcaacgccggaagctgccagatcaatgttaactcgttcacgctcatcggctgaacgttttgctatgttgtgctcactgcgttctgtcatctgtaagccactgttttcgtgttgatctttcagcacacattttattttactcttagagtttcgctcaggcaggtggtgtaacgtagcgaaggcatctcgcgtttcattttccatacgctgtctgttccctgtccagcgaaccacaccttacccaggcccgaacggtttatctgatccacagccgacatcagagcatccgcgtttgcgcgcggcagctgctgactgaacatgtccagctgcgcaacacctgactgataaaaatcccccaacgtaacacccgctttcgcataccggtaaccgtcgcgccatattgcgtcgagagctcgcaatgccggactgataatgtcccgtgtgtcgctggttggatattcgcatgtcatagcggcagagttggcatactgtggttcgtttccgtatcgtcctgtattgactgacacattgagccctgtttctctgagcttttcactggcacgcgtggatacgttactacagcctgctgcaggtcttcgatactggtgacacgttgtccgaaactgcggctcacaacaatctgctgctttggcggcggggcactttccagagctaaacaggattcaccgttaagttcgcgaaccgtacgctcaactatcacatcaaagattttccggatcatgctgatgttactatcggccagctggagcgctgtactaatacccatcgtatgcagtcgcttactcagtctgccaccaattccccagatgtcatcgacgcttaccagtgcgagtaattttctctggcgctccgggctggttaagttgacgataccgcctgtttgcgtccattttttagcagcaaaattagcaagcttcgccagtgtctttgagggtccaaaaccaacgccgatcgtcagtcctatttctttcttcactcgattccgcatctgcaagccaaagtcttccagaggcatatacgacgaaatgccgctgacatccagaaagctttcatctatcgagtaaatttccaggcctggtgccatttcaaccaggatagccatcattctggcagccatgtcgccatttatgtggaatggaaaagggtaatcgtgattcattgactgcaggcagggacatgaagctgatgtgtatacacgctttatgcatgcatcagctgtgaaaaacgggagatagcatgctcttgtgcctgaaccaaaaagtgattgcgactatgaattacccaagccagcaaatgatatggccaggtcagccaggcacagacatacggagccggtggattcactggggttgcggctgaccagtcaggtgattatggagtgaaaagcccatgaattgcccctctattcatgacatgacagtttctcttgtcaggataatattcagtaatgattatccagatatttacctgtcagaagtgcagtctggacaaatcactttagtcagctttcatacattgtgcattcatccgtacaggcaccagtcagccggtgatacgtatggagttagtggactttcattaaataacattatcgtatacacagccggagtctagatatgtctttttcacaagcggtcagcggccttaatgctgcgtcaagtaacctggatgttataggtaacaacattgcaaactccgccaccgcgggctttaaagccagcacggctgcctttgcggatgtttttgccgggtctggcgtgggcctcggcactaaagtggctgccgtcattcagaactttacagacggtaataccaccacaaccagtcgcgggctggatgtggcgataagcaatgatggctttttccgcctgcaggacaatgcgggtaatacttattacagccgcaatggtcagtttacgctgacgtcggaccggaaaatcgtcaataccagcggaatggctctgacaggatacccggtcgctggtacaccgccagtcgttcagacaggtgccaaccccgtagaaactcaccgttccctcgacggcaatgtcagcgaacccaacgtccactggcgcacttcaagctaaccttaattcatcctataacgttcctacagtaactccctttgatacagcaaatgtagacagctacagcgataagacatccatgagcgtttacgattcactcgggaatacacatcagcttgatttatattttgttaaaactggtgataatgcatggacactgcatccggtagacagcacaaccggcactgccagtccggcgacaaatctgactttcacatcaagtggtatactcaatggtacgggcaatgtaaccgtggacatcggtgcactgaacggttcagcagctaaccagacgatgcagttgagtctgctgggatcaaagcagcagaatacaggtgccaaaagtacatttggtaatccttcacaagacggttatgcgccgggtgagcttacctcatatgtaattaacaatgatgggacaatatcaggcagctattcaaaccagaaaacccagcttctgggtcagatagctctggctaacttctcaaacgctgaggggcttaagtcagaaggaaataacgtctggtctgcaacagcagcatcaggtcaggctctggtcggtcttgccggcacaggaaatctgggcacgctgacttcaggtgcacttgaggcgtcgaacgtggatcaaagtaaagagctggtcaatatgatcgttgctcagcgtaactatcaggctaacgctcagaccattaagacgcaggatcagatcctcaacaccctggtcaacctgcgttaatcttatacatatgtcttccctcaggattaggaacgggggaagatagttctgccagattctggaaggaaacttatgacagtcatactgtttcactgcacttttactgacaggaacatgtccggtcacgtccacagctatactccggacaaagcagagtatgtttatggcgcatgcctgctgcagtcaggtcacggcgaaacccgtgttacgagcggaattattgttcagaccagtgtgcatgacagcgataccggttttattgatgaactggtgcagtccttaatgcgatgcccgcatctggccccgctgactgctgagccctttaccctgcagccattccggctgccagtttctgaatactcagctcccgctggaagaaatgaattactatgagctcatgtttgagaaatatctgtcactcgctcagcaggggagcttcgccaactgaaaacaggaacgcaatgccgcgttcagtgtgattctgctgtttcccagtttaccgttatctgcgtcgttccggttcccgtcatgctgataacaggcttatcgctggtcaggccataataaagctgaaagggctgacctgcatcctggcctctgaagaaaagggttgaacctgtctggtgacctgaaacatccgtacagttatcggtagccccgtggcacagttttactgacagcgagcctcggccgcgcaggtctcgcgggcccagagcatattcataataaacgacggacactctcgcacccgcttccggaatcgctgttaccggaaactgatattcgtaccactggtttgctgttcccagtctcatggtttcagaaggcttgctggtataagctcctccttcagcggccagagtctgtgctgacgtaatcagaacagcaaaaaaaataatgacactgctcctggtattgaccatggaacgctcctgcaggtttgcgaaaaataagaccggccgggccagttaatctgtttactgcaactgcgggataagaatctctcccggaagaagtccctcaacgacaattcctgtcggaacggtttctttaagcgtcacaaaaacccggcgaggctttgtatccgtattttcacgataaatcacatagctgtttccgctgccatcttccttaatactctgcgcgggcagaaccataccatgggcatctgaatatgtgaggatctgcacatctgcgctcatgccaagccgtacgttgctcagggtttctgtcgggaatttcagggatgcggttacgtcgtatgttactgtgcctgatgcttcatcttttgcagaaggttgtgatgctatccgtatgacttttcctgacagtttttcgcctggcagtccatcactcgtcacctttacattcataccttctttgagaaagcggacgtcgctttcctgaacgcgcgctctgacaagaaaacggtcaagtcgtgtcagattgaaaacaggcgcaccctgtatgacctgctgtccgggtatcgcattagtacttttcgcaccgccaggcagagtggctggcagcagaagtccatcaaaaggtgcgcgaacctccttcctggcgacctgactaaccagtgagttgtactgcgtttttgcattgagtaacaccatttgtgcaatgcgcatattgtttccctcagcatcagacagggactgcgcaagcgcatctcttgagttctgtagttcatcagactgtgttctggcctgcatacgaagagcatccagttcgctgcgcgcgacaatacctctttcgtagagcgcttttgtttcatgcagatttgcttgcgtatccccaagctcagctgcggcgatattaatctgccggcgcagacgggtgatttcaggagaactcatccagtgctcaagcctgttaacttcgctttgcgcttttaactgatctgaaagtgccgtcctgatacgaacctctaactgtgcaggatttattgaaaatataagagtgccggatttaacgcggctgcctggtgccggtccgaccttactgatgaccccatcaaatggtgcactcagggttacgtcttcttcggcctcaatgtgacctgccagccccataaatttactgaccggggcataatcaaccggtagccacgtttccagggaagctgtttctccaggcgtatccctgtcatgaaaaccgatgataaggaatgctccggccagaagaaaaacagccagaagcaggccccccagtaccgtcttattcctgcgcggcatcgtttgccttatcatttagcataatgccccagctctgaagcgttgttcccataatttcatcaagttcagtcagtgcattctgatagctgatggccgcagccagccgtgcactttcagcgtttctcaaatcagcatcaaatgagacaacctgaaagttagtcgagcgtccggctgccagcttctgccgttcgatatccactttctgttgagtaagttcagctgccctctgtgatataacaaactgcttccaacgggtggtaatatcattcgtggtgataagtatatctctgcggagcttttgctccatgtcaccagcttcaagacggccagccttcctggagacctctgcgctgagcgcagcctgccgtgaggataaatcccccacaggaatatcgacctgtataccaacataattattccggctacggtcagaacctgagcctgcacctctcgattgcctgtcactcgagccagcaataagcgaaacatcccacagctggccgttacgggccagtaatacgttgatgtcatcttttttattttcaagaagccgactcaggaacgctggctgaacattcctggctatccggatagccttatcagaattgatgtcagtgtatacaggagtacttacgggctcggtaaccagcggggtactgaggtcaattgccagaagctgcagaagctgcagtctcgcactttcaacggcattctgtgcctgctcaagcgaaagctgctgcccggcgacttctgcttcagtctgtacaatatcaaggcgcgccatacggccagccttaatgagggcgctgtttaccataacaagatcctgagcccgttgcagcgaagactgtaatattacagcttcctgagcggctttttgcagcgcacgataggcttctgctatttcagttactgtatgggaaacggtatttttcagttcaagcaggtgctgggcttcactcagtctggccagctctctgtttgccgttgtaacctcctttccggcattacggagcagtggctgtataatagtgaaatccgccccatcattgctgtaggtttcgctgctgtcattatgcactgagttatgtgcccaccccagactcagacgcgtgccatacggcgtcagtagcgtagttacaggtgacagggtattttgtgagtaaagattttcctgatttttcccacgcaaatagtttcccgatataacgagcctaggggtaaagctgtcctcagcaacgcgtaagtcaaacctttgtgagatacggtgcagataggcacttctgatagcagggttatttctcagccccagcgatattgcttcacttagtgacagcatgacctgtttatcgtctgcgtgaattaggtctccatgcatcgcatctgtatgcagtagtttcgccagctgaaacgatcaaaggatacgtgataaagctgaaggccagataagccagtagcgctttacgcatcattcattgcccggacaggctcggtttgtgctgcccttatagcaggataaaaaccaaatagaagcccggagagcacggagcttccagctcccagcaacaatgaagacgcagtaatttccagagtggaccagcctgcaaattcaaaaaatatcagagctccggccactccggtgacacagccagctatagcgcctacggcactgaggaggacagattccagaagaaactgtaaggcaatgtcttttgtacgtgcacctatagccagtcttatgcctatctcttttcttcgttcaatgatgttcataagcatcacattcataatgccgactcctcctgtaagaagaccaatgcatcccatacagatgagtaaccagccaaataatctggactgctgatccatgccgtcgatgagtgtctccggaagttgtacgttaatatcaatttcaggccggaatgagtgcagtatgtgctgcagctggtcagccattttctgcgaagaagcctgccggtattttactatcagcaatgtcagatagggcgagggcattatccgtttcattcccacatcggtaagaaacacagcattatcaggatcgaatggaaaaagaggattattcccgcgatgggccagaatgccaataatggtatagatatactcccccagttttaactggtcgccgatatgacgtccacgagccagctcactgccaataacgacgtacgtactgctggcatctgttcgcgttagaaagcggccatgttgcagttttagccccatgat

SEQ ID NO: 23 - DNA, 82305 bp, Pantoea agglomerans NY130
acgttaactcgttttatgcgagctgcgagtccctgttccgccctgacctgcgcggtaaaccggtggtggtgctcagcaataacgacggctgcgtcatcgcccgttcagcgggcgccaaagcgctgggcatcaaaatgggcgctccgtggtttcagattaaaaatgaagtttatcctgagaagattcatgtgtttagctcaaactacgggctttatcacattatgtggaatgcaatttaaacaaaaaaataagttaccattcctctgaagtttattttctgaacaggaattattcagccttgaaccacttcggtatgcttactggcagggaggaaagttgacgggtggtaagacatagccggaaaatcgatttccccgccgggatttaatctgccatgcttattctgaagccctcaatcgggcaatgcgcttttatctttcactttatgcaggaagaaataatgataaaaaattacagaatcccgggactgaccgcggtggcatttctcctcataagtaccatcgcaggtgctgcagaagcgcgctggacgtttgacggcgatatccacaacaattcccttgctgtcagtcccgatgaaaaaacggcggtggcgtcctacagtgagcgctcagacgtggtggtctatgatctggctgccgggaaagtcagaaaggtgatgaagggctacgtcaccccccgtaatgcacttttctctccggacggtaaggccatatttctttctgacagcagtctcggcgtagtcaaaaaaatcagcaccgggacgcttgacgtggcggccacgctgccgctggggcccggggcattcggcacggccataagtcgtgacggtcagcgactgtatgtgaataacgaggccgccagcacgctctcggtgtatgaccttacacatgaccggcccattgcagttgtgacgggttttgcccagccccgtcagggcattaaaatcagcccggacggcaaaaccgtctacgtcaccaactttaagggcgataaaattaccctggttgatgccgtgacgggcgacattcgcggcgagataaccggcttcagcaagctgtgcgccatttctgtcagcgcagacggccgcacactgtacgcggctaacagcggcagcaacacaatcgccgtggttgacacgcaaaagcacgtcattacggcaaccattcccgtgggtcaggacccttacggtgccgcgctgacgccggataaccgctatgtttacagcggcaaccttggcgacaacagcctctccgttattgataccgccgccggtaaggtggtgtccaccgtcaccggactggatgcgccccgtcaggcgattgtcttcaacaaggacggtacccgcgcgtgggtgctgaataaagacctcagcattgcggtggttgacctgaaaaagaaccgtgtcatggccacgattaaaagcccgccgcagacctgacgcgaaacctcccttactccagcgcagtgacgatccttcgcaaagtggggtggttaatcacttttatagatttattttagctaaataacctgttttaaagatttactctgacatgcctataatctttctgtctactcaggagattccggcatgaacgataaaatattcaccctgcataacggtgcgcgtccgctgagcgcgctgagcagcccgaaagaggccatacgacagttcacgcctaactggttcgccgcgaccatggggaccggcatcctgtcgctgtctctggcgcagttcccctggcaggttccgggattgcgccttgtcgccgaggggctctggatgtttaacatcctcctgttcagcgtctttgccgtgatgtatctggcccgctgggtgatgtacttcggagaggcaaagcgcattttcggccattcaaccgtgtccatgttcttcggcaccatcccgatgggcatggcgaccatcatcaatggcctgctggcgttcggtcttccgcgctggggcgcagacgttattcaggtggcacacgccctgtggtggctggacgtggcgatgtcgctgctgtgcggcgtgtgcattccctacatgatgtttacccggcagcagcacagtattgaccagatgactgccgtctggttactgccggtcgtggcagccgaggtcgcggcggtcagcggcggcctgctggcgccgcacattgctgccccacacgcgcagctcggcatcattattaccagctacgtgctgtgggcgtactccgtgccggtggcgctgagcatcctcgccattctgctgctgcgtatggcgctgcacaagctaccgcacgaaagcatggcggcctcaagctggctggcgctgggtccgattggcaccggctcgctcggcatgctggtcatcggcggagatgcgcccggggtgtttgccgcggcgggcatgccggaaatcggtcacatcgcgcagggcgtggggttcgttgccggcattctcttctggggctgcggcctgtggtggatgctgctggccacgctgataaccgtgcgatacttccgtgaaggcatcccgttcaaccttggatggtggggctttaccttcccgctgggcgtgtacaccgtggccacgctcaagctgtctaccctgattgacctcgcattctttaaaggcttcggtgcgcttcttgtcgtcatactggcggccatgtggctgcttgtcgcggtgaaaacagtgcgtggggcatggagcggtaaactgtttgtttctccctgtctggcaggcctggatcggaagccgtgagtgaaaccagcacatcgatgcaggactcgtttttacgcgaggaatgcctcgcggcagtcaccgcgccgcatgtggccgcgctgaatcgctgggtcagcggccagcgtcaggccggtgcagaactgccgtggtttgatccggctgacggcggggttagggccggactgctcgtcctgctgcagtcgccggcgcgcagcagcccgtcaccgcggtttgtgtcgcgtgataacccggggccggcccagcagaaccttgggcggtttctggcggaagccggtatttcgcgtcaggacagcgtgctgtggaatacggtgccctgggtcagtcacgggctgcagaaacggccgtcagcggcggacatccgcagaggctgcgccttgcttgaggacgtgctggcgtatctgcccgcgctgcgcgtggtggtgctggccggtgccgtagcggctcaggcccgcgggacggtcaatcatctgtaccccggcgtccccgtgttgacgatgccgcaccccagtccgctttcgctctgcacgagtccggcggtgacggaaaacattcgccgggtactctgcgaggcacgggctgcgctggcaggctgagggcgccagcagaataatactgacaggttttgcaaccggctctatactcatatgacaaggtgatggcgttccacctttcccaacccctccgttccggagctgatgacgcctgatgcgactcttgattttcaggaggtgcgtcaggccgtccttactttcttcccggcctgcgtacttccctcttcggggagagacctgtgatacacgtttttggccacatcaatcctgacagcgacgccatctgcacggccttcgtcaccgcgcactggctgaccgggcgcggcatggacgcccgcgcatggcgtcttggcgaagctaaccgcgaaacccattttatctttgacaccgccggactcacgctgccgccacggcttgatattccgctacaggatgaacgggtctggctggtcgatttcaccgagccggcgcagggacctgacgacctgctccggagcaacatcgtggggatcactgaccaccaccggctgggcggactgataacgcaactgccgccggaggtacacatacgcccgcttggcagcagcgccacgctgctgtggctgcttatgaacgctgaagcgcgacgcacgctgcccccgacgcttgccattcttctgctgggtgcactcctgagcgacaccgtgaatcttcgctcgcccaccacgaccgaagacgatatccgttcggctaccgagctgggcgtactgtccggcgtaaaccgcagagccttcgcccgtgacctccttacggcaaaaactgacgtcagcggcctcagcgcacagctgctgctggacagggacctcaaggccttcgtcattgccggcactgacgtgcgcatcgcccagattgaggtcagctccccgtcacaggttgccaccgtgatggacgacctgctcgctgccctggcgtatctggcagaccagtcgggtgctggtttggcggtgctgatgctgaccgacatccgggccgggttttcaacgctttatttcgccgggcgggagagcgttaacgcggcctcctgctccgtaccgggtatgctcagccgcaaaaaacagcttctgccgtggcttgagtcccgcctcaaccagaacgggagttcattatgacctgctacacccatgcattgatacttgtgaacgataaagacgacggcaccctcctgctgaagcgggcggtcgcgctggcgcagccgctcggcatgaaaatcaccctggcccacatcagcgacgactaccgggaaatgaactacgtgtccgacagcctgatggacgacgtcgtgtcggaagaggtgctgaaatccaaagcgtttatgagcgagctggcggcctccgtgcctgagacggtagacatgcgggagctggtgaccatgcgccgctttgaggacgtggagaagtgcatcgctgagctgggcgtggacctcgtgcttgccgggcaccgaaaccgctttatgggaatgctgacgtcccgctcggcggaatacattaaccacctcacggtggatgtgcttatcactcacctgaatgactgaaccgggagaaactctatgcgctttacactggataacgtgaccgcccgtgaaattcttgactctcgcggcaaccccaccgttgaagtcgaagcccggaccgtggacggaatgatggcgcgggcctcggtgccttccggggccagcaccggctcgcgcgaggccgctgagcgccgcgacggcgacgtacaccgttttggcggtaaaggcgtactggatgctgtcaggacggttaatacggaaatctgcgaagccttgcgcggcagggacgtgcgcgagcagcgtcagctggataacatcatgctggcgctggacggtacgcagagcaagagtcggctgggtgccaatgccattctgggcgtgtcgctggcggttgcccggctggcggcacaggcctcgcacgagccgctctggcgctacctggggggcctgcaggcgaacctgctgcccgtaccgtgcatgaacattatcaacggcggcgtgcacgcccgcggtcagggcgcggactttcaggagttcatgatagcgccacacggggcacccacgctgcgcgaggccgtgcgtcagggcagcgaggtctaccaggcgctgcgccagatcctgctggacaagaacctgtccgcggcagtcggcgacgaaggcggttttgcgcccgccgtatcgtcgaaccgcgacccgctggcgtttatcgtgcaggccattgagaaggcggggtacaggcccggagaagacatcagcatctgcatggaccctgcctcaagtgagtttttcgcagacggaaaatatcatctgcgcacggagggcagtgcgctgagcgcggcggaaatgacggcgtactacggcgagctgatggaccagtttcccgtcattctgctggaagacggcctggcagaagatgactggtcgggctggaagcatctgcaccagcagcttgcgggcagggccgagctggttggtgacgacctgtttgtcaccaacgtgaagtacatccagcgcggcattgacgaaaacctcgccagcgccgcattgattaaactcaatcagataggctcgcttagcgaaacgctggacgccgtggcgctctgccagcggcacgggtggggcgcgttcatgtcccaccgcagtggggaaacgacggacacatttcttgccgacctcacggtagccctgcgcgcgggacacctgaaaaccggtgcgccgtgccgcggcgaacgcgtggaaaagtacaaccagctgatgcgcattgagcaggcgctgggtgaggacgctcactatgcggggcttcatgcgtttgtgcgccgcacgtaacagatccaccggacggccagcggccggcacaggagcacagtctttggcaccttcaacgctgattctcctgcgccatggcgaaagccagtggaaccgggaaaaccgttttaccggatggacagacgtgccgctgacggaccgggggcggcaggaggctgaccgggccggtgacgtgctgcgggacgcgggcctgctgcccgatcgggtcttcacctcggtgatgacgcgctgtgttcacacggtctggcgggtgctggaccgtcttggccgcagctggacgcccgtggacaaacactggcggctgaacgagcggcactacggtgcgctgcaggggctgaacaaggaagcggctgcccggatgatgggtgcagagaccgtccggctctggcgcaaaagcttcagcggcattccccccgcggacgcaggggctccggcgcagctgcgtcgggacccgcgctacagccgcgttgcgctggccgacctgcctgcgacggaaagcctggaaatgacgctgcgtcgcgtcatgccctactggcagcacgccgtgatgccgcagatactctgcggaagtaccgttctggtcgtggcgcacggcaacacgctgcgcgccctggccgccttcctggacggcatgccacacgacagcttggcacagttgcatatcccgaccggcgtgccggccgtataccagatggatgcggccgcacaggtcgtttcccgttatgttctgaatataaaaaaataaaaggagtgaacgtgaatcagctttttgctgtcatcaccggcggtgctttagggtgtgttatccgctggcagctgggcgcgcgcctgaacgcgctttttccggacctgccgccggggacgctgctggtcaacctgctgggagggtttatcatcggagcggcgctggcgtattttctgcgccatcccggcctcgatccggcctggcggctgctcattaccaccgggctgtgtggcggaatgacgaccttctccacgttctcggctgaggtttttgccctgctgcagtccggcagctatgcctgggcagccgcctcggtgctgatacacgtgctgggttcgctggccatgacggcggccggattttatatcatgacgctgtgtggttaacccgagggagaccttagtgcagtgaccgctgcactgaggtatattgttcagaagcgctctctgcaggccagacctgacagggtttacgcttgtaatgcttcccgtacacctgaggcgctgctgtgaaagaatttcaggcctgcctgttctggtaaaggtcccagcgattgccgtagatgtcctcaaatacgacaaccattccgtattcttcctcccgtggctcctgaaagaagtggacgccttttgccttcatagcattgtagtcgcgccagaagtcgtcggtctgcaggaacagaaaaacccgtccgccgcactgattgccgataaagccttcctgccggtcgttcgacgcgcgggcaagaagaatagcacagtcgctgtcaggggccggcgtcaccacgacccagcgcttacccggctgcggcgtgtcttcaatgagggtaaagcccagcttatcggtgtagtactcaattgcacgatcgtagtcatcgaccacgaccgccacgtatcccatacatcgcttctgttttctcatctgctgctccatcagttacggcattacgcccgttataatcagctttatatcaaatacggcgttcagttatctgtactgattctgcactgataccctcagacctgacattgtaagcatctgagcagtcaggattgtgggcccaatcttgtaagagcctgctcaaccttttcagcatcctgctccagtatggctctctcatcgggagtgagcgggacctcttcgaggtaacgccggatggatgctttactctccagtatcagcccgcgcgcgctatccttcagcaggttaaaatcgcagccgatgcaggccatccggtgcgggcaactgctccagaaggggttcgtacagtatgagtcgcccagatcgtagtaggtcgcgggcccggacaggctggcggcttcaggatcgtggtcaaccagcacgcttatcatatgagcgaccctgtcggctttgacgaacgaggcagccagctgagtcgggcggatgcgaagatagtgcattgtagactggggcgttgaatggcccgtccactgcatcagttcgtacagcgacatgccctgcggtacgctcgccagcgcggtcacggctgaggcccgcccccggtggctggttatcattccgccactgtcttcacaaggcacgcccgctcttgcgcatagcatcggtatcacggtgcggttgaggatagcgctgccggcaggcttaccccggtactgaaacagaagccggactttctcaccggttcgctcgtcagcgagcaaagcctgttctgccggacgctcatccagccatatgtcgacgtattttttcaccacggccgccaccggtttaacaaaggcttttgaggtttttccggcagggatatgcaggtaacacagggttcctgccgggatgatacttccgtcgtccttcacgatatcgtccgcctgcggcgcgatgcacccggttgtcaggcggagcagttcgttctttcttacccccgcatgggtccagatgacggccattgcctgcagcatggccagtggataatgtatttcagtgagcagatcttcctgacgcagattgaggctggcccagatgagcttcagccagaccggatcgtcaataacacggggattgacgccgcgacggaacagcggcgtatccggtgtggaaagatggcgggcagggctgaagtgcaggcgcccccagccccagttttcgtaatcaatcataaaacggcgcagagaatagataaaatgcgccctggaatgcggcatcatgggctcgccggagcgcaccgatttgcgggtgcccctttccgtgcccagctgaagctcatccacgttcatccggcctaccgccgcaatgaagctggcgcaggtttccattgtccagtctgccggttcccgaacctccggatgctcctttttcagccagaggccgcagcgcagaataaagctgtactggctttcacgggtgcgcggcctgagcaccgacgtttcccgccagcgccggcaccagtgcacccaggccggatcgacgccttcgaccggcttttcgtaccattttttatagtttcgcatcctcaccggggcgctgataatccccagtgcggcaagtgcatgtgaaacgcggccgacgtaacgggatattcccttgtctgtcccgctctgggcgcgccagaggagttcaggcgtaaacgtttcaagccggggatccctgttcatgatcatcagtgttgccagtatacccgagacatgatttttctggctggtcggggcataacccagcgacgtcagcgtatcagtcagccggtccagctcctggtgataaaaagcctggccgaagatggcagaagcatagagcgcgggtttacgtatatcaggcaggctgagcgggtcatgcaaatcagccagatgccaggcaaaagcggccattaacggacggccctccctgacttcccggcacagcgtcagccagcgtttcctgcggccagcaccagcagggcatgccgtctgcatgcatttcgcgcagcaatccggctatcaccagccccgtgattttgctgccgcatccgcttccggcggcaatgtccatcagcggcctgatgaggtccggcaccggcttcgttcgcagcatacgggaccggctgtgagcgctgctcagtgccgtccgttcagcgagggtcagtgacgcctcaagccggtattcagtcatgtcgaacggatgccggctgttttcaatcggtgtgtgtgggctcatgttatttctctgttctgaaaatgaggttcgccatcctgatatctgccgtttcaatcgcgccagccatccgggcagccaggtccctgccagaaagatgaatataaatctgtgttgtggtcaggtcgcggtgtcctgcataggtggcaagttcgtgcaacttccagcccgcgcgggcaaggtgtgtgagtcgcaggtgccggaaggtatgggttgagatgtccggcatcccagactcaagcgcccatttccgtaccgttttgctccaggtccagaatgaaagcggcccgccctgattacgatcggactcagaacggaacagggcacctcttacgattccggtccgcttcatctgcataaggtgcgcggccagcactggcactactgccgggctgtaacagacaattcgttcacgccggctcttggtggtttctgcccggatgcggatgagccggtgagcaaagtcgaagtcgtcaatacttagcgaggtaatttcagaccgacgcagcgcgccgtaataggttaatgccagcatcaggcggtcacgcagtggggaagcggcggcatgataaagaaaacactgccactgcgcatcgtcaggaatgcgcggcagctttacaacgcggggaaccagtccccggccggaactcagcatgccgggcgtgccggatcggggcagcggattgaccgtgcaaagatccaggtacatgagaaagtcataccagaggcggatcgccgacaggcgaagctggagcgtggcgctggccgcggaaaaaggcatcccgggtaactgaggactaatataggcagccaggtcttcaaaccgcgccttttcaggtttaattccgttctggctgcagaacgcaaagtaatgacggagggcattgcggtaggctgttagcgtggcctgcgcccgccccagatcggataacagttgcagccagcgctctgccagcaacagaacgtgttcactcggtggaatcagcattgcattctcctctgacaacagctttgctgttcaaagtttactcaatcaatgttgcattccacgtaacttactgtctcagccagcgggtgatgacggctcttgaggaggtaacgccccgggtcgagcagtactcgattgacgagatgttcctggatctgaccggcattgacgggtgtgaggattttgagcacttcggccggcgcctgcgggcgcacgtgctggccataaccggcctgactgtcggcgtcggcatggggccgaccaagacgctggcaaagagtgcccagtgggcgagcaaagagtggaagcagttccgtggggtactggccctgacgcccggtaacccgaagcgtacggccaccctgcttcagaatcagccggtggaggaagtctggggcgtgggcaggcgcatcgcaaaaagactgaacctgatgggtattgaaaatgccctgcagctgtcgcgcgcgcatcccgcgctcatccgcaaaaacttcagcgtggtgctggagcggaccgtgcgtgagctcaacggggagtcctgtattccgctggaggaactcccgccggctaaacagcagatttgctgttcgcggtcctttggcgagcgcatcacctcaaaagtggccatgcagcaggccctgtgccagtacgcaacccgcaccgcagaaaagctcaggggagagcggcagttctgccggcgcatcagcgtgtttatccggacgtcgccgcatgcagaaaacgaggtgttttacggcaacagcgccggcgagaagctcagcctgccgacccaggacacccgtgatatcatcggggcggccatgcgatcgctcgatcgtatttggctggacggccgcaggtacatgaaggccggcgtgatgctcgacgactttacgccgcatggtgtcagtcagctgaacctctttgacgatgcgcagccgcgggccaacagcgcgcagctgatgaaggtgctggacggcattaatcagtccgggctgggcagcgtgtggtttgccggtcagggcgtgaatacggaatggaaaatgaggcgggacatgctgtcaccggcgtggaccacgcgctggagtgacatcccggtggcgcgcgtgatgtaacctgtagcggcagggcacagcagacataacgtaagtctgctgccctgcattgtcatgaaaagtgcggccagaactcatccatgatgatcaggggcttgcccgggcgctttccgcggaagtatcgtccgcgcggaaccctgtccttacgcgaaagctgatgaagccagtcatcaaaggccggacggcgcctgcggacggggcccttgaacataccggctgactgggtaaacgttttgaatacaatccccggtgctcgcatctgcgtcagcatttcctgaatttccatcaacacctctgtgttaatcgttcattaatcggggctttttttcttccagccgccgttagccagaacggctgcacgcgaaacacaggccccccacagcagctgcatgccgattttgaccagctcgctggcatcgtgcaggaaaaaaagcggcacgataaacagcgtactgagaagaaaaccccactctgcagctttcttcctggatttctctgctaactttgaaaaccctaagaatccagttatatatctaaaaaaagacatacaccctcgcatatcaatagtgcgcacaatgaatacatctaagagccattacgcatactcattagatatacataaacaccacataaggtacttgttgtgaggccgcttattgctgatctaaagcaccatcgctctctaactttgcacgtattgcttcaagtatgtacgagctaaaatcaagggaagttttgtttgctgcttttagtgaagcatgtgcctcaaaataggtttcaggcaccgctcgtaaattcttgcttcgggacttatttttgtgtgacgttttgatttctgatgaagcttcttggacagggacagcatcaggaaccgcagaagtcttcaactttgcagaattcattaaaccactgagtttttcctgctgggccgccagatcaaacttcttattcataaatacaccttagatacataacggatgcgtgatagatattcaaagaatacaccttaagcatctttaaggcatcctaaagatacctatatttctttgacaatttttagcatctcctcaaccattgatctcacttctttacctccggcggtagttcggccatgtaacgattcagtgataccaaatcctgattcaagagactcttcaaaatccgcagtacgataggataagcgactgctcattagctttatatgtctaaaagttgggagtagagcgtcaagttttgggtagtgttttttgttagggtttgtcttacagagaaataagtgtgcctcaatatgcctgccaacgatttcactaatctcacctaatacgctatcaaaactcatcagaccaatacgtttctggtagagagtctttagcaggtacaatcaccagatcagcaaatgctaccgcagtacgcgtcatatcggagtcaaaaccaccgcaatcgatataaagaagttcatcagtgcccttaaactcactaatttctttaattaattcatcctgtgtttcagggatcgatatagggatttgcttatcttccggcctaagaccatgaattattgataaccctctgtgcgtatcaagatctaaagcttttgctggttttagctctccaacaacgtgcactgaagaggtagttttaccggcgccacctttattgtgagccataacgataacagtcataaaatccgcctatagagatatcaaatgagtattcactaaacgcacattgtatatacaaaagatatgcgatagaaatccattagatacacaataagtatctggtgcgaattttatatcattgctgatctgcgagagcaagaactagtttacacactgcataccttaagagtactcaacgtatatacgtaagatacacaaaaggaactcgttaaacatccaaagggttctcgatgagtatgcaaaccacttaaatattagggtaatttcctttgagtaatgataccgcctcatttccaggcatatgaaactgcacccggtgtcgcgccgccacgtcaagcgcaaaaaccttcgtgtagacctcggttgatttcatgctcttgtgccccatcaggctctgcagcgccttcagcggaatgcccgcatagagcatgtgcatggcgtagctgtgccggaatgtgtgtggcgttaccggcacggagaacgtgactccgtcaacggcggctgcagcgacggcttcgttcagccaggtccgcaccgttctgtcggtcaccgtccagagcctgactttctcggtcctccccgtatccggattgcgtcgctcctgcggaattttcagcgtggcgaccatcatctccagctgaaccacatactgaggatctgacagcggaaccagccggtgagggaccaaacctgacggcgccctgccgggaccgcgtgccgctttttcaccacgctgcttcagcgtggccagctgcacgtaagggtagggcggtgccaggctgaaatctccacgcgtcagcgccagtgcttcattaatgcgcgcccccgtattccagagggtagtaaacagcattttgcggtgcagatccggcacgtagtgaagcagcgcgctgacttccggggccagaaggtactgcggatagtcatcatgttgagcggccatctgccgcagtgccagcgctgcaggataatcaatcgcaaccggcagtggtggaacggaagcctggggataatgtgatggcagcgtcatggtcatttctgcttttccttattgcccattgcgatgacagaccagtgaaagctcgtcaaacatcacgaaatgccgtgtctgcttccccctgaaaatacgacgcatcatgggcgtgtaatcagccggttcccagccgtagggaccaatgtcatggattcgggtgtcagcagtatctaataccttttgcggtccggcgacaatacgaatgacttcagcgtacaggacctctccgcgcataccgtactggctcagatagcggcgcagacgcgatctgggcatcctgcaatcgcacttcatagagtagcggacatcttcgactgactgcgcggcagctaaaatccttggacttaacttacgccatgaaaaattagaatctgttctactctccattcatctttccttcattaaatggttcatgcgttttctccggcatcggaagcgtcgtctgccgcttttcttctcatatcgttctttacttcaaatgcagccagcgcacgggcatgaagcagggactgcaccgagcgtcgattcctctcccggcgccattcttcccatagcacgcgctgcgccgaccagggcgtggcgttgaggcgtgaatccgggaagcctgtcagcttacgcaggcgccgggacaaaatcaccgccttcaggccaagccgggtgtactcgtactgccgggcttcaaagaactcgtcatattccggaccgataaaacccgccgaagcaattgtccggtccgattcgcttttgagaaccggcagctccctcagctggtacatcagccggacgggcagggtgcgccagtcaccggtgacagcagcatagtcaagttcgggcaggggatgagaaggtgcaaaagcatgctcatgttcggatccgttatcccgggcgacactcgcacagttctcagcgaattgctccagcagaaaaaccaactcggtggcgatgaaataccgctcccgctgcagcctgtcttctgacgctatcctctctcttttcagggtgaacttgtgagtcagcatcacggccgcaatcgctgccccggcggtgatcagcccggtagccacacttccccatatgcccggcccctggttgatcacctgcaccgtaaccggatgggaaactactgatgaaaggctgtcagcaatatagtcagcatgcatcattcattcattcctaaacatcccttcatcaagttcaatagactttaggccccgcctctctgtactgcgtggcctaaaactgaataccacggtcttataatcttttattctctatttcgttcgtcggggcatcatcaatgctgttgttcttctccgatttgtctaaccaggcgtggagaaccttcttctgacgtaaagattgattgctagtaatgtgcttaaaaatgatgtcgaagttttcgacttcttgattctctcccttaacgggagagccggtgtctgtctgaagcttttcgagtacggcatctttttcaggaacgacctcacggttaacaaccttaccaagcacccggatgctgccagcgatgatttctagatcgtactggttttcgaaggagttacttttgaatgtgcgctgcgtcctcctgagccagatgtccgaatgctcgaaaccttgaccaagaaagtccgaaattttcttagcaaccacagcttcctcagcaagttcattatcaattttaaaaacctttacatctgatactttatccattgaattaatacctgagatggtaattagttaagtaatagtaataagcatataaataagcacacttacaatttcaaaatgcaattaccgtaaccccaccccggcatgatccgagtttttcccgatacggcagtaaccggaagcgtaacacggcggcggggcggggcaaagtcccctcacacgggacgctaaatccgcagggacactatatctggtagctggaccagctgacttaaccactacatgtagtaccctgcgcagaaaaccgccaccctcactcgaagatccggttccacccttttccggatctgcggaatttcacaacaacgaaatactgcaagcgactcaaaatgctctaggagtattcttatcattaatattatgattaaaacatcagcaagtctgatgaatgctcatttttcctgaccccaggtcagccccctcagcgataaaaagaagcactaggagagcacgtggcacttaaacttcagcaggaaatgcccgcagacagcgacctgttcaaaggtggcagccaccagaatgtggcagacaggatggcagaggtaattaaagaacaggaaattaatatcctgggtctggaaggtgagcttgggtccggaaaatcgaccattattcattttttaaaaaaatctctttcccctgaatacacttttatagacttcgacgcagaggtttatcactacggcaatacgaaaaaggcactcattgaggtcatacacgacgggttgagcgaaagtaaagatgctaataaaggcaacctcgaaaaactgaaaaacacagcgctgggaaacattgtaaaatacgataaaaaggtcagtagcagactgagttggtggacggtcagtttcattcttttgtgcctgctttccgtgcagatggtcagatatcttattctggatatcaatgctaatgctaaaagtccgggcacaatatcaggctgggtaattgcctcagaaatagttgctgcgatttctccgggcatgcttttattatggcttttagtgagccctaagcttaatgtcaaaacttggtggatcataagctttattttttcgtgcctgctttctttgaagatggtcggatatattatctcggacatcaatgctaatgaaaaagtaccagacgcaatctcaggttggataattgccttagagctagctgcaattctgttaccggccctgcttttattatggggtaaagtgagccccaagcttattataaaacccctgagcaattcagaagacgtcaccaccgtgggcgatctcttcaaacaaaacagcaccgacagtattactgaaaagtggctgataagccgggaaatagggactattgaattaacgaacgcgctcgcaggttttaccagtagctcatctgtttctgcagacgcaaagtttattctcattattgacaacctcgaccgcattaatgccgacaaggttaaagaactctggagtgatatggagctcattgcgggaacaacgcaccgccagttccgcattattgtgccttactctgctcgccatgttgcaaaatctcttatgctggacggccataccggccgtgagtttatctccaagcgcatccccgttaccttttccgtaccacctctgataactgccggatggcaggacacgttccgcgaaatgtggaaggaaaccgtgaacgagcggactgatttctcctgcgcggagaccatgcagatactggaacgctggcgcactgctgagtatccccggatgacgccgagactgttaaaaaaactggtaaatgacgtccacatactcctgatgacagtgcctgcaaaagctccggaagaatacgttttaattgcactttatgtggttttcgtacgctacaacgaatcagacgtaatggcgctactgagattcactgaaaataatgatatcgacgtacagcccgctgagtatgacgataagttgcaggcaacaaaagatcagttaaaccgactttttatgaatgatacgaaccgatggagtgaatatctgatgagtattcatttccaggcatcggtagagcttgcgcgtacagaactgtttgatctgccgcttaccgaagcggttaacaaacaggatgctgtagcactcgagaaactgacaggtatgtacggattctctcatgcgtggcagcgctgtgccgggcgctttactatgtacgactggatggaaactgtcacgaaactttccgacaatacattaatcagaatcaaagaagagctaaccgatgccgttgccaggctcaatgcgatatatgcattttctgagcgggaaaattttcgtgagtctttcacccaaagccttaaattgcttgaagaaaaaggttacctcggtactgaagatttcatggtccggcagaaaaatcatgtcgttacagaactgaataaaattcagaaaatgcctgaaaatgatgaggtttatatcagggggcttcttaaagaggcagacctttattctgcaatttttaaagaaaacctgctggacctgatagatattgatctaagcggtaaaatttattccatgtacctgctgaatgaaaaagagaatctgcctaacctccatgtcagtactctttctcttacagaagcagaacaggaaaaaatgcttcgccacatactggagactgaatcgcaggatatattcaattatgatgtcatccgcttcttcaagctgtacagtaagccagtgggaaatattattaagaatgacaagcaaaatttgccagaaaatatcgtaagcaaactggggttactccgcaactccagcagtaatgaggatgtagatgttcttcgttatgttattttcaaccctgagtggtatgacagtcagattacacccagtttaaaaaaacagagtggctacagagaatattttcctgaggagtatactgctcacctggtcgcacatctcgtagtcacaaagaactattcagaaatagaaatttacggtgaagattacgagcataatgaaagttacattaaatacctttcttattattttcgttatgttaataattttggtattgtaatggatgctttgaaagatgctcagtcgtcagcatatgtaagagaagctgttaagattttatttactaaaaatcacttgggttatatcaacacggttgattacgttaacacctattacccgatgctcaaatctgagttaattgatgttgattacatgagcccaattgtcgatcgtgaagctggcttgcttaaaaatattgattcagcaaaccttgataaaataagccatgaatttcttgaagacattttctccggaaatcaatttaaaaaatttaaagagctacttcacgtaatcagtcaggacattatttcaagtagggagcagctttacagtgcctttaaagcgatagaaagcaacagaagccttgttctgagaaggatggcttcagcaggaaaatacttaaacatgaccgcaggtatcagcctcttcgcggactggtatcgtaatctcgatggtgtacagcttaaaacttctaacaacgtaagattaatatggtcatgtctgaatgaagtgcagcagtctgaagttcttaaagaattccacgatgttcttatggaagtgggcacgcttaaagaaaacaggatcaaagtcattcatgattttcatgatattatcaactttgccgaaccggaagggaaagcgtcacgacgggcaatagcagcgctgttcggtcttgcttccggcgatgaggtattgcgttcgtggcttaatgcgcagcagtttactttcagcgcctggcctaaggctgaagctgatacagtaagtcaggtaattaacgtaaatcaggaggattttcctgatattatcagccgttcttcattcatcagaaaccgtcttcccgtaccggcaccggagccggatgataaaaatgcagaaggaaataaggatgaggcctgaaattacctttcgcatccgggcattccgtcaggtctttgaagaatacgctgcggatatcaagaggtgggcattatcatgaaaaagacgacaacaacgcctcatgacgccacatttaaggccttcctgacgcatcccactacagctcgtgactttatcgagctgcacctgccggcggagctgcgcgccgtctgcgacctcagtacgttgaagctggagtccggcagcttcgtggaggaaaatctgcgcgcctactacagcgacgtgctatatagcctgaaaaccgccgccggcgacggctatattcacgtgctcatcgagcaccagtcaacgcccgacaggcacatggcgttccgcctgatgcgctatgccgtggccgccatgcagcgacaccttgatgccgggcataaaaagctgccgctggtcatcccagtgctgttctacaccggccggcgcagcccgtacccgtactccacggactggctgcaggagtttgacgacccggcgctggccggtcgcctttacggtgccccgttcccgctggtcgacgtcacggtcattccggatgaggaaatcatgcaccaccgcagcatggccgcgctgaccctgctgcagaaacacattcaccggcgcgatctggccgacctgctggaccggctggccgccaccctgatggccggtcacctcacaggacagcagctggtttcgctgataaactacctcgtacaggcgggcgaaaccgatgacgccgaggcctttgtacgcaacctggcgcagaaagtgccgcagcatgaggatgaactgatgacgattgcacagcagctggagcagaagggtctggataaagggcgtattgaaggaaaaatggaggtcgcacgtaaacttctggaaaacggtattccgctggagtcggtcagagagcttaccggactatccgacgacgatcttgcaaaaatccgccactgatattatccagtaagatatcagtatattgatcctgcttgcgatgcccacacagtgggcatcagcattcacttaatcagcggtatgtcttttaacctcgtggtatagcgtggtgacagcatttcgcgtttcatctgccaggcactgtcacgttctccctgacccgcaaaccatacctttcccttgcctgagcggttaatggtgtccagcgcggccatgagcgcatcagcgtttgcacgcggctgctgctcgctgaacatgtcaaactgcgcgaccccggactggtaaaaatcacccagcatgacgccggctttggcgtaccggtaaccctcctgccagatggtgctgaggccgcgaatggctgagtcaataatgtcccgcgtatcactggtcggataatcacagatgcgggaagccgtattcgaatactggggctcatcgccgtgtcgggcggtggcgatggacacgctgatatgacggcagcgggaattctgctcccggagtttttccgccgcacgcgtggcgtacagcaccacggcctgctgcatctcctccagctgtgtaacgcgctggccaaaagagcgtgagtttacaatctgctgtttcggcggcggcgcatcctcgagcgccaggcaggactcgccgttgagctcacgcacggtgcgctcagtgataacgtcaaaattttttctgatcatgctgatgttactgtctgccagctgcagggccgtagtgatgcccagctggttcaggcgcaggctgatgcgccggccaataccccagatatcactgacgtcggtcaggtgcagaagttttcgctgccggctccggtcggacagatcaacgacgccccgggtctgagtccatttcttggccgcgtggttggccagtttggccagcgttttggtcggcccgaatcccacaccaataaccagtccggtctcccgtcttatgcgctggcgcatctgctgtccgaacgtctcaagcgggatgaggctgccaatcccggtgacgtcgagaaagctctcgtcaatcgagtaaacttcctgcccggcggccatttcgcccaggatggccatcatgcggctactcaaatcgccatagagctcataattagagctgaacacctgaacgccgtttctgcctgaaaaagcgctcgttctgaaacagcggggcggccatttttatacccatgcgctttgcttctgccgaacgtgcgatgacgcatccgtcgttatttgacacgacgacgacaggcttaccgcgcagatccggcctgaatacggtttcgcaggaagcgtaaaaattattggcatcggccagcgcaaacatgactactctcccgccggtccggtgaatcccagcccggccacatcggtgagtgcgtaagcaaccacgccccatacgggaagtgcctgactcacatccagcagggtaatggtttcatccgcatcaggtgcctgcagggcggggaccggatcgagcagcaggcgccgcagcgtcagctccccgtcgtactcggccacgataagctggccgtgcaccggtaccagcgcacgatcgatggccagcaccgaccctttcacgatcccggcatcaggaaagctgctgtcgctgcgcatcaggtaggttgaataaggtgaaagatgaacgagatcccccagactcaggcgagtttcggtgtagttctgggccgggctctgaaaggccatgaaaatactccattctgacagcttttcagctttaggacgtgaacctgtaacgccgctgtctgccacacagtgcgtatacgttactcagaatgtcagtatacgacgccagccggggagttgcctgcattaaaccgtcctcagcggggcggaaaggccggtatatcatggccttcagggtctgctgaggcatcccattgccaccatcgtccgggcccgtgctctgtgtcatacgccaccgttttaacctgtttacgctgcagataatccggggtattcatgccgaatacctccatcggcagggcttcggcgccggcaacgtcagtcagtacgaagtccgggaaaacattttcctcaccgtcatagcgcagcggcttgatgaacgcgcgtttttcctgccacagacgcgtctcgaccattccctcatagcgcgagtccagggggatgtagcgcggactgacggtcatcagcgccgcatcgattatcctgcagctgctgcgcggcaggttctgcccgtctcttcggataaaaactgtttccggcggctcggtttcacagataaccatgacccgggcaccgcggcgccagtctcccagtttcgcgcgagaagctccgcgcgaggcgcgctctgacgtcatcaggcagctgcagcgcgggaaaaccggcaaacagtcccagcggaagcgtggactccagtcgcgcatcggccgcatcgctccaggcagccagctgcgagatcaggatgagacggcgtgacgcgctgccggcgtctctggcagcctgacggttctgcacggcctgcgctgagtccttcatggccatcagcagcagcgactgctgcagcgggacccgtccgatacgtatgcgtgcggccgtttcattcagccgccagctgacccagcccggataacgctttttccggtcaaaggcggggtgccagacgttgatgccggactgttcccagagcaggtgcagcaaccccagcaggcgcattgagggctgccggcgccgcttaacgggtccggcgctggccgggggagcctccggttttttttcctggatatctttcttctgcaggccggtgggaaggcgtatgacaatattcccgtccggtgccgcctttacgacgtcgggtgcataaatagcggcctgcctttcatcagaccagacggaataaaagcggcagtccggcgcgtgctcatggccggaaaagggccatgacgcgagccagcactgatctgttttctgcgagaggtgcaccttcaggcgccggcagtgagcgtcctcatcgggtggccggcacaggcaggtcaccaccgtggtggctttattatcccgcgcgtatttcagccagcgctgccactgttccggcttatccgcacggaagtctgcggcgcattcccgcgttccgcgctggcctgcaaaccgcaccggaaatgttttctttgccgccataataagccacctcccgatcataatactgaatatgagacctgcctgattcttaattcagcctgtccgctgagcaggctacaggcgaagattcattccacagacggttaaattccgtctggtactgtcgcgcggtttccggctcgcccgtaataaccagcgcgttttcagcatttcttttttcggctgatgacgtgtagttaaatgatccggtttccaccgagcttccgtcagcaacaataaatttattgtgcatgatgctgtacatgccgttgacgcgcacctgtacacccgcgcaggccagcgcgctgacgagtgaccagcggtcccggcttttcttttcatcggcaaccaggcgcactgacacgccccgcgctacggaagcagccagcgcctgcgccacgggctgactggtaaagtcataggccgccacgtccacgctctggcgcgcgctgccagcgaactgcagtatcaggttcagcgccgtgccgccgggggagaaccctgccgtcaccgcagcgaacgaacagggcacaaatgcaatcgcgcatagcgctattactccgggtttatatttaatcatcgatagtcgccctgcaggataaataagtcaccattctatcacgcagcgtgtttatttaattaaataacgcgctattactgccgcaacaaaatataacaaatgcggattaagtcattattaatccctgccgataatataattcacacagggagcgggggaaccatgaacgaatttcacgaaataaacatgctcacatcacgcggtgatattaacggggcactttcactcatctgtaaatggagtgagagcattgcccgtaaaatcatgaaaaaggccggctacagtgtgaccccgcaggccggacgcgcgttctggtcatgggtgcaggccacgctgacggattcagcccggcagcgccgctgtggctaccgggtgcgggctgagcgcagggcacccgtccgctactgtcgccagcaggcgcgggagaactatgatgcgtacgcgcagatgatggcctcagacgtcgcgccgcaggctgaggctgccccgcacagagagatagcgtccatcgatgctggtcctgaaaaaagtgtcgctgtctgcggccgcacagaaggcctgatacacctttgccggcacggcaagccagcgccggcacgcgccgttccggtactccagctcaagcacgccggtggtcgcatcgtatcccgcgctgctgaaaagcgcagacgtcacttcatgtctgttcatggcgttattccgggcaggtccctgatgaatgaaatcgttgatcgtaaaagtgcggatcgcacgtacacaatgcccgtgcagggtaaaatacaatggcatgtatccggctgttcactggcggctcgtccgctgcatgtccgttattctgagctaccccgggcattcactgtagcctgtaaaaagggaacccggaggaacagggacccggcaacgctgactgcttcacggggagcaacggccagacgtcagtgttcacggtctttaagggcagcagacacccgctcatgtaccagcgccagaaacgcctgcgccgtcgtgtcccagttcgccggcacaaactcccctttgtaatgcgcccggaaatcccgctccgtatcgtcacattcacccagaaacagttcaatgtctgccagcagggtgtgaagattcgcgtcgggcatgtcgtgaatgtaggcctgaattttgggctctatctcatgtccgggttccgccataacgtaatcctgaccgaaatagacgccgataaaattatccagttcgctgatgctgatacgatccactatacctccggaaacgcagtcagaataaaatagggttttccgttaaatgacctgaaatcaatcaccacgcggacggcataacaggtaacggtctcctgatttcctctgcgcaccataatccccgtgggatgcgcaaaccgccggctgagccgcatgcgggcacgcatgccgggcggaacgttcttcacccacatcgctatatgatttttattatccgccagcacccggctgatgattgcctctgcctcacggagtgatttaaagctgctggattcttcaagcctgggctctctgataagcctttcgcgtagctcatccggcgatttaccgatgtgtcgctcgatggtatggccaccgggcgcacgtcctgaaagtgactcgtgctcagcaattctgaaccgcccacggcgtacggcaatgacccgctctgccccggccgccagtgcaaacgccatcggtatggcgatatcgaccgtcaggccgaccttcatggcggtctggcggtcagcaccgagggattccgcgagcgccacggcggaattaaaggtatcggtattgacctgcctgccggtccagacctgccggagactggcctgaatggtatcaagtccgtgcgttccgacaaagacgcatccggctttggtcagcatggtgggctccggcaccacgcacagggcgcctgcaccgaacatttccaccacgccacccgccagccccagcccgccggatatacggttactgactgattcaccttcactgacgctgcgatcagagagtacggctgccagctgcaccggcgaaagcgctatcctcagtccctgttcttcttccacagaatcctccttttcgtaaccggtacgtcatttactcaatttataaccggcacggcatcaggttgcaaaccggtggcgtttctccgcttatcttcaaagggcacagtgaacaacagaggaacggccatcggtttcaataccagtgataaccggagtgatatcggcccgggctttcagagcggctccgcattgttcacatccggaagaatttccagcttatcgataacgatctgcaggacgtccgccatgcccggtgaccatttgccgggtatatcgagctccgaacggaatacccctgccagccttatgcgtgtggtttcaagccccgcatcggccagcatgaggacggcttcacccagcagacggtatgcctcttctgaatcccgtcgttctgcttcagtaacctgcatagcatgtacctctcagacgtagccggacaggtgagcagtgcgcagcctgtcccgtgaatgccgcgtcagcggcatggaggcgccagaaactgttaaggacggctccagatgccatcgggcgccgtaagcccggcagagccggttacagggctgatggtggcaaaccccaaccctgtcctgccagacgccgtttacgcagcggcctgtcagcagcttatcagcctgacggtcggagacgaaagaaagaaaccgcggttcctgtcaccgcaactcagaaccaactagttacaacacccattaatcagccactgcagttccggcccttcgggccgggcggcggcggctggtcagtgggggcaaccgggcttcaggtccggcgcgggtccggccggagaggggcatcgtgggttcagacctgcgtggggcctgattacagtgaatccttgactgttgtaactaattgtactggccggggcccgcgtcagcgggagctatttcagattctgagcggcgcggacgcctgcggccgctgtgagcgaaggcattaacttaaacttatccccgcagaatgcctgcatgaaaaacaccttatctttatgaagatctcttactgacgtaagtcaggaatatcttgcaggtaatgtgattactgattacgggtaaagccattttcttaattgcgggtaaatgtgcattaaaaaaagaacacttccgaagtgcgctgtttttttattttttctggagaaaatcctgagtgggtattgctgaaactggcaattcttcgcattgcacaaacgactttaccgccagtcaaggcggtaaaagaaaaggggacagagtcagtgtactacgtcaggtatcgcaggtatttccggttcataatcgagacctaaatccatctgccggagacggttccagacctgacgatcgaactcttccggaggaagatgcatccattcatgggcaggtcctgcgcgcagcagcttggccacggcgttccgccggtcatcaatagacagcttactcagccgcgtacggcgctttttgctggcggctttttcacgccgcttcagcagcgtggccatgcgcatattttcataccagcgccggcgcgcggcgcgcacggagtcgtgcgtcccgggctcaataatgccgtcggcttctgccgccaggcggacgttacgttcagccaggaacttatccatgtcgatgccgcacagctgccagaagcggtccgtcagcacgatgtggcgtggcatgcagtagccggtggccgggtccatttccagatccggacgctcaatcaggccaaagcgctcccactcctcaaaaaggcgcgaaagccgggatggctcaacgcgcgtttccggtataacgttgccgttttcgtctttcgggctgagctcgtcggccagcttactgccgttgaaggtgacaactgaggtggccagatcggcacgctgaataaccagcggccaggtcgaatcatacagcgcctgcttttccggccggaaatcgcgtttacggccggcggcctcgcgcagctgcacaaaatacgggtgacgggacatgcgctggcgcagcatcattttgccggtgcgtttgtctttcataacgagccggctcatggcatgccccatctgtcccggcaggcgccggaagttaccgggtgcaaaccattcagggtttgagcacttgcaggcaacggagtgatcgccgcgacggcgtccgtcatttttgaggttcgggcggtttaacccgattaaaatctggtcattcaccctgtcccgaacttatggcggacaggggttgtcttatgaaaagcatgcgttataatccttcacaggccagcgcctgcttttggaccccctgatttctgccgccttccgccaagttgatgacagatttcggggggtttttgcattcagagcccggtaaaacgtgggctccataccctggacgtttttacggatacgtcctatccggttgattctttcctgctccgcgcatgtccggctacaggtttactgcacaccctcatcatcaaccaccacagtatctgacaaggatctaaaaaggatcgccgcccggcgaattctgaaaagaatacccatctcccccatttaaatccagcacagtttgctcatagcacgaatcgtaaggataaaaaaagctcaccgataaactttacagtgaccgggttcacatctgcaggcggacataatacaaatcacgcttctggcgggacggtgatacccggaagatgtctgatagaggtattcactgatattcaggcagccggctgtggtggggtcgcagacaatcgcttttaatttacgacgggcagggcggtcaggctgaggcgtaccgcagcaccgcgaggaacgaacagcctgagcggcgtggccgtcatggggtaaagattctggcggaatggccgataccccgcacaatgcccgctggctggcgctaaagggcaggttaacaggtttcaccttcccggccccgggccgggattctttatggtcacatgcggtaaaggtttgacagaatggcggatgctgtctcatgctaccggcgggatttcctttgtttggtggtgttattccgtttgggatagtatgcccggccctctgtcacgcaggccggacttttttaacccttttctgcccgggttatggcctgctgcatgacctgttcgctgaccacacccggaatgaccgtagtgttgtccggcgtggcgttctcggccggcatcacgataatgcccggcgttcccctcagccccagcatctcagccagggctgcattgttctccgtaacgtggtcagacacggctttatcctcgtctgaagccgcacctgcaccggccgcggcggcgaccttctcaatgtcttctgccgtcagttttccttcattatgcccggtccggtaaataccgttgtgaaatgccatgtacgcatctgccccctgcttccggtaaacacccagtccgcggtgcgatgcctgcaatgactccggatagcgggcggcaaagatggtccagtcccggaaagcaaagcgcacgccggcgtttgcagccatcaccttttccatcaccggcgccatcatgctgcaggcactgcattcgtagtcaaaaaactcggtcacgatgacttttgagtccgccggccctttaacgggcacgccatccagttgcatcagtagccggtgagttttcagcgctgactgcacgtaagcctgctgctgcatggcctgctgccgcgcctgcagctttttgctcacctcaatgagcacgtccgggtgcgcgaccagatagtccgctgcaatctcaccaatgcggacctgctgctccggggtaaacgcgtcagcgccggcagcaccggcttggactgtaaataaagcagcgctcatgaccagagctatgctggccatcttaagggtctgtttcatgatttatctcatatggctgcgttaagcagactgaaggtgagacggccgcaatgagtacggccgcgctgatttttaacgctctttctgaatgttccttgagggttcatgtgacagtttccggtggcatccgctccggagcatcatgctgaaccggcctgctgagacctgccgcaaagtctttttccgtccgggaggctgctgaaagctcagtggccagttctgtatcgcccttgcccgaatgcactggctgttcccggatctcctcctgcatcctgataacttccggggagtccggccgggtattctccagaacccggctggcaagtttcgcttcatccgttacagacctggcaacagggaactctggtttctcactgtctgtcatctcctgtggagcagccaggctgagatctgtggccagctttttctctgctaccaagtcggcacgactgtctctgctgctgatttccggttccggtacggcaggagtatcaggctgctgactttctttcctgacaaggtctctgatagctgcgtcgctaatgtcggcaggtaccaccgttgatagcgtatcttccggaacgggcggtgtattctgcacgctgttaacggcagctcttaccgccgtttcggtaacgggctccacgcctccggaaattttaagaagctgttttgacggcgagtcgtttccggtcttaagcaaaacgcctgaagtgggatattttctcgccatactgagcgcttcgtccagtgtggtcaccacatgcgtttcaccgttcctgcttttctgcacaagcgccgcttgtgcgccggcggtaaaaatccgcctttcagccccccgagccatgtcaccgctgccgggtcgtagcggcaccatcgtcaggcccgccgcttttccgttaccgtcgaacaccggcagggccagatgcggctcagggaacttccgtgtcggcgggatgatacgtgccgtaaccgggctgccgcgcaaaccatttgaccgcagaaacgcgcggcccatcgccgttttagacgcgggctgacccatcgcccagatccgcctggcccgatcgcgctccggctcgggcgtgagcgcatcatgcgccgtggccggcccttcttttccggtcctgagcgtctttgtccagccggctttatcatcggtaaaaatctggacatggtccttcgcacgcgagacgttgatataaaacgcccgcgcgccgctcatcagctcacgagcgccctcaacgccctccagcgccagtgagtaacgggcactggcgccctgagcgccgtagccggtgaccgcccagctgtagtcaacgtgccggtcagcgaacgttgctgccggatcgataatcttcagcccgccggcattgcgcagcacaatctcaccattgtcgcgcagctcttcaacgcgatactgttcgtgtgcagcatgaccggcctgcttctgggttttactcaggcggacgctgtcacccgtgcgaagctcaatagagcgggtctcaaaaacctcaatttcagtggcgttgagttcctgcggcgaccagtactgcgtgcgccccgcttcatccttcagggtgatgttgccgtttgcctggtcaacgccggtgacgtgcaggtaccgctgattggccatcaccacctgcccggtttcccagtcgtcaatacggttaaagtcgtgccggccaccgttgatgcgatccaggacagggacggtgcggtacgcctcgcccagctcttttgattcaaccatcgcgttatgaataccctcattgatggctctgcggtctgcgtgcagctgaaccatgatcatggtctgctcccgtgcctcatcggtgcggctcataaagtcagccacgattgtggatacaggatctgctgactcgacaattgatcctgtgggcagcaccgtgcctgctcgccggggaacaacgtccggcgacaccttttcaatgtttctcagcgccgccgcgaaatcattgctgatgatgctgtacaccgcagacttcaggtccgggtcgcgctggcgcacgatttccttcatgaccgccacatcaatggggctccgctcctgcatcagctggaatggcgcaccgctctcgggcgactgcagctgcgcaacgtcccctacaggaaacggcgcggccgttaccggcggcgatagcacggtacgccgccgcggtatcctggttaccaatcatggaagactcatcgataaggaacagcatgttgtcatagcggacgtcctcgccggccgcgctgcgcatctgccagtccagcacaaacgacttcagcgtctgcgcatctatgccggtgcccgccatctccttaaccgcccggtgagtcggaccaaggcctacaatgaccggacgcgcgtcagccggcagggtgtcgatagccgccttgaccgcattgaactgggtggttttaccgacacctgcatacccctgcacggccgtaaaccggtccggactctgcagaataagcgaggtggcctctttctggccctgagtcaggccggacaggagagccggatcgacctgcgccatcagcggcacctgcgtgtttttaccccgctcaatttcactaacgatggctttttccatctcccacgtggcgcgcgcaacgaagtgaggcccggccctggtctccacctcaatgaggtcaccctccttaacctgccgggcaacttcactctcgataagcttcaggtcaccgcagaatgtcagcgcctcatccagcagtttcgcccatgggaaggcgacgtcccgcatctgcgccacgccgcgcgttacggctttctgtgcatcagagagtagctgtttactgagcgtgtccaccgcctcactggcatcctcttttccgctggcctgccggaccagcgacagcggcgagcgcgtggagcgcatgcgccccagcttctcttccgcccggctcagcgcttcgccggtaaaaatttccgcctcatggccggactgcgccagcgcgttaatcatattcaccgacagatcctgtgcgcccaggctggccagtaccgtgccgcgatcgttgtcgcggctgccgggcgcgctgacgtatccgtaagttacgtaaagcggccgggacgcgtccagacgcagcggcttttgctgcccttcgcgctgcacgatgagcgtgccgttttcaatagccgtgaccgtgaggcgatcgcgcgctttcaggccggcatgcttatcaccggcaagtgcaaacaggtgctccccggcggcaacttcagcgtcattctgcgtgaacagccgccagtcgccggagagtgcgctgagttttacccgtgatagcaccccgtccccgtcaatcagtgagagcatgcgggtctcatcatgcacgcggtcaatgacgtagtgccgcgtttcgtttttctctgaccggtcctccagcaccataccggcgcggtaggtctgagggagacggcgctccttagccgtcacaaacaccggtgtacgcgccgcaatactgaccgactcctgccccagcctgccggcatcctgcagcgcactcctgataaccccggtcagctgcgcctgctcgcgcgggcctgtcacaacggccgtaacgggcccctccgcagggtccattccggcatagcgctctgccagcgcctggtagcggtcgcgcttgtcctgaatactggtcacgcgcacctcaattccgtcagatggtgcggtcaggctctgacgctttacgcccgctgcagtcagcacagacagggcgttcgcatttgactgccgtccggcactatccagaaagagcagctgcgcattctgctgatgcgcctcatcggtgagcaccagcatttctttcaggctgagtttttccgcgctctcaacgatgaccgtactctgcggcatcaggctgaaggtgccatcaagcatccggctgcggtgaagcagccggtccctgagctcaggcgactttgcaaagctgagtgcgcgctcggctgaacttgtcagtacgcttacctcgcgcccctgctcacgtgacattgtcaccagtgtctctgtaacctcacgcagccggccgactgatgcaggtgcactgatgataacggcgggctcccgggcaatatgctcagggtgcccgggggaaagaccaccgtcggggctgaagttaattacccggttctctttcaagatatctgccgccagcgactgcaccgacagctcatccagcagatggatgtgcgaggtaaacacgcctttatcaccgtcgagaggcacgagcagattgtcatgaatagcctggtcaagcgcttggcgcaggtccggaatggtgttctgcagttcaccggtgttatgagcggtcagcagaagatccccgtaggtaaaccgcgttttactgtcgctcagtacagaaatggcagtgcggaccgactccatcgccggcacagggacgtcctgcacctctcccgcgtcaggacgggacatttcacgttcacgcgcttcattcatcacgccctggatgtcaaagccgatttcttccatctggcgctgccagcgcgcctgcagccgggcacggccgtcggccgtttctggtttagcgatcgggtcatctttagccgatggagacggcgctgatgtttctttatctgctgttgcagcctctttttctacggctgacaccgcacgctcaggaccagactctgtcggtaggtctttttcctgtgctgatggggttaaaggctctttatcccccgtttcagggaatttctctgcagctggcaccccatgtgccggttcagtctctgcaggaccatttttttcctgtgctggcaccgctaaagtttctttatccgccgtttcagggattttctctgcgtctgacaccctatgtgccggttcagtctctgccggaccatttttttcctgtgctggcgccgttaaaggctctttatctgccgttgcagagacttttccggtaacggtcatctcgtacgccggcgcaggctcagcctgcacaggtatagaggcagattcgggccggctgcgctccggtgccccctcgtcttctccatagcggctgatatcctgcttgcgctggcgcgtatcgagtgcggccacgtcgcggcttttgagcgaggcatcctcgccggcgcgtgcgtggatttcccggtgtcgcgaggagaactcatccagcaccgcttccgtaaagccctttatctcccacaaatcatgacggccgccggtcggcacggtttcgtaaccgatagcctcagccttgcttttgagcacgttgcggtagattttgccgtacgttatctggttgcggtacgccgtttcgataaagccggcaccgtgaatggtgtcggtggccagcgccttccacttgccgtccagctccgtgacgttggccattaccgcgtgtgtgtggatctgcggatcaaggttacgggaggtgtcatgcgtgaacagggcagcgaccattttaccgctggtcacgatgcgcgtgacgccttccttcgtatcccgggcgctgaccgtctgctccatgatggccagcgtctcttttaccgcgtcatggtgtgcctccagcaggcgtttatcgccgccggcaaggataagcattgagacacttttaggtgctgaaaaggtaaagtcgtgccccggacggtgtacgtgggcaccctgcacttccttccccagcatcacgccgttgggcagattgccgtgcagaatgccagtgaacgtatccaggtcaaccggtccctcaagtcccagttcgcgcgcaccctcccccatccactgcgtggggatgtcatccagaaagtaatagttatccttgctgctgtagtagccggcagcgtcggcggccgaagccaccggagcaacggtcatcatcgttcataccctcccgggtcaaggctgtcactcatctcctgatacgcgtcgtagtcgtcgcggtgtcgcaggatgttcttttcttcatcggccatgcgtgcgttggcatcgctgtactgccgggcatcagcctcttcacgcttttcctggtcagtttttcgcgggctgatgtgccggacgataaggcgtccgccgtcgtctttttccatctgcatgttcaactcgggagcctcaccccccggcgtgtcactgtcggtttctgctgagcctgccgtagtgccggtctgtaggcgccggattcggtccagcggagaaagcctcgggccgttatcagtctgtgcaaccccgggtgccggcagggtgggcgctatctctgctgttatgtccgctgtggattgcctggctggccgcggcctcacctgatgcgtactgatgggcaaaatagtggcgcggcgcgggaacggactgacgtttgaggtagtcagcacattgccgcccgatacgggagccggttcagtcgccttcagatgaggggagacatccagggaaagctcagtctctttctcttcaggcggctcctgtcgggttacaggaggagcagtttttaacgtgtcagcagacggagaggccggtgcaggctcagttgcggcggtagccgtggccgtggccgtggcggtggcggtggtacggtcaccgttttccagtatttcttcgccggtcggaaacgaaatgttcgccgcgcgggagctgcgttcgttgctctcgatgatttgttcgagctccggactcagccggtcatggaagtcacgctcaatcagcgcggggtgatattttttctgtttacggtacttcaggttcagctttaccaccgggtactcgcccggcaggcgcacatagaactgcaggttcggcatcttcataatctggtcgtagtccacgataggctcattgaccttgtccttactgatcgagataccatcacgcacctggtcaaggccgtagctgttctgctcgcgcgcctcacgccggcgctgatgacccagttcctcctccacgattttggccacctcagcgctcggcgaacggccataggcgcgggtgttcagcaggtcaaagatggctttagccatctcgcggccgtagatgtggattagctgcggcatgttctgaatgcccagcacgaaacagccgccgaacttgcgcgcctcggccagcgtttcgttgaactccggtatcttctgcaggctggcaatctcatcgccgataaaccacacgcgcctgtcgctgttctcgcccatgctctgcagcagcagcgtggccagcgacagccacatcgatatcagggggcgcacagccttgcggtggcgtgccgttgtggaaataaacagccagctgctgtcgtactgcgcatcggtcatccactcgcggatgctgaattccggcttaccctctttatccagcccctgcaggtagcgcagcgacttggcgtagttggtcagcaccgagcggatagagatggcggtcttctcgattttttcctcaaccaggttggccgacggggtgttcttcagaaactcgcgcaggcttttcaggtcgatggagagacaggtcttcaggaacgtttcgatgctgcggtcaggacgggacgcgaactgcatggccgtgtcgctgaagatggtgcgcgatgaggagacccagaacggatcggagtcgccctcaaccggcatcagcgcggccgtcatgttctcgtaatccaccacgtcctgcgcctcgcgccatagcacccagttctcacagcgcctgtcgtgcgcgttcaggattttgtccaggcgctcgtcgtagtgggtctcaataaacgtcccgccggagtcgtaaacaatcgcccggtcgccgcgccggcggatgtagtccagcagccagcggatgagggtggacttaccgacgccgatggtgccgtgaatgagatagttcataacctcggcgtttcttcaccatgttcaggccgccaatctgcagatcggacttctcaccggcctttttcagcagccggttgacctctttaagctggtcagtaagggtcatgcccgagataaactcgtcttcactctcccgcttaccgatgcgacccacataccaggcaataaggcaccagagcaggctggcggcaataccgcaggcgctggcgataaagcgcaggttcgtcaggaactggcggcccatgtcctgcatccacggattggccagcagctgcgccggcgtcagctttatcgcgcacagctgcgcactttcatcgcagtgccagaagatgtcccatgtggcttcggccgcacgcggggacaggtccagcagagagtggctgggccacgctgcccagtaccagaagccgttacgtagcacgtcatcgggcgtcgtaagccagaacagcgcgccggtggccaccacgaacagcagcagcatccagtggaaaatccagttgctgacctgcacaaacatgcgcagccggtaggccgtcatctggccgccctgcgtcaggtatttgggtgtaaaactcatggggaactccgaatagcacgcaggcgcagcccgcccgagagaatcgggcaggctgacgacgaaagaaaagtggaagccgggccgctcgggccccggagattatttcagcttgacggacgcgggggtgcggataagccccgcccggcgcagcagccagacaccggccatgacggggatagcacaggtgaagacaaacagattccagcaggccagcgtgagcccggaaagcacgcagccggcagtcattaccagcagaaccagcagcagcgtgataacgcccgggggcatcatgtcgccctgcaccatgcgggtggcgaggtcccaggcataaagatggctgtgtgacatgatggtttttacgatatccggcccgaactgccacagcacgatggcgctccaggcgaaacacagggttaaccagataacaaatgtgcgtgccgcaccgttgaaagtgagcatagatatttccttcagaaagttagggtcggggatgaagtacagccgttacaacgcagactccggcgcgcgctgcggggaaagaaccccgctgagcatgatcgatacatgtcggttaaatctgagccacgcttccgctaccccgtatatcagggagaaacgtggaaatatgaggtcccgtaagggaggagggcagcacccgtggtgttgatgctgccccggtgtccgctgcccgaggggcgcagacgggggttggcaggcgccccgttgtcaggagagattttcttatttcccccttaaggcgcatgctgccggctttgcaaccggtcatgacttaataccaggaatttcagcaccctgcaagctgctatatcttaataactgtctccctgaaagttgcagaagcagctaagcagtatcttgcgttacatgatgccggcgactgatttagccaactgcgcttcaagaacaggctttgcctcttcaaacttcaggttcactttattagcgtttgaaacgacgcgggtctgatacttcatacggttgccttcttcactgctggtctgcagcttgaggccagagtttccctgcctcagcgctgccacattatctgtcgtcacggctgctttgctgcgttcggaaatctgtagatcggtcaccatcgtaaagttcgtgtcctcgaccagagcatctgctgccattcccgcaagccccgcggccaggcctatgcccagaatggctccacctgaattactgttataagcggtaatcccagcaccaagagcagcccccgcagcggcgccttcataccctgtcgacaggaagctttgtgcctgccgtaaatccatcttctctgctttcagaacgttagcctgaatccagtaataagcagcatcagggctggaggttacggtatagccttttgcacgcaggtcctgcgccagtatcggctcaagatcgctcatgtctttatcagaggtatttcgcacctgcagataaaccgttttctgactggatggctccagccatacggtctggctcatctgcgttttgacatcgagattgcgctttttaatagctgtactcatggcactacagccggaaagcataagacaggcagcggtagtcgctgccacaaagacattgcggtttttcacaggtgcatccttatttaacagagaaaacggaaatggcgcgcccctgggcacgctgtattaactggaaggatttataaagaaaaccccttcagccagaatggcggaaggggtattagcaggaactgggtgtcttagatgtttttaataatcttagcgaatttgctcattgcgccagcaataccatagcgtgttaattctgaactgataatagcttgcatgatgagatgacttatcaaaagcatgaatggcgctgcataaaataactgcggattccaggctgctattaacgcgaaaatgccattgccaaagattgctgctatacaggtatttttgtatgtccggcttaacttctgtaccagaagcgatttacttctcaccgtctgaggtatagcggtcagcaacagaaacggtgtataagtcatagccataatcgctaaagataagattagtgtgaagccaccgaaggccagcgtcagcccctgataatgcagcgtcgggttaatccacacatcgtctggcggcacaaagctataaatgatgtatgcgaacgataatgcatacaacgacaaacaggttaccggaaaagcagcactcaatttcattgcatcgagtgcatttgggacctgctgttcgccagatgcaaaactattaagcagataatctgcgtccttcttgatatcgctatacatcatcccagcccccttacttatccggcacgccgtctaagctccgctatttttctatcaaagtcatcgcccagattgtctttgggtttctgaccctgctcatttaactctttattatgacccgctttgaaatttcctttagcagaatcatgttcgtgcttaagtatatcactggacgtctgaacagtagttttattttcggcgattttaccgtcattttccctgagagtttccataaggccagatctttgtgctgcgacctgattggcgacattattctgaattccggcgcctgcggcctgctcgctcactcgttttgaaccgctgcggaaatcctctctcatttcctgtgaaggtgcaccggccggaacgctgagattccgctctccctgccgcgtgctgacttcagctgtctgccctttcctgacgacagcattctgtgacgaaccttcagcaggtccatagctgtcagccggcgagctgcccgacagggcctgtccggaagtctgtacttcagcgggaagcgtggttccacggtccgcagatgtgcctgcagcatccagcgaaacgtgacggctgcagcggctcactgttaacctggtcagtccgtgcaccatagttacgcatgatttcaggttcaagccgatcatgcataaattcagtagctgcgccctgcgcgcttctgacgtttgtcaggatgttctgggcgtcactgccatatttagcagtagtccagtccacaaactcctgattgtagttggcgtccaggctggcactctgcgtctgggaaagagtggccatgcggctgaattcctgactgcgcgtgctgctctcagtgtactgatggtactgactcttagcatcattaagcgttgctgcgaactgctgagcgttagagctggactgattatcagtatgactccctgaatcgctcagacgggtcgatgtcaccatatccatgccctcgcggaaatcacgtgcctcctgactgctctggtctcggcgactatcacgtccctctgaatggctgtcctgcgtaccatgcgagctgccggtagtgtgacgaaggtcagcactgatactggcttctcccccagcgctgacgccggtcgcccacttgccgagtttacccgccagctggtcaccggagtcaaatttaacctgacctctgacacccgtgccagcactgccctgattggtaatatccatcagctggttgtaggcctgctgttcagaaacattgtgcgacttcgcatagttctcaacggcagactgcattttgctcgcgcctttagagacattcgttgccacactgttgtcgctgccctgcgtcatgctgtcgctattaccgctctgctgcgtcagctggttcatctgctggaagccgctggtcacgctgtggttataaccatcaagcgaactctgcgcctgctgctgcgcctgccgtgcctgctcggagaacccgctgctggcgagggagcttaatcgcatgctgactggcaggtttgatatcgcctggctggtatctaccaccgtatgcccgtctgccgtctgcgtcatcatcgcgttattgccggtctggaagccctgagcccccgagcgacgcagcatgttggtgtcaaacttgttggcactgacattatccatcgacatgttgttaaacgaccagttgccgtccgccgtcgtcgaggcctgcccgccggtcgcaaacgccgccgagctcatcactccgccaacggcctgtgaggccaccgacgccgcgcctttggtaaggaaaaaggcgagcaccggtatcgacatgctcaggtagcccgcgatgttggccgcgtctgagtgctgcagggcgacctgatcctgattggccagtaccagtgacgtggctccggtcttcgtctgcagataaaagttggccagcgagttaaggatggcgaacatcaccggccacatagtgaagtaaacgaaaccgccggcgtacagcttcagcgttttaagcccgaagatgtcgtgatttaccagcgcaagcgcgatgaccagcgggaacagcgcaatcagtaccagcatcatcagcgactggaacatcggcaacgtacgtgacgctatcacgccacccgcgccccagctaattcgctgcttggtcatgctggactcggtggccagattcagcaggttggccgtgtcggaagagcgcgccgcaaaacctttccagccgtcacggatggccgcattagtgatgttgttacgcataatctgcgctgcgctcaggccgcctgcatagaagaagttgtagctctcatccatcgcgttgccgagcagcgtgtcaccgctgacgcggctgccgaacacgcgcgtggccagcgcatgccaggtcgtgccgccgatgcgcacgtccgctccaatcaggtttttgacgaccgcagccgcctgctggcaggtgataaactgccggccgctgcccgtatcctgatacagaccgcgcagcgggctcgggttattcgtaatcagcgtcagcggatcggtgctgttcagcagctgtgacacggtgtacttgttattcagcaggatatcgcccaccacgcagttttccacgtagtcggtaagcatgccggccagctgcggattctgtgaccggaagtccgtggtctgcgccacaatctgcgaaccgaacagcatgccggacttcgtataggtcagcgagtccggacgcgagaagctgtactcataaagccgcgccacgccgaactgcaccgacgtggtcagcccggcgatgaaggccaggccggccggcacgttatcgacctgataaactgccgccggatcggtgacatcaagtatctgcacgctgcgtttcggaacgagcagcaccgacgtaataataaagaaaacggccagccagctggcaaacaccatcggattgcgcgatttgatgaagctgaagatcacgcccagcacgccaaaaagcccggcgatacgttttaacgtgtcataggtgtcgctgccgatgacggtgacgacgccgttaaacacctgacgccacatgtcaccgccgtaaatggtccagacctcagtcattgcccgttccccactgatagttgccctgataggacgtcgagataatggtggatacctgctgctgcaggtactgcatgttgcgatcgatgccgtccagcgcgttctggtcggcggtactctgcagcttcatctgtgccagcagcgaggttgcagccagcacgttgttacgcagctcgccggccgcctgctcggggaagtttttaccggccagtgactggctcgcctgctttacgagttcctgcaggtactggatcatcatgtcctgcgcgataaagtcggcgacctgtatcaggtaggtcgggctcatgcccatgctgcgggagttggtcaggtatttcagtaccggcaccgaggtggtgttgatgaaacccttttctctgtccgacaggccggtatcggccgtgagcttgctgtcgatggaaatcatcaggttgcgcacctgggtcaccagcgccacgtcgctgctgacagtgacgctggccaccgtcggcccgaggcacagatcctgctcatcacagccgtacatcttcgcggtgccgccgcgcatcagcacggtaatgatgtcgcggttatcaaccagcggcgtcaggacggtgacctgcccggctttattgaagatgatggagcccaccacgctcatcaccagttccttcagctggcggttaccgtcgaacaggtggttgcggcccagcgcgtcccagatgaggtttttgtttttcagcacctggtccttcattttatcggacgcccggccggtgacgctgtcaccctgaccacccacggtgcagccctgccgcgacgccgcccagtcggagaaaatgttgctctcgccggcaatgtcctgacagattttctggttcgatacctgagacaccggccacaggccgccgatgatgccctgcgcggcctgacaggagctcatgttggcggagttcacgtccgaggcgagcttctgcagaaagtctttggcctgcttgagctccggcaccatcgtctgcagtgccaggtcaaaggcgtagcccgccgcattactcatgatctgcttaacaaagcgctgaagttcggccccgttgatataggaaaaggcgcccagataggagtcaatgccgccgcagccggcgttgagtgacggtacctgcatcgagatgagctgcacctgtttgaccgggttacgcagatagatggagccgccggtaacgtagcctgcggcctgaccctgccatgcctgcgcctttgagacgttgccgtcaaagccgaggctgccaaagtagccgttcaggtcgccctgtacgtcggcaaaggccggcgcactcagtgtaagtgcgaccagagcgcctgttaggaactgacgcagattcatgatgttttccccgcctgcaagtgtgtacgttctgtcattgaaaactccgttcattcataaatccgtgccggcgcagggtgatgctgaccagcacgccgcagccgaagccaccggcaagggagagcaggaacaggagcgggtacagctgcagaccgctgagcaccagcgcgtcagaaccgtaagtcatgccgtccatacggccggcaatttcgcaggcgagccaggcatacagggcggcggcggccagcagcgaggcgcagacaagcagcagcgccgtctccagccgggagagcgttaacgttttttcagtcatgggttttccgtcggcggcacagccgcccgtattactgcggggtcagtgaggcactgctcgggaccggacccagcgtgtccggcgggaggttatcgatatcggcttcgatcatctgcgccagtcgctggctcatggttcccatgtccgtcaccccctgaaacagcgggtaggccacgttggtgttcacgttgaccataaaggtggtcggcgtggcgatgggcagcccgttgccgaagaaggtcaggatctcaccggcaatcggttcattcggtcccgtcttgcgcgggataagcgcaatgggaaaagccgcatccccgtagccatcaagcgtataggggtacacctttatcccttcctcatcagcccaggacttcagcagcgggtcaaacttcgcgctgtactgacagcctcgctgcataaaaaccaccaccgcatagtcgttcaggttgacctgacgtccgtcggtcagggttatcattctgggcggctttgctgacaccgcacgcacagggcgcgtcccgggcaggccgaaatccggcaactgcgcaccgcgctgccccttcgcctgctcaagcgcagcaatgtccgaggccaccgacgcctgtgcgaataccggcagcgtcagcagtatcatcagcagcacgttaagcctcatgatggcctccccggccgcctcgcgaccttcgccaggcaatcagctccgcgatgaggcccagcgcaaccagaaccagacaggctaccgagacgccggcaagcacgtcgtacgtgaagctgactgaccacgccagcagctggcgcaggcagttaaaaatgatgcctgacatgaacagtaagatgataagaggtaagcggttcatttacggactccctgagcgtggcggcgcagggtccgcaccgccacgccggcaataatggaaaacagtacgccggtgaggtagaggctacgcagtgtactgtcagtctctgttgcccatgcatcacggctctctgccgccttcacacacgtggcaggcggggggacaggcctgatatctctgctgaccggtacggccttatcccatgatgtatcaggaacggacggccaggactccacgcgcgtggcctgcgaggcgcaactccacacctgccctgccggagcatcgcgtatcagcctttcggcctcgctcaccagcagatgcccggcgccaccggcgctgtgcgcgctgagcaggaacagcagaaaaaacagcagcgccggatgaatcaccagcgtctgcagcagaaagttgcctgcccggtttgcggtaagcaaccgcccgtgccagacaggtgagagtgtcagcataatcaggtcctcagaagttaggcttaaagccggtggccacattgagaaagcgcttcgccaggtcgtcctgcgtcataaaaccgtaggcgagcggacggaagctttttgacttggggtcaaccagaaacagcgccggatagtgcgtaattcccatgcgcgcgctctggccggcgtccggccggctgtcgggcacctgcggcgacaccgtgccgtccacgctgaccggtatcagggagatgtgccgcaggcgggcaaagtccgccaccacgccggccatctgtgcatcaatcgggtcaccgccgcggtagaagtagaacagcccgtactggccggaaagctgactgatggcctgcgtctgctcctgctggtcccgtgcctgctgcagcggcgcggtgctgttgtagtgcggatggtcaaggttatagtcgagatccggatggtcaagctgcgccacggcaaaggactgactgaacatcgaggcccggtcggtccagaacttctgccagcgcaggaacgtggcggtatgctctgcagacggatggaggatggcgttgttcagcgcctcctttgtgtacgctttaagtacgtccgcctgctctgacggtgacagcctgctgaagtccggcacctgcggcgcgggctgcgcttttggtgccggcgggtcaggctttttcttcggctcgttgtaccagtgccagccggtaaacgggtcagccggcgtcaccaccgcgtcagcagccggcgcatcgtccgccaccgcctgtccggcgcacattgctatcatcaggctaatcagcagccgcttcattatttacctcctgtctgcgcattgacctgcgcagctatacggtcttttgcctgcttgatcatcgtcgctgagtcagggattttctgattggccatgaggtcgctgtagaagtcctggaagttaatcagatcaaagttaatggcctgcagttcaggaaccgtaatgccgcgacagttcggtgagtcaccgctgccaaagctgacgtgcagctgatcgcggcgcccctgctcctggataatgcgggcgagcttgccgccgaacacgcaataggcctgcttcttctgcacgcacacccctagcactgccttgttgcaggcttcgccgaccagaacggtaacctttttagccttcgctttaccgatggccatttcgtcactgttacagttggccagccccgaactgttcccccagccggtatcaacgcagcagtttgagaagccggccatcgccttgcggcaatagagcgcctgtccggtaaaggccttaatatctatctgatcgccgttcttgacgtcatcgccggcagaggcaagtccggcaagtttggccacggcggtatcaaagccgctgtcgccggcaccgtcggtaccgttgcagtcgccgctctgacagaggtattctccgccgcacagcaggccctgcgagctgtaggtggtctggcactggtaagtatcctgctcatgcatgcacgttccgccttccgcctcggtacagccgcggccggcaatggtgcagttgcggtcagacatcagctgagcgcagttaccggtggagttcaccggcacgatgtagctgtcctggtactgccagcagtcctgcgtctgggtataggtctggccgtcggaggtaacagatcgtgagcctcccgggtcggtgcagacgctgccggtactggcggtggcctgggatttgtcaaagctgcagctttcggaccaggtcgtgtcggcctttttgtcggacacggtcacgttaaacgtcacgtcgaggtggaacagcgtggtgccgttattaatgtatttaatgagcgtgttaatgacggaatcaagtcgggcccctttaggggtaatcacggcagagtaaacctgacccgcattaacctgctgtcctgcgacacccaggctgtcagcccccttgccgtaccggagcgtgacattgttgttcagtatcgaggtgacataatctgccccggagttataagacggggccggggtataaaccagctgcgtggtgccgctgacgagcgtggccgtttcaggaaacgtgaaatcgaccagtatctgattgcccgagcgccgtgcgttcttgagcagcatattcatcgtccgggtttccgtgtggcttgagcccgtgacgataacgctgccggtgcgggcacaggtctggacctgcgccacgtccctgtcgcaggtgaagttttcaaatactgacttcgacacgactttcgcggtgcactggctgttggttccgtccacgatggaaccgctgttcgcctccgcattcttgccgttctggataaagtcggcgttagggtcaatcgtcacggccggattcttaacggaagaatcggtgacggcctgccccgcctcattacttccaatctgagtctgtcccttatcctttatcccgccgtccccgccctgcacgccgccgtaataccccccctgcggaggactggcggtgtagcccgggatcactgacgccgggtcggtccccttcgccgcagcggtgccctgccccttatttgagccggcatatcccgcacccgcgttgtaagcatcactcgtcgcatcagcgaatgcgccggacgccatcagacataaagaaagcagcagggcacgcttcatttcgtaccctccgcatcctgcagcaactgcgcggccgtactgccacagtcaccgcgctgcttaacctcttcgagcgcctgcttaaccggcaggctgccatagatgacgtccgactgactgccacaggtaacgacgagcgccggcacggccctgatgttgtatttctcatacagggtcgggtcgatttgcaccccggcctgcttatcttttttagacagttcaaacatcgtctcagcggtctgacggaagtcgttgttcagcaggccgcgcagcgtggccggtatgccgaagcggcgggcgtccgcaagcatcggcaacagcccctcctccgggatacccaggctcacgaaatacacagcccgcggttcgggacgggcggcgctgttctgatccgcctgcgaggcggcaatttcgttctgcagctgcgacacccgttcctgctgcgcatccggcagcgtaatgttcatgcccttcagctggcttttgaacagctccaggtcgcgctgctgctgcttcatatacgccatgtcattacctgacacgaccggctgctctgcggcattcgccatttctgcgcaaagaagcgcggcgccagcaagcagcgccgtaatcagaggttgtttcatggtgagtccttacagataaacgcagttacgctttcgccacatgaggtagccgaagttctttttcgtcgccggtgagttgtgtaccgagccccagagctgggtcgtggtgccgaacgggtggcagtcattaggttcggggtacatattcaccatctgataacgccagcgtgatttcggaatgattggggacggatactggtagcacacagccacgtccgccccgaccgtctccatcaccagtccctcccggtgcagcttgaaggccatgcgctcactgaccagcagcgaggcttccagcggtgaaaactcattactggtgaagcccgtaaacggatacatcgaaccctgtgcgccggcgcaccagaacagtgggtccagcggcacgcccgccgtggaggcaatcgagtccgccgcacaggcgccctgcgccagcaggttattgaacaatgccacttccgggttcaggatcatggccagcgtgctgtcgttccacagcgggtcaacctcggacagataggcgatgtccatgtcgccggtctgcatgcagcccgtactggtgatgatgttgagccagtaaatcagcggatatttgtaccagtgaacgtgatagaagctgccgggagtgggtgagtcgctctgcccgccgcgtccggcaccggtgcggccgaggttaattttaaagccgcccatgttcaccatgacgccgggttcgcgcgtcacgtccgtcagcgccagcggctcccaaaagccaatggccagacccagccggtagaaaataccgtagggacacatctgaatcggcgaggcggggttcggggtgtccggatgcgcacctgatgcgagctggatactgcccagtgacatcgggaacagacacttccagcagacgtcgctgatggggtttacccagcgcccgtcgccagcgttgctggtcgctgccatgacaggcttcgccataacacctgccgtgagcaggcacattatgaggagtaaacgtttcatgagcctctgacctctgttttacttcgaagccagacacatacagggccgtcatccgtgtcgtgaatgctgccggtaaaccagctttcgcccgcaggtgcggacggctcccagcggctgcagtcaccggttttccggaaggcctgcatcatccagtccggcgcgtcgttttccatccaggtgaaggcggccgccaggttatgtgcggtaagccagacttcaaactcgccgggctgcggatattcattgccgtcagcgggcacaaaaaattcaggatgtgtccagccgccccagcgatcgcgcacgaccggctgagccgatatttcagcagggtgtgtcatagggtgagattccgtaaagatggcagcggaactgccggggtcagacgttaaacgggcctgcctgcggggtgcaggctgaggcgtaccgcagcagcgcgaggaacgaacagcctgcgcactgcgggcagaaaaggcattcaggtggccgcagccacccggggaggatttacttcaccgcgcggcatagcctgccggtgatatcgtcgagctcgcggtcatagctggcacgctcggccgcactcagaaagccctgctgctttacgtagccgtcagcatcttttctgacccggtcagcctgctgccacagctgttcagactgcgcttccgtcaaatgacgcgccttgcgggcgttaccgatatcggcctgcagcacattaatgcgcactgatatgtgcgcctgaagcgggtctttaatacttccgccggtttcccccttcacgtcatgctgagcctttacgtcacatgacggccagtcctgcgtaaatgacgaagccgcggtggcatggccggccgccagcagtaaaaggccgaatgtcatttttttcattgcctgtatcccgttgtgtgagtattcacgcgcagaattatagaccagccgctgtgagccacggcaccgaggcactgcatcccgcgtgtcgttattctgtcgactcaggaccgtggtcgcgcctgacaatgtaccagccggccgcctccgctccccgcagacagtaatcggtccagctgccggtgtagtcatcctgttcggcctcgcgcagcatcgcctctgcagcgtcgtcactctggcgcgggttcagatagcgggaacgcgcctttacgatggccacacctacccgggcccggacaggataaggcagcgggacctttgcccgcggctcgttgcgaagcgcaaagccctccgcctccagcgcgtcgccaaatgctgtcagcatgcactgccagtagtggctgttcgcctcatcagctgccagtttcgccatctcgcgactgccaaacggtgccggagatgatgagacaaaagccacgcgcattgtgtccggccgctcaggattcgttctccttcctaaacggacaaggacgatggccatcgccatgaagacaatgaaaccacccacagccggcaggcctgatgtaaacgcgctgatgctctcgggtgccagtgtgatttcggcacgacaggcaggcagaacaggatcagtccataccggttgcatcaccggctcagcgtgcagctgaacgggtgaggcctcggatgacgacgcagaatactgccagtcatttaccagtctctgcacaagatcatatggcgtgctatcactcatttcagtgccacctcctctacccggagcatccggtccgcgcgcgtgatgcgcactggcgtatgctcaaagccgaatttcgttgttaacgtgccgtactggtcgaagtacaccggctcgtccagcgcgatactgctgtcgtgcacgttgcccttcaccaggatgaccttaaaattctgttgtcccgcaagctgcggcttcagccacgccatctgctgcggattgtcaccgtccacgaagtacagcgtctcgctgaaggcaattttatccagcggattaaccctgtcgcctgcccgggcgatgacgttgccgcgcatatcgcggatggtttcccgcaccgtaaaggtcgggtcatacaggaacgcgcggcccgttttcgccggcgtcagcccggccaccggtgccggacggacggcatgggctttcacccgtgcctccgcctcacgctgcaggcggtccatctcgccgctgtcctccatgcccttaaggcgctgaccgataaaggtcagcaggtccggctcggcgatcgggaacaggtggccgatagtgccgagctctttcgcctgcacgggctgagcaaccactgcagcgagcagaacaaccgctgtggcgagttgcctcatggcgccccctgcatctgccgggcaatatcggcctgaatgaccggggtgatatcggtgacgccggcaaccaccgcgcccttcaccagaacgacgccgccgtgtgcggcctgccagtcagacaggctggcgtccagcgcggcgccaaaacgcttcgtcagcgtttccagcgctcccttttccaccggctgctgcgccgtctgctgccggaacgtgtcgatggtgcctttcatgtcaaacaccacataatcgggctgtacggccctggcaaccagcgcactgacgccggcgcttgtcgcgatgagcaacagagtgaacgccgccagccgcacgctgtggctccgcatcagtcgcgcagccgctgtcatatgagcgccgtcacttatgttatccgcggtttctgtggccacctgctgaggcggctgtctttcttcctgcatcgttaattcctcttttaagcagtggtcagtccggcccagcgctccagctcctgcatctcggcctggtacatgtacggctcgcaggccagcaggtaggcagcttcttcactggtcgccccggccttctgcgcctccgtcatgtactgatagtcttccccgcgggtgctgaacatggctcgcgtgaccgggtcaacaaagacgcggtggaacgagctgttttcgcccgttgagatcatcaccgagctgaagccggtatcgcgcgcaggctggaacccgcggataacctgcgtttcaacctcactgaactgatccggattggagttaaggtaggttttgaaggccttagcatcctgcagcagggtcactttggtgcccgaacagtcccatgccgccgccgctgccggcggtgccgcctggtctttggtgccggtaaagtccttgatgccctgcgtgatggtgatgaatgccccgcggtggcggcgaaccgtacggtagccggtttcgataaagcgtgctgcgtgcgggttagagccgctgaacaggcgccaggcctcatcgataatggcgaccttcttcaggctgcgcggcgagtggtacatcttttcctgaatcgccagaatcagcgagtacaggatggcggagagcaggtgcggctggttctccaggctcagcagctccagtacggcaaagcgcgtgtcgccgtcgagcgtcggcttgtccgagttgaagtagtcgccgttggctccccacgtacaccagcggtccagcagcagcaccagctcgtttatgcggttcatgatggtcggctgctggccatattcctctttcaccgccgccgacttcatgtaaagcaccacgtcatcgatacgcgcggtgttctgcttcgattcgtatgccgccaccacccctttgagcaggatggtttcgctgaccttatcaagcggttcgttagggctggccagaacggtcagcaggccctgaatgccctcggcggattctttaatgtcccgcacgttggcgaacgggttaaagcgcagcgtcgcgccatccagataggccccgcccgcctgccggcagaagttcttatagctgccccccatgtcgataacccagccgaagccgcctgcgttcagcacctgccgcaggatttcctgtatgaagaagctcttccccgccccggtggtgccggtcaccgcgatgttaaagttggtggccccgttgctttcgctgaacatgtcaaaaaaggccagcgcgttgcgataggtcggcagcgggctgcccgatgccgccatctgccgctcggccacgaccggcataaggttgacggcgttgaagctcttgcagcgcagggtggcattcatgtgcttcatgtcgtcccacagcccttcctgcatcacgaaacggcagcgaggtcatccagttgcgcagctgctggtaacggggggcggacatttccaggtcatttttgcggaacacgttgatggcggagagttcacagcgctgctgttcgctgtcgctgtcgggcgtgaacagcgtcaggttgaggttaaagctgcacatggcgatttcgttgctggcaagccccatacgcaggtcgcgccactcctcataggtgcgctgcgtattgggaaacagcttaccgtaggaggagttggccttcttgcccatgtcctgctctttgcggaacgcctcgttctgactgctcacctgatcctccacgcagatggtccagctcaacaggaacggacagggaatacctaaatccgggaagcgcatgttctgcaggttgtccgccgcctgccagagtgcaaactgcctcggcaccttcgtcagctgcatgttcacgatgcgcgtgctgaccaccgctttatcgccgctgtcgctgaccgcccggtcaccctgctgccgcgcggtgatcagcttcaggtgatccggatgaacctccatttcggtactgttatccacgcactggcggtgcagctcctgctccgggttccagtgctcgctgccggcactgacctgccccggccggtaattcagctgctcgcggatgacggataaaaactcattcggtcccacgcgacgcgtgtccatgtgtgcggccagcatcgatacgcggagcgtttcgcgaacatgcgccaccgcgtccatcgatctgataccgccggtgccggagtgtgcgtacaccaggaagacgcggtagttacgcaggtacagcgggtattcgcgttcgttggccagcccctttagcgccgaccgttcccagaaggctttggtgatggcgttgaggcgcggcgccatgtcacccttccacatgtcccggctcagcccgttttccagcatgtcgcccacgcacttgctggccaccatcagcaccgtgaccggcgttttacggggcagctttttgcgcagcaggtcatcgagcgcttgtaccacctgctgatttgcgccggcaagcggcgccacctccataatgaagccgaccgagcggctgttgatgaacagctcagacttctcatcaaattcgcgccacggcagcaggctggtcagcgacggatagctgaagctctcctgcagcctcttgcgcgcctgctttgcgccgccctcatcccggctgctgctgaaaataccggtgaggtgatcgataacgttactgagcatgctggcctccgacgcgctctgttttcagcacggcctttatcagggcagggaagagtgcggactttccggtaccaggcgtactgtgcgcaaagacgtgtccgtaaccgggcgcatccgcgaacatcagcccgggccggacccggtgatgcagcgctgcagcggacgatgcagattccggccgttcatgcgcgctgctgaatgaaaaacgctttttcattactccccctcgctgattacgcgaaagtcttcgtcccagcgggacttctctttcacgaactcaaccacggcaggctgatgaaagctgtcctgctcatccacccagggcgcaatccacagacgctgcgtcgcatccgggatgcggcgggcgtccacctggcccggtccgctgtagtcacccgggaccacaggaccggtggcaccggtacggaccggcaccgtggatgcccgcaggctgtctgcggtcgcgccctgccctttcaccgtaagcggggcaagtgttgccacgcttaccgagcggtaagggctgacggcgggcttcacgttgccgggcgtcgccagcgcctcagcggcaggctttgggccggcctccttagctgccgtcaggtcgtccaggctctgatgctttgatgccagcctgctggcatcggacatcgacaggcactggtcggtcgcggtcttattacagtcaaaatcagagttcatgccggcgcagccggtcaacgcagcgcacagcagtgcgcacgcaaaaagtttctgcatggtggagtcctcagtggcggccgggccgcaatgggtcagggagataaacgtgcgggtcaatcgggtggtgcaggttgccctggtgaaggcactaaaaaacgggttcagccggtatatttacctttcataaaggcgttgaccgtctgcaggtccttaagcgcatcctcgctcataacacgggggctgctggcagcgtgtatgttttttaccggcgcttttgtttgcgtccagatatcagcatgtagcatgccgggtgaaacctgacgaatgacgtcagcgatgtatgtcgcaagctgctcaatcgtgatatctgtgaatgcgggtatgtatccgaaattctcagccagcgggcgtattgccgcatccggaaccggtcgggtgttaaacctttcaagccggaacagcatattgccgctggattgccgcccgtctttaatccggatcaacagcgagtccggagcaggagtggtttcatcgtggaccattcttagcctcgttaaaaatcaggttttgttgagaaaggcgcgcatggagccgcagggtgccctggtgaaggcggaagtattgtttgtagtgttgtgcgatagcagtcccggccggcagcataggctcagaactgtcttcttattatagggggactgtcagcgggatacgtggaagctgatttaccgggtttccacatgcggctggctgacggccagcagacgctgatccacccatccatctgccctgcaggtcgctactgccgaaaccgtgttttccggagtccagtttagtacagcagcattattttcatgtacgctttttacgtcgcccagttcgcagtcgggttgcagaaccttgccgtgacgtacggctgcaatcacaatcttcgcaggctggccatttataaaggatgccggaactgaccactgaaaactgacgtcagactgctcagtaacaggtggtgtgttttcactgttttcctcgcggagcctattgttaatccattcacgatcactggatgacagatcatgctggctcagtaaccagatcaggcctgccgtgcccagccagcctggtccgctggcttccttttccctgatgatggtctgaagctgaggagaaggttgtggcccgctgcggttttgcaaagactgaggtactgaaggtgaaagttttgctccggctgacctgctgtcagttctgcccgttgccgtactgcttccggctgcgggcctgaagctcttataaacaggtgtactgcctgtgacggagctccggtaagccgggctgcgagcggcataacctgctgacgacttaaacgatgaccgggaagaggaactgcccgccataaccggcaatgactgcaaaaagcaaagcgcaataagcgcgcctttcagaagatatttcatttctcctcccagctggcctgcccgttcacggtgatgatgcttcggtcctgcgcgagagactgaatgcgtaatatctgtctcgggcttagcgaagcagaatcatcatatgctgccaggctgctgtcacaatctccggtacagcgaagccgccatagcagtgcgctggcctcatcatgctgctcactgtaaagccggctcagactggctggcgcctgtgtgtcatatgcaagccacgcccgggcaaaaaaagcagccgcacggacactgtctttctgcacccatttaccgagttccagaacatgagccgctgttgcaagtatttttactgaggctcggtcacccgatgaatgatcggccactgtaatgagctctgcagcaaatgctggcatttgtgatttcagttcggccggtggctcatcccgcataaacagatcggttaaagccgcataagagtgctggtctaacgctttgcgatagagcgaaaccgagaggttgcggtagtcagttttacgtttttcagaacaggatggtaaaagctgtttttccggacaggctttttcggcttcagcattcagttgctgccaggcctgccatgcatcagggttctgctgggctttggtccggatggcgtcgaactctgctttttgattgtcacaggccgacagtagcatgactgacagcaacataagcatttttaaaactctatctgttaccacaactcttctcctgatgatgtgtggcctgactggaataccggatagcaggctgagtatggtcaggcgcagtcctctcatccgttcaaagcttcaggcccgggactgtctgaagccagacgctgacggaccgactcgatttcggtcagcatagcggccagcctgcagctgctcgcctgcgccagccaggctcgctgataacgaagccgcagtgcgcagagccggatacgcagttcacgctggttatgttcactcatgattgcctccgcagccggactttcgttatctgaggttaagcagcacgtagaacagcgtaaaaaaatacgcgataccggtggtaaagcccgccatgaataaaatatctgtggggttgggtaccggtaccatccagaaccacacgctcttgacaaaataatatgccgccagtatcagccagaacagcgccatccccccgaaggtcatgaccgccatgtccctgaacatgtacgccagcagaataataatgggagacgtgaacagggccagccgccagacctgccagccagggaagcccgggaaagcgggcagcccatcacgcatcgtcagaccagctaggatgaagttcaccgccagcataactgcaaccagaaccacataaacgtgaaccctgttatccggatgacgccagcgtttaatcagccccttcatgctgcctcctgcccgtgtgttgacgtcctgcggaactggatgttctgagaccggacctttttgagatcaagttcaaccagtcttcccataaggtttaggagaagcattgcacgctttgcgccctgcggctcatgccagatagcttgcatgttttcaaacgtgccgtttgttatcagaactgtatcgccatgctcaggcgcctgcatgtctgcctgcgcagccgactcagctccccgcttcatgcgctccatttccgcatcacccattattgcgatgcgattgccaaagctgactatggttgagactccgcgcgttgctttaatagtcgttgtgtgaatctcttcaggatcgaatcgcgcaaacagatagccaggaaaaagtggttggggtttaaccggtttaatgcttcccccggcaacaagctgacaggtgaaaagcggaaggtaacattccactccctgattgagcagatgggcttcggcgcgtttttcctgactaaataacgacttgagtacataccactgtttcatctgtcatctccttaattaatagtatcgccgaggcgcagctggctggcctgacgcagaacttcgtcaggattcagaacaggcgcactgccattactgctgctgactgccggtgcagttgctgaggcctgctgcacggcggcctgcggagcctcctgcttcgccttttcagcttcggcatcctcaatcgtttccagacggaagccctgctggaacaccaccgtcaccgcattaccggcgccgatatcaatcaccgggtgatactgctcggcacgtttaatccagtactgactcagcgtgtccgccgccttgctggcaccgccaccgagcccctgcttgaagatgtcaccggcgccaactgaggcactgccacctagcccgaccgttggcgtggcggcagactggataccttcaccgaagccggacagcaggccggcggcacctgcattggcgacaatggcgccattacgcatcaccggcttgccgcggatgcccaccttgccctggaaggacacgtgcccgtcgaacggcatatcgatatgcttgccgttatccaggatgcagctgatgtttttggtgcgaacctcgccacgctcgctggagatgtcaccgtacatttctccggtcacgcggcactggtccatgttccaggtcttcccgttaggcatggagacctcgccgagcagggtgatgaccaccggcgaggtattctgctgaccggtcacgctggcgttggcgtcagcgccctcaatcatcgtggcctcggaaaaggagccggaaggtatccagggaagctttgtctttttctcggtaagcgcagcgtaggtgaaggtttcacggctcagaccgctaggacgcaccgtaccggtgccgggataaaaggcctgcccctgcggcgggtaaaactgtccgccctgccctctggccggtccgctgcccggactgttgatgctccactgcgccggaccggactgcccggctgagaccggtgcattaactggagtggtaccggccgccggtgtggtagcggcaggaccgtttgccggccggcccgcctgctgcgtctgcagctgactgattgcgtctgccatcgtgttgagcttcttctgcagctcctcattctggcttttcagtgtgccggtaagcgtgccgaggtcgcgctcaaggcctgcagtcttgttctgctgctgctgcagcgcggcggtggccaccccttcggtaaaggacgtattcaccaggctgccggtcaggttcggtgccgcctttggcgcgggacggttcagctccgcctggtggtgtgagtacgcccagatgccgccacccacggccagcatgaccgcggcggccacgccggcaatcacccactggcgccggcgcgtggcggtgttgatgttgctcatgacccgccctccgcgtcagtggagaaaatcacccacacaaagccttcgccgtttgcatacagggtacgggttgagagcattaccgcccgcacgcccttctgccagaactgtttttcactcagcgtccgcgtcacgtagccggtgtttttcatgcggtatcgcatcacccgcagatgggagccggcaagctggcgctcaggtgtcagcagcaagcccgcaggcgggttatacgcaggaccgcgcgaggccttcacctcggtgtaattctctggcactccaccactgacaatgctgcgcgcaacgcttaccagcgttttctggaagggctgactctcctcccataccttcgcgtccgggttgggcttaagtggcacatccgccggtattaggtgcagcgtgcggccattcccgggtttgggtgacacgtcgatcgaaacgcctacgccgccggccgtttccaggaagatggtgaagtcctgaccggtctgtggcgtaatcagcagcgcgccgtcggcggtgttgcttttgaggtaggcattgtccggaccggtgatgccggtaatcagctcgccgtcgataatgattttgttaggactggtattactcatctgcgccttaagatgcgcattattctcaaacggggtcccggccgggccgggtacggcggcctgcccggcggcaggcagcagcgccagcgcgccggcaacggccagggcggaaaggttttttttcatcggttcagtcctgttgcgggcggcgttcaggttgagtccagggcacctcggggaaggccgtcaggcggataaggccgtccacgtagtgcacgctgagccggtaggctttactggcatccggaagcgaaatgttcaggttaccgttcgtggtgctcgcgctcagcgtgccctgcacggtgatgtcaccggtggtggagtcggtgatttcgtcatcgatgcggaacacggaagagacgccgttgtttttgatgtactcagcttcggcggcgagctgctttttcatgtcgtcacggtattcagcgggaacgaagcgcagcagggcggcgtgctggctgtccacggtttcaggcgtgacggaaaggcggaggttgacgaaagagcgcaccagcatgccgtttaaggccgcgtctccggaagcggaatcggagataaacgggcggtcaaacatcatcggggtggtcagggtcctctgcgtttttgcaaaatgccacgccagcgcgccggtaacgacgttgctgacggcgagaataaacacgagcagcgaaagtgcgcacagggccagaatgattacccggttgcgcccctcccggacctgatacttcatagcgttatccttttaataagcgccatccggagatggcgcgtgggttactgcatccagtgccggttgcccgagtcgggcacgcggcggaaaactgcagccggagcagcgcggtcggcaggtaccagtaaagaagattcatgagccaccaggtgccctgccccttcttcagatggcggactaacagccagagcgcgcccgccacaatcagcatcacaatgaacagatcgcagagcaggccgatgcccgcgcacgcaaggatgagcacggcctcctctgtagggagtccgccgaggcgtttctgctgattgagggtttccgggaactggtactgaagcgattccccgttcatgcgggattaaccggccagggagaagaaggtgcgggtgataacgatgaggaaagccagaccaccgacgaacagcatcgggttgcgcgttttaatatatgcgccaatcgagatgatgatttcgccgatgtaaaacccccactcaacggtactgccatgaccgaacgtgtctttggcatcctgcttctgcgtggccagcaggtcagtagctcctgcaaaatgtggcaacgcaaagaacagcattgcgagagctacaagggttacgtttgcgcgatgctgataaccttttttacaggcagtacggacaagacctttcagcatttgtttagtagataaatatttaccagagatgggtttctggcagacatcagacaatgctaccgccacgctatccgttttatcggaagcgaaagtcgaagtttgcattatttaatcctcgaacagaattaggttataaaaaacgactcaccatttttaaaatggcgagcagtgtcctgcaccggtaatatctgatgcagtctgaaaaaacatttttaagcgaatatgatttttggtctcaaaataggctatatctatccacctccttatatgcagtaagttacagcagcgttacatatatagatttaaatgagaggaatgggcggcgaaaagactcaaaaactactcacaatcagtggcggattcgaatctccgaccggtggcggctaagtcggaaaatgatctgagtgagtcttcaagtctgatttttgcctctcgtgttttacttcttcctgaacgcttcgatgattccactaggagctggttggtctcctctgacaggtggactaaaactgaacctcccctgatggattttgcattggccataaggcgtctcttatgtggctaaaaattagtaaaatcagaaacttagctactcaagcttacttcaagtcgcttcgtttactgattaagaacctttactaaacaactcaaaagcaactcagcattgatgtgtttctgtaaagaattatgcatgtattgaaaagtatttcgagtagtttttgagtattttcctatatagttattgagtttattgaaaaactctttattaaacagagcattacgggatcaaaaaacccttcaaaagatactcattcgtgtatcatcttttgtttaacccaaattctttagtcacggcgttaactgggtaaaacgtaaccgatggacgggagtagactttggacacacctaataaaaacctcaaaaaggtattagaacttttagagcggaaaggaatcgacaagaggaagcaggcgtcaacaatggctgatatcctcagcattaaatatcaaagcgccaaacaaaagctcgatggtaaaagaggtgttttctacagcgagcttaaatctatttatgattattttcacgaatcgcttgaagaagctaagccgtataacggcatattcattgttaacgacatgcatgtaagatgtaatattattgtcagtgatgaaaaggttgatattaaagagccaggcattaattatgcatactttcataagaattattatgtagtaaacccaacaggcgtaaaattcagtaaagacatgaagcgggtattaagaatggattttttacctgcgcctaaactggcaatactagataacgataaagagttactcgaattattaaaatcagtatcgaacagatacggtattgatgcatcggttttcgagaccgcacaagaaattgtgcaggcggtcgacagagaagattatgatggatatgttattgactggttactggactacgacgaaaactctgaagcagtcatcaagaagatccgctctaaaagcgagaccgtgccaataatcctgcttaccggacaattgaatcagcatgagcgagagataggagaaaccatcatggaatacggagttgaactggttgaaaagccaactcgtgtttttatactttcctcaatattgctggcgaacctcttcttttaaatggtactgaaatggaattaattaaattaacggctgaacatataaaagaaatgtacgacataaggttttctgtcgctgaaaaccttgtccatgcacatcagatcgagtatctgcagcgaaacgtaattctggctgacgtcgcacagggtggcgggtggatctgcaaaactgacgatggctatgtaggttatggcctcggcattcacataccccatgcattgataggtggtctgtttgtacgaccagagtaccaggggcgcggagttgggggagcaatactggaaaaaatcactgagtggttttttgaactgggagacactgagattgaactaaccactgatgagcactcatctgctgctcggttttctatcaagcgagaggctggcacagttgcggtcacgatgaatatggacagttgatcatgaagaaaaggaaaatgaccaaatgaaattacttacagcgcttctgttttctctgatctcggttaaagcagcatatgctgactcctttgttctggcagacggcagtaaagagattcacgtctctactgaggatttggtcaagctaccagtaacttcaataaccacagccaccaatttcacaccaaaagctacttttgagggcgtgaccttcacagaactgctctctaagtactcgattaaagcatcatctctgagggtctacgcccttgatgactacagctacaccctgccagtgggagagcttttaaaatatcacgttatcctggcataccggaaaaatggtcaagtgatcccggtttctgaccttggaccctttgcagtaatctaccccagagatgagcatccagaactgaacaaattggaagtgaatgccaaaactgtctggcagataaaccggattgaggttattaaatgaaacgcagggtcgttcccgtcgtacttggcttagtactgactctttttttttcaggttcagttttttttactgttcagaaattcaacgagattaagaatcagtataagagtattgagccaaaccttgataactattcgacggctgaaatcctcttcctggcatttgaaagaacccggacatctgtttaccagacagaaacccctgacaacttcgaaacaaagaaatctgtctttgactctaaagttagaattcttaaaaacaaatcaatacgcataaactcattttattatgagccagatttccttagtgcacttaacctccttgaagagcaaagcaatgaactaagtaggcttaatgagtctacgccgcccacaaaacggaaagatgtactcttagagcaaatgaataagatgcagcctacgcttattaatttgcaggaaattatttataaaatccagataagaaactttaacacaataaaatcattgatactggataactcatcctacacagaacttgctgcactcttttgtattttccttctctttactttaatcattttactttgggttcatatcgttaaactaaactcagcgattagaggaaaaaacattttcatttcggccatttatcatgaattatctggctcaattcaaaaaatccaattatcttctgatatgatcaacgttaggggggatgtcttaaattcagaaaaatatcttgctaaaatcacttatcattcaaataagctttatcaacagaccaaagaaatacttgagttttctaaaatcgaaatcggtaatgttggtgtcaacaaccttaccttttatactgaagatgctttaaacgctggcttgtctctctacaatgaaagcaattctaataaaatagattgcagtgtatatccgcagaacactctcattaatgctgataaacaaaaaatcatatcaataattcataacataatagataacgcaaataaaaacacctatcacggcatcattaaagtacggcttagagtggcaaagtcgcacttctttttaagagtcagtgacactggctgtggttttgatactaaaaagctcaatcttctttttcagccattcaaccaaggtgtcgagggtgaaacacgacaggggctgggtctgggactgtcaattgttaaaagttatctcaaaacaatgaagggaagtatcactgcgcgttcgaaaataaatgaaggctcaacatttatgatcagaattcctgtaacagtgattgataaagagccttaagcgtcctgaaagaagtccgccacgcccggacttcttttccattactcactctcgtccggtttaacgaaatgcctgttatctgcatcgctttcggagttatctatttcagtcagatactggctcagcagggaatcaatacgctcagtgctccctcctcccgttgagttcacataaagctctgtcaccattgtcagtaatatcataatgccttctttactgccgctgactttacgaagcaattctcgattaaactctcgttgattaaacgtatcttctgtgtttttagctttgtgcataatcaggcctaacctgagtagttcgttacacgtggaagacaaactgacctcagcaggacttgctccgtttctgtatgtccagaagataaatatccctaatttccttctcaattttatctttaacgtagatacccattcttcccatctattcttctccagagtgtcttattttccatttaaaaaaaaactacggcttgaggcatctcatccagtacggcactgcagcgctagtctgcataccatttggtgcttatacaggtagtcgtaagcgacaccaatatgtcgtagggtgtgacactgtacgatatataacactatgattgaaatcattatcaacactcctacgatatgacatcgtagtaaactacgacaacaggtagtagaaacctacgataccatgtcgtaggaagcgacactactatgtcgtagaaacctacgataaaacgaactcacacaggttaatggctataaattttaataagtaatcatatgattttaaacaaaaaaactgcaagatgaaatcttgcgtggggtgtgatggaaattatcctatagagagcggcttgttaaataaacttatcttcctgaattctttatatccctgcccaagttcgtcatccacccctcagcgcaatgtgcgcgcctgtaacgaattaacttgcaagggaggatctgagcgcgtatttttcacacgaacccgcctggcgcattacgcgcacgcacgtgagattattaggatgaaattttttgctgctctcgcggctgtcgctgtattcagcgtgcaagctgcgccggaaatgtgtttcacaaaggccggtcaggatttcggtattgatccgcgtctgctgatggcgcattccattcaggaatcacatatgcgtaacaacgcactgaatactaaaagcagcggcggcacgcatgacgtctgcaatatgcagataaacagctctcactttaaccagctgaagaagttcgatattacgcgggaaagactgctgaaagatccgtgcatctgcatttataccggtgcatggatcgaggcgagaaacttcaggcagtacggcaggaactgggacagcgtcgggatgtacaacaccggcccgaacccgaagctaatcagacagcgtcgtgaatatgcggccattatcaaaagtatttaccgtgtgctgattgcacgggatgaggtttataccgcaatggcgcagcggaataaaaaagcgcccgcgccggaaacgtttctggctgcggacgtgatgcctgacaaaaaataaccccggcgcgccggggttattttcatgatttgagttttgcgaactcctccgccattttccacagcgcctgattcagctttatatcgccgtcgatgccggttaccggacgggtggtggttctttttcccttcgccgttctgccgggcacgccccccttaatcagattctcctgcacgatattaaacgcggtccacaggtcggtgcctttgtcataccaggcacgcggctgaataatacgctcagcggataccggcggctcttttccgtcatatttatattccagcgccagctgccccagcaggcggcgttcttcgctgttaacctgaatacctttcatcatgccgatattattttccaccttatcaaacacgcccagcacctcataagcgccttcaataacctgcgacacaatatcacctttgtgcggcacgctgatttcaccaaatgatttccagcacaccaggccattcgtgcagacctgccggaaaataccgggaatcattttataactgctggagccgtcatggctgttaagcaatacaatttccggcacctcttcgccgccgttgttatttccacggcgcaggcggatcatgtgtttggtaaattcacggcgctccggatcgcgcacgcgcgactggctggcaaaaaagggctcaaatccttcttcacgcaatttatccagcagggtaatggtcggaatataggtataacgctcagaacgcgaatcatgtttttcagcagaaaacgcgctcggaacaatgcgcatcagctcgtcgttattcagcgggctgtttttacggatagcggtcggggcggcatagcgggaagcaaaacggaccataattaattacctcttaaatttgagtgtcagcagtgaaataaaaaacggtttataaagcggccagcgcttcgcggaatatcaggtaaccggtgtcgtactcatacaacgccagcggccagccgttgtgcaggtaaacgatggccgcttcaggctcctccgtgggctcctccagcgcatcgagctcagccagttgcgcaccattaaccccgctgatgccggtgaacacgccgtgcctgtgcaggtgatcgtacagatcgcgaaactgcgccggactgagtgccccgccctgcttttcagcgcatgttttgggagattctggcgtggcggtgttgacgttgacgttctgtgtgttcatggcatttctcctgctcaggtgggttgtcatgtttcggtcgatccagtcgcggcagagggcaaaggagcaacggcaggcggcaggtgcaagggcgccgcaggcgtgcatttcacccttgcagctgacgaatgacggtgctacgaccagccctccgcgcctggactgaccggacaagcccgccgcgcgcgaaaacggcacgaacacaccccggacggctatgccggtccggtcctcagcggccccgtttcggggccagtgaacgcaccggcgaagccggttgcaggggttgcgtcaggatggaaacccgctggcccggaacgggtccgggcagagacggcgtgccggctctgtgcgcagcatgacagccgcccggacgcccggggagacagcatttcagtgcgtgggacagggcattgcggaacgccggaaagaaacataacgacgtggacgattcagacattactcctgctcatcgcctgacggcatccggacagcgctgaaagcgggggtgataacaggatgaaccctcagaatcatgcctagagatggcacctgcgaatgtgttcgcgttggaggcaggccggtgcgtcagcaccgtcttttatccggggccggacggccccgcggggttatgctgtgttgcccctgctcacgtgtccgcttcgcagccgtaatgctgtgcagccgaaaccagcagctcacagaacggcatgcccgttccgccacacaggtgcatcaggtcagccagcaagtccaccacggcggtggcggccggttcctcatcggcatcgaggccggtgcagcgggcaaaggtgacgagcgcggcggcggcggcgcctgcccggccagcgttgtctgcttcaggcggcatcccgtctgcgttctggtgcgccaggcaggcgaggtcagcaaacgtcatcgtgtcgtcagccatcagggaagtcgtggtgttctgcataatgtactcctctcagtcagggtgatcagggccggtctgaccggccctgcggcatcagatagtggcccggcgattccaggtggctttccagtcgatatagtttccctcgcgcagcggcgtcagcttcaccaggttttccgccagcccgttcatgatgaggatgcgctcaatcgcctcaaaccagccctccccgctgccgaccggaaaccacaggttagaattgtcaccgctgagcagcggatgatcgcagaagtggacgccccggccctgcggcgtttcacttcccgtcacgatgccggaggcgcgcaccttttcggtcagggcactgcgggccagccgttcagcgatatcagaccagcaccactctccgtccggcaccggcagctcagcatgccgcagcgactgaccgcccgcccgcgcggcaagccgggcgatatcggccaccccggcctctgcggtcgcgccgtccgcctcgcagatgtagtgcccgttgtgccagaaggattcggctccgttgtcgaggcggatcaggcagtaccgccccagcgcgcgggcgatatcctcatgcgtcaccggtgacgccgtaccggccggatgctgctgcacgatcatgctgctcatggctgcacctccagctggctctttacggtggtcatgaactgctgccacagcgaaaacggcatggcgggtacgtgtgccagccgtccgctgcgcagggcgtttacaaatgcggtggcatgtgcgacgatttgtgcgtcgaaaatcataattgcgtcctcgtaatactggttttgatgaggccgccagctcgaactggcgaccgtgaaaagagcaggctccggcctgctttttttacgcctgcggattgtcctgcgcacctcctgcctgttgtgtgacgtcagcggcaaggcggtctgccagcaggctgctggccctgccccatgccacctctcccgccgtgccgaagcggtcgtgtacgatgtggctcgccgctatccacgcgcggaatgagggcagcggcagcgcgccgtcccgtaccgtgtctgccacctgctgcgccatgtcgtgcagggtgaaccacaggaactcatgctgctcacgttcgctgaaccggctctgtgccagctccgtcagtgccttcaggctttccgccagctgcggcgctaatctgctgatcccggcgtctgctgcgttctgtgttttcattccgctccctcccccgctcacgcaatatccgccaggtgcattccccggcccgctttcagcagcattcccagctcgcggcaggccagccgccacgcctcttcaccggcgccgtcgcactggtcacgtaccagcggaccggcggcaagccacgcctgccaggccgtcaggggcatccgcgggcggtagcatgaccagtcggttacggcgttgcagacctgctcagccaggcttagcaggccgccgtaaagcagttctgcgcggtcatccagcgtcatgcgctccgtgcgcagcccggccagaaaagccaggtctgccgccagcgccggactcacgcccgcgagggtgtggccgttaacccatgttttgggagattctggcgtggcggtgttgacgttgacgttctgtgtgttcatggcatttctcctgctcaggtgggttgtcatgtttcggtcgatccagtcgcggcagagggcaaaggagcaacggcaggcggcaggtgcaagggcgccgcaggcgtgcatttcacccttgcagctgacgaatgacggtgctacgaccagccctccgcgcctggactgaccggaacaggcccgccgcgcgcgaaaacggcacgaacacaccccggacggctatgccggtccggtcctcagcggccccgtttcggggccagtgaacgcaccggcgaagccggttgcaggggttgcgtcaggatggaaacccgctggcccggaacgggtccgggcagagacggcgtgccggctctgtgcgaagcatgacagccgcccggacgcccggtgtaacggcttttgaccgtgcgggacacagcattccgggtcgattaaggggtctgtcgtggtgttgatgacgttgattttcagtaagaatccaggttttcatgcgcatacacgctgtcttttttccctgcagcgcactgcagggaagccatgatttatcctctcagacgtgaaaactgccagtgacagaacgggctgtattcgtcagccaccggcaggttctgctgcgcatatttactcagtcccccatgctcagaccagaacagttcaagcgctgcggcattcaggtcgccttcaaccttataaacgttaatcgtctggtattcagtgttctccgcatactcttcttcgccgatcggattagctgaatgcacgatccgcgtttcataagtctccggtgttgcgcctgccgccagggcatagacagaaaccgtgacctgcagtttttcgtgcgcgttaatcagcagcatctcaattcctgaacggaattttcccgtatgaaattccgcctcttcgcgcgtgaaggttgccgccatcaggaactccagattcatagaaaaatcgctacgcagcgccgccgtgttgacattgaactgcggacagtccgtgtaaaacagactgcggcgtaaagcgcgccgtatagcttcatagctgatctcttctgatggttttgccgtgaaagacgatgattctttagattctgcagccgtggtgttgacgttctgctgtgacatgttgtgtctcccgtgtggtttatctgatgtttctctgagttccttgccgtgaaggcagaacgggctcgcgggcatcaggctgaacgcagggggaaacggcaaagccgcagcccgcagggaccgggtgacgccgtttagcgtgcgtcccttgcgtgaagacggccgcgtgccaggtttctgcacggcgaagggattcaggaaactaaactgaacgcggaagatgaacagagcacagccccggacggcggctttttgccagtccggtcttcagcggccccgttttcggggccagtgaacgcaccggcgacagccggttgcaggggttgcgtcaggatggaaacccgctggcccggaacgggcccgggcagagacggcctgccggctctgtgcgaagcatgacagccgcccggacgcccggcacagcagcattctgtctgtgcggcacgggcagaaatggccgttatgatcacgtattacgccaggaaataagcctgaaaaggtggctgctggcaccgttctgatagttactgttataaggagcgatgcggccgccgcgccgtcaggcgcgagtcctgccgcctgcgcgccgaaggcgcagggggttttgcgcaccaggagggtggcggcgggcctccctgcccggccccctttgttactggtttatggcaaggtatgcgcgcctgagtgccgcctgaatcgcgtccgtttgtctgcctgcgcctgcatccggcagcctgcccgccgcctgcatcagtatttccaggtcaccggctgaaagggtcaccagccggctgcgctgtccggcggcgtagcggatattatcagccagctcgcggagggtttcggctcccacgcccgcctcgtgctgcgcatccctgtcccatgtggcgaggtcacagacgatttcggcggcggtttccgccgttacgtgctcctcccccataacccgtataacgtcttctttacgccagataatcagcgtgatcttcttatcgccctcaaactgaattttcaggtcgttacacagctggcttacggttccgtacaaggttctctccttaccggggcggccttgccgccccgtgctgtcagatatatgtttatttgccgctctgctctctcagcagcgcgctgatccgaaagagcgccgccgtttccgccgggaagcggcgggcagatgccccttctccgttctgcgcatcctcaagccgcatgaagtcccacgccactctgatcgccgtctcaagcgcggcggcgggcacggtcgccacgcgggcctgcttttcctcctcgcggatgttttccagcacggcctggagcgtttccagactcacgccataatcgtgctgtgcgtccagcccgctgatttgctgcacgatatcagcggcggtttcttccgttacgctttcgtcgtcaagaacggccagcacgtcctcttttgtccagacaatcagcgtcataagctcgtcagatttgtaacgctgtaataatcgggcgcagagttcgttaacggttccgtacatggttttttcctcttaagaggggcggccatgccgccccgtgatttatcagttcagggcgcagaaaatggcggcggcttcggaatgggttttcacatactccatcagctggcggtggcgctggcagaaatgcgcactcagttcttcgtcgtcgtggcggtcgtacagccagctgcgatggttaagaaccagcgccgtgatgatgatccccgccgcaccggcgctgatttccagctccgtccagtggtacggatttgaatacatgtagcgttcctcaccttccggcttcatgtatccgccgccgcccggcagctgtacgaagtcccagaccgtgccgtcatagttcgccaggtagcggctggcgtagaggtacacgttgttttcggcctgcgcgtaatcgtggccaaacagggaaggcagaaaacgcaggctgacaaaatcggccagaacagacgccggctgtaaaacgtggggttgtgtgttcatcagacatctccgcagtcagagggggttaaggttccggcctgtgccgtgactgaatgacagcccggcggaaagcgaagtgttcaggagcgacaccgcaggccgcagcgcaagcgagcgggagacgggattacgcacggcgctggcgcgaatttctgagcggcggcgcgacggaagtaagcgcggcggagcgagtgcgaacgggcgaggatggcgagcgaagcgatctcttgaacacgcagcggccgggctaaagtgaagtcacggcaccggccgcaccacgcacggaccgggttttctgccctgtcccgccgcatggcggaaaaaagcggcgcgcagcaacttccttatttcattctgtccacagtccgggtgcatagcctggcgataaccctgtggacaaaagcgcagcggcggcggtctccgcgcacagacagcaggcggtcataaaatgaccgccccgtccgttatttcaggtgcccgcgcatttcggcagcgcgccggtacagcgccaccagttctgtatcaatctgttcgatcagcatcccggccattttctgagccggcgccgcgccgcggaaaagatggcgttttgtcatgtcccgcagcctcaggtgaaactcgtaaagcgattcctcgaggtcgttaatgtcgtcggtaagctggtcgttgccggtcgtcagtgtctggtctgtcatggtggtgtcctcctggtctggttacggaaaaatacgttatgcggcatgagcggcacgggcggcgcgcagctcacccaggcgacgcaggccggccgtgtggtactgctccagcagttcgatcccgatccagcggcggccgcactggtcagccgcgacgcaggtcgagccggaaccagcgaaagggtccagaattaaatccccgggcttcgtgaaggtttcgataagcggctgcaacacgctcaccggcttttcggtggggtggtgccggttgcccgtgtactgccagggcatcacgtcgggtaaaggcttcgccggcagcggcgggcgccctttagccagcaggtaggcgctttcatgctgatacccgacaaatgccgatttcgatgcgtatgttttggtaaacacaaggtgcccgacgacgcgaaagcccgccgctttccatgcctgcataaagatgtccacgcggttccagccgtagaagctcaccgccaggctgttgtttttaagtacgcggaacatttcacggctggccggcagcacccactcgtcactcacgtcgttggcgatggaacggccggagcggtccttaaagccgacgaggtacgggggatcggtcagaatgaagtcgatgctgttatccggaaagccggccatgatctctacgctgtcgccacgcatgaatcgggacatagttatgctcctgagtgtcggggggcaccccagtggtgccgtgaccaccacaaagacgggcgtaaagcggagcaggcaggggcggacgcgcaagccgcacgcgccgccggagcggactgaatgtcccgcgcacggcggggaacgggtgagcaggacggcgaagcttcccttgcaggcgaagcggcccggctaccgtgagggcacggcactttatccctgccggtttccggccgcaggacgggaagcggcaaaagaggcggagcggagcgacttccttatcccttacagatgagatgccgccggccggggcggcatcggatgaaatatcagggccggtaatcttcccaccggcagtcgctgcggtcgcagatgacgggcgcatccggcgaaccgttcaccgtccactcatcgaggaaccgcaggccggccagcgtctgtgcctcacattcgtcaagcagaacgatgctcttcagccagacgctgccccgatcaaactgccagtagcagccctgagagcagacgggacgttccggcggccaccaggtttcccccatccgttcgcatgcggcttcggccagcgtaaagtcctgcccgctcagcagcaggtggtattcatgtgagtcgctgcccgcctcttcctgataactgaccagccagatgttcattcagtctccctccgggccttcacgctttctgcacagtcgcgcataaattcccagctgaggctgacgtcagcatccagcatcctgtccgccagttcgatcgctgcagtcacttcacagggcgtaagttccggatcaatgtcatcaaagtcgtccgccatccagacgtgggccacacacggcgtatccggggcaaatcccgacaggctggccatcaggcccgcaagggtgagttctcttttcatcattctcttcggcggggcttcccccgccgcctcccgtcagccgccataatggccgatgttgtttactatccagtccggcccggtcacgcacgtaatgccgtccccgtcctcatctccccactccagctcactgcagaggctgtcggtcagttcgccgtcgctgtaaacggcaaacccgcagaagctgcagccgctttcggcgtaccagtgctcagcctgcacaccgaaacgcgtactgagagcggcaaatacccggcaatccggcggagaccagggggtgtcaaaatccacctccagaaagcccggcccgcaatcacccacctccagtgcgtaccccaccggccacttcacgccgtactgcgcgatataaaactcatagccgcccggcacaccgtccagcaggccaccgttgaagccgttgatttccacatcgagacgggtgggaagcagcaggcgcatgtcaaactcagccgaatcctctgcagtaacatcgctatcgcacgtgcggctccagaattcgctcagattgctcccgctcacgcctgaccagtcgaaagacttacgctgccaccgggcatccattactgccctgacctcatcatccagcgcatcccacgtgcggctgcggagtccggtggccagccacaggtcatgcagccggtcacaggtttcgtccgtcagttctgcgccgtcgcgcagctgcgcgagccactgcgtaaaggcgcggttttccggcgaatcttcgccctgccccgctgccgtcagcgccgggaaaggtgcatacgtttcgttcgtcaccgggcgcagcagaccggcacagcccgccaggaacagctggataccctctctttccgcccgcgcatatgcaggacgcacctctccccgcatcagcgcccgcagctgactcacattctccgccaggccggtcacacgcagcctgtttgcacaccagttcggcatggttctctcctcagtcaatggttgcacggcctcacctgcgccgtgccgccacagcagacgggcgcaaagcggagcaggcaacgggcgaaggaggaagccgcacgcgccgccggagcggactgaatgtcccgcgcacggcggggaacgggtgacgagagaggtgcaacggacccttgcctgcgcagcggcccggctaacgtgaaggcacggtgcagcccggaaaggagtaaagagagcgtctgaggatgagggaggatttccggcgtcaggcaacgccggcgcgccggttaaaagcggagcgtagcgacggccttaagagaagtgacgcggaccggacgagagcacggtgaacagccattcctgtcatatgtctgtcacagcacgctgatgaactggccctgctgaagatggtattcgtaagatgaataacgcaacactgcatttgcctgtccggtatacgccgggcgggcttttttatgcccggcatggccactcaggcgtgacgcgattcagcgcagtgcaggatcgtcgttatcagcctgtgggtgtgaatccaggcgggcccacagcgattgccggctcagccagaacccgggcgaatgaaatacgcggcccggccccggatcaaatgaggaacagagaaaaagccggcccttaaaacgtgagcacgcaacgctcgccgcagtgacggctgaggcgtaccgcagcagcgcgaggaacgaacagccgtggcgaggaagcgtcatttcacctttgccggcagaaactgcttacgcgctttctcaaaaaaatgcctggttcaggaagtccgcagacagatccccgggtgactgaatcaccttccgggagcccggtggcacctttattctgcccgttgtctgacgtgatgctgctgaaagtgcatgatggtaaaaattttccattgataatcagccagataaaaccgtatctgagtgatcctctgctgctttttcttgccagataaatttcgcccaataatactgtatataaaaccagttaattacagaggaggaatttatgcaccacttacatacagcacatatcccgtcaccggtattttcatcccggagcgtcctgtgaaacccgccgtgtacggctcaggcctgatgctgctctggcccccggtcttcaccccccgtgtacgcgtgcccctctatgcagatccctgtgcggcaggctttccttcgcccgccgcagattatgttgaggctgaacttgaccttaacgagctctgcatccgccggcgcgcctccacgttttttgtgcgtgccagcggcagcagtatgcaggaactggggctgtgtgatggcgacgtcatggtcgtcgatcgcgcagaagaggcctcgcacggagacatcgtcatcgctgaggttaacggtgaatttacggtcaagcgcctgcagcttcatccccgtctggctctcctgccgatgaacccggcctactccgtcatttatccggaggagctgcagctgctcggcgtcgtcacctggttcttcaacagtacaaaagcgcgcaggaggtagctatggcgctgcctatgttcggactggcgg

SEQ ID NO: 24 - DNA, 445192 bp, Pseudomonas poae FL10F
gctacgagttttgcttgctctgtgtacttacccatgacgcccccaaaggttgtgtccagcctttgggggtcagttcactctgcgtgggaatgccgcctgggacgctccgcgtcctgcctgcattgtggtgacgcagagcgtcacgggatgcgttcccacgcggagcgtgggaacgatcagtgcagtgatcacaacttcgcgatcgacacctcggtcgatttaacgaacgcaatcacttcactgccaatcaccaattccagctctttgaccgagcgagtggtgatcacagacgtcacgatgccggacgccgtctgcacgtcgatttccgacagcacgtcgccttcgacgatttccttgatggtgcccttgaactggttacgcacgttgatggctttaatagtcatggtgtttttccttcatgggacaagtgagttattgagcccaacgcaattgcgtaggcagcggtgaaacaggttcgggttccggcggcgtgccgggcaacgacagcacacggttgagcacttcggcttccagcgccgccagacgatgtgagccccgagcgcgtgggcgcggcaggtcgacgatcaggtcgaggccaatctcgccgtcttcgataaggatcacccggtcggcaatcgccacggcttcgctgacgtcgtgggtgaccagcaacacggtgaagccatgcttctgccacaggttttcgatcagttgctgcatctcgatgcgggtcagggcatccagcgcgcccagcggttcatccagcaacagcaagcgcggttggtggatcagcgcacgcgccaaggccacacgctgcttctggccgccggacaaggccgctggccactcattggcgcgctcggccaggccaaccgcttccaaggcctccagcgcttttggacgccagttgcccttgagccccaggcccacgttgtcgatgatctttttccacggcagcaggcgcgcttcctggaacatcaaccgcgtgtcttcaatggcttcgctcagcggcgcggagccggccagcaattcaccgccgctggctttgtccaggcccgcgagcaggcgcagcaaggtacttttgccgcagccgctgcgaccgaccaccgccacgaattggccggctggaatgtgcagatcaatctctttgaggacttcccgcgcaccaaaggccttgcgcaatttgcgcaccgccagcggaatgcccttgagcaggcgcggaggttgttgagcggtcatgccgcacctcctttattcacttggtaagccgggtgccagcgcagccacacacgttccaggccacgggcagccaggtcggccagtttgccgaggattgcgtacatgacgatggccaagaccaccacgtcggtttgcaggaattcgcgggcgttcatcgccaggtaaccgataccggaactggccgagatggtttccgccacgatcagcgtcagccacataaagcccagggcaaagcgcacgcccaccaggatcgacggcaatgcgcccggcaggatcacctgacggaacaggctgaaaccggacaagccgtagctgcgcgacatttccaccagcgccgggtcgacgttgcggatgccgtggtaagtgttcaggtaaatcgggaacagcgtgccgagggcgaccaggaaaatcttcgccgtctcgtcaatgccgaaccacaaaatcaccagcggaatcagcgccaggtgcggcacgttgcggatcatctgcaccgagctgtccagcaagcgctcgccccatttcgacaggccggtgataaagcccagggccagaccgatgctgccaccgatcacaaagcccaggccggcacgccagccgctgatggccaagtgtgtccagatttccccggtacgaaccaggttgatcccggcctcgatcacggcgctcggcgccggcaggatacgggtcgacaaccagcctgccgacactgacaactgccacaccgccagcaacaggatcggcagaacccaaggcgcaacgcgatggcttaatttttcaaaattcatgactacgcctcagctctgcgacgcagctttgggaaggatgtcgttggcgaccatttcgccgaacgggctgacgtaaccggcgctttttggcagctcgggacgttcgatgtccaggtgcgggaacagcagctcagccacgcgatacgactcttccaggtgggggtaacccgagaagatgaaggtgtcgatgcccagcgccgcgtattcattgacgcgtgccgcaacggttggcccatcacccaccagtgcggtgcctgcaccgccacgcaccaggccgacgccggcccacaggttggggctgacttcgaggttgtcgcggttgccgccgtgcaaggcggccatgcgctgctggccaacggaatcgaagcgcgccagggaagcctgggcacgcgcgatggtgtcgtcgtccaagtgggagatcagtttgtcggcagctttccatgcctcttcgttggtttcgcgcacgatcacgtgcaggcgaataccgaagcgcaccgtgcgcccaagtttcgcggccttggcgcgcacctgttcgattttttccgcgaccgcagccggtggttcgccccaggtcaggaccatttccacctgttcggctgccaggtcctgggccgcttcggaggagccgccgaagtacagcggcggacgcggctgctggatcggcgggtagagcaatttggcgcctttgacgctgatgtgctcgccgtcgtaatccacggtttcgccttccagcacacggcgccagatacgggtgaattccaccgaggcctgataacgctcttcgtggctgaggaacagaccatcaccggccagctcttccgggtcaccgccggtaaccaagttgaacaacgcgcggccgccggacagccggtccagggtcgcggcctgacgtgcggccaccgtcggggaaatgatcccggggcgcagggcgacgaggaacttcaaacgctgggtcactggaatcagcgaggcggccaccagccacgagtcttcgcaggaacggccggtaggaatcagcacgccgccgaaacccagccggtcagcggcctgggccacttgctgcagataaccgtggtcgacggcgcgagcgccttcggcggtgccaaggtaatggccgtcgccgtgggtaggcaggaaccagaaaatattgaggctcatggagttgtctcctgaagaagtcggattacggcgctttggcaacggcggcgggtggcgtccagatcacgtccttgatgctcaagggtttggggatcaatttgagttggtagaaggcgtcggcgattttctgctgggcagcgaccacttccggggtcaggaacagcgcgccgtagccttggcgtttcaccgaggtcagggtgatgtcagccggcaagccaagcagcggtgcgacttgttcggtgacgtccgaagggttggccttggaccattcgcccaccgcgcgcacttcttcgaccaacgccttgatcacctgcgggtgctgttcggcgtacggcttggtggccaggtagaactgatggttgtcggcgatgccggtgccgtcacgcagggtgcgcgcctgcagttgtttctcggcggcggcctggtacgggtcccagatcacccacgcgtcgacgctgccacgctcgaacgcagcgcgggcatcggcgggcggcaggaagatggtttgcacgtcggtgtatttcaggccggcatcttccagcgcacgcaccagcaggtagtgcacgttggagcctttgttgagcacgattttcttgcccttgagctcggccacggatttgatcggcgagtctttcggcaccaggatcgcttcactggtcggcgctggcggctcgtaggcgacatacagcagatcggcgccggcagcctgggcaaacaccggtggggtttcgccggtgacgccaaagtcgatggagccgacgttcaggccttcgagcagttgcgggccaccggggaactcggtccattgcacttgcacgccttgggcggccaggcgtttttccagggtgcccttggctttaagcagcaccagcgtgccgtacttctggtaaccgatccgcagggtttcggcggcctgggcttgaacaatggcgccgaaggacacagccgcagcaaacagtgcgaccagaccacgacgcaagatgacagtgcgcatggcgctctctccaaaaatgcgatgagggggttggctgcacctgcttggccgttggcggctgagtaaggtgagtactacaaaatccggtacggcttaaatgctccagcgagcactcaacaaacgttcattcaacacatgggggtcaagcggtttcgggcgacgggccatggcgtcgtagagcgtttccagggcctcgtgcaaacgctgttcgagcactggcaccagttgcgcctgggcgctgccttcggcgtaggcgatctggctgtcttcggcaaaaatgccgtggagcagttcctgggccttgagcgccgacaacaccggcttcaaggcgtaatccaccgccagcatgtgggcgatgctgccgccggtggccatcggcaatacgatcttgtgcgccagggcgcgctcgggcagcaggtccagcacggttttcagtgcgccggaaaacgaggccttgtacaccggcgtggcgataaccaggccgtcggcgttggcgacttgttgcagcaggtcgatgactttggggctgtcgaagcgcgcatgcagcaagtcttcggccgggaagtcccgtatctgataactcaccacttctacgcctttgtcttgcagccactgacgggttttttccagcaagaccccggagcgggaacgctggctggggctgcctccaagtgttacgaccagcatgcaggtattccttgagcaagtgtcggcggttcgctgtgtggcgatggcgccaagatgggacagaccatatcaggtgatttatatatctataaatcttattttttcatttgtttattctaaaaatgcatatgaagattattaatctcaaggcgaaaaaaaaggccgtcgaaacggcctgaaaacccctgctatgtgattcggttttaactcaaattcggtggtgtatgtaccgccgccatcgcgggcaagcccgctcccaccggggaatgcggtcaactgtgggagccgggcttgcccgcgatagcggtttgagcctcagcggttgggctgtggggtgaggcgcaggtacggcttcacagcgcgatagcccttcggaaagcgtttcttgatttcttcctcgtccttgagcgacggcacgatcaccacttcatcaccgtcctgccagttggcgggcgtggcgaccttgtggttatcggtcagctgcaacgagtcgatgacccgcaggatttcatggaagttgcgaccggtgctggccgggtaggtaatcgtcaggcgaatcttcttgttcgggtcgatcacgaacaaggagcgcacggtgagggtgtcactggcgttcgggtggatcaggtcatagaggtccgagactttacgatcggcatcggccaggatcgggaagttgacgagggtgttctgggtttcgttgatgtcttcgatccacttgtggtgcgagtccaccgggtctacggacaaggcgatggccttgacgccgcgcttggcgaattcgtccttgagcttggcggtgaagcccagctcagtggtgcacaccggggtgaagtcagccggatgggaaaacagcacgccccagctatcgcccagccattcgtggaaacgaatcttgccggcgctggaatcctgttcgaagtcgggggcgatgtcgcccagtcttaggctcatggtgtggctcctgatgggtgcttatggagcccactgtgcatgggttgcggattatttaaaaagaataaatatcgatttatttagaagataaacgaatattaaaaatcaattcattggacgccggaaacggcgaggatcaacatccacttcaaggttcgagaaggccttgagacgctgtacaaagaggggattcaggaagggcttgcgggggttgagcccgacttgaaagtaaaacaccctgcccggcgttgcgccgggcaaggtttacagtcttacaacagcttcacgctactagaacagtggcagcgagtagctgacgatcagacggttttcgtcttgatcacgcgcgctggcgatatcggtacgccacatagcgtttttccaggcaacgccgaggtttttcaacgggccttctggaatcacgtaggcaatagtgatgtcacgttcccactcggactgaccggtgaattccttacgggcagtgttgacagtatcgatatcgctgcctttgaggtagacgacacctgcggtcaagccaggaacaccgaccttggcgaagtcataagcgtaacgtgcttgccaggtgcgctcgccggcacgggcgaacttctggatttgcatgtcagtggtgatgtaagccgacgaaccgtcgccttggttcaaccaagggaagtcgctgctaccgttgctgacctggtaaccgccaccgaaggtgtgaccggaaacgctgtacaggaacaagccgctgtacaggttattgtcgaccttacctttaccggcggagaaaccactgtagttaccgctggagaagtagctggaaatgtcgccgtttttaccgtcgtcagtgctgtggaaataacgcagatcagacttcagtacgcccggcccgatggaccagttgtgggtcagacccaggaagtgctgcttgtagaagtcttccaggttgccgtagtagtactgggccgtcaggtccttggtgatcttgtagtcaccaccgccgtagtagaacttattgctgaacttgcctacgttgtagttcgagctgccgttggcaccaccgatggacaagccttcgttgttgctggagttacgacctttggcttgttcgatctgaccgccaaccagggtcaggtctttgatgtcgttggtggtaatttggccaccctggaacgtttgcggcagcagacggccatcgttggtcacgataactggcagcttaggttgcagcgtgcccagcttcagctcggtttgggagattttgaccttaccggtcacacccaggctggcgtaatcgtggacagctttgttgccgtcgcttgggaaaacagtgccgcctgacagcgtaccgttgtagttaccgtggttttcacggctggagtccaagcgaacgccatacaagccgatagcatcaacaccaaattgcacggtgccttgggtataacccgagatgaaccgcaggtcgaagccctggccccattcagcgttcttgctgtggctggtggcggaatccggaccgttgcggttgtcggtgttgatgtaaaagttacgcgcactgagtgtggcgtgactgtcttcgataaaaccggcagcgcctgcttgctgagcgattgcgcccagggtcacagccaacgccaatgttgacttcttcatgtaccgctcctctcatttctaatttttgtatttcttaggtcctgggtctgacgccccggatccacagatgcgcgattagcgccagatagtgactaccaagtcaatcgtaactttgtatgtctactaccttcgtctaatcgcagttgatttggtccctgcagggtaatgagtttttcatacacccaaaaagaattgtttcattctttttcatacgattcaggaataagcctttgcatgaggcgagccgatcagcgtagaccaaccactccataagctaattactaaatggtatttactcgcctttttttagatcgattagtgtggccgtactgttgcatacgtcacccacgatcaaaaaggcgacgccatcatggccaaaggcacatcctcccgtcaatttgttacagtttttgtgtcactaattctttcttttggtgtcaaagcggccgatttaaccatcggctaccaaaccggcatcgaccccagcaaggttccgcaggccgatggcctctacgaaaaggccatcggcgagaagatcgcctggcgccgattcaacagcgggcccgaggttgtaaccgcgatcgcgtccggcgatgtgcaaatcggcaacctaggctcaagccccctcgcagcggcggcttcacgcaatctaccaatcgtggcctttatcgtatcggcgcagatcaatgcttctgaagccttggtggtgcgtaacggcagtggtattgacaaaccgcaggatctggtcggcaaaaccatcgccacaccgttcgtctcgacctctcattacagcctgctcggcgcactgaagcattgggggctggacaccaggaaagtcaaagtggtgaacctgcaacccgccgaaattgccgccgcgtggaaacgtggcgatatcgacggtgcgttcgtgtggtcaccggccctgggcgaaatccgcaagaccggcaaaaccctgacagacgcggcccaggtgggtcagtggggcgcgccgacatttgaagtgtgggtggcgcgcaaggatttcgcagaaaaacatcctgacgtagtggccaagtttgccaaggtcacgctggattctttcgccgactatgccgcgcataaagacagctgggcggtggactccgagccggtgcagaaaatcgccaaattgacaggttcaaatgccgccgacattccagagcttttggccggcaccactttcccggatgcccaggcacaacaaaccgatgccctgcttaaagggggcacggcgaaggcgattggcgagacggcgaagtttttgaaggagcaagggaaggttgaaacggtgctgccggattactcggcctttgtgactgataaattcatcagccaataaggtaatcaaatgtgggagctggcttgcctgcgatagcatcacctcggtttatctgaaaaaccgagtcgtctgcatcgcaggcaagccagctcccacatgagccagctctgtcttgggccgaaagaacgagcttacagcgccttctcaaaaatcttcgagttacgctgatagttgtacagcgacgcccgcgccgatggcaggcggtctacgctgctcggctcaaacccgcgctcacggaaccagtgcgctgttcgggtggtgagtacaaacaacgtcttcaaccccttggcccgagcacgggtctcgatgcgctccagcaacacatcgccgcgtgcgccgtgacgatactccgggttgaccgccaggcacgccagctcacccgcatccgaatcggcgatctgatacaacgccgcacaggcgatgatcatgccttcgcgctcgaccacgctgaactgctcgatctcacgctccaacacctcacgcgaacgccgcaccagaatgccctgctcttccagcgggctgatcaggtcaagcaacccgccgacgtcttcaatcgccgcttcgcgcaccagttcgaattgctcctgggccaccaacgtaccgccaccatcacgggtgaacagctcagtgagcaacgcgccgtcttcggcgtagctgacgatatggctgcgccctactccgccacggcacgcttcggcggcagcatcgagcagttcagcttgatagttgctgcccaggcgttgcaggtgcgccggcacttgttgcgggcgcagctcacggaccagacgaccattttcgtcgatcaggcccaggtccgcgccaaacagcagcagcttgtcggcgcccaagtcgatggcggcgcgggtggcgacgtcttcgcaggccaggttgaaaatttcaccggtgggcgaataacccagcggcgacagcagtacgatggagcgctcgtccagcaggcggttgatgcccttgcggtcgacccggcgcacttcgccggtgtggtggtaatccacgccttcaagcacaccgattggccgcgccgtgaccaggttgccgctggccacacgcaggcgcgagccctgcatcggcgaggaagccatgtccatcgacaggcgcgcttcgatagcaatgcgcaggtgcccgaccgcgtcgatcacacactccagcgttgccgcgtcggtgatgcgcaagccttcgtgataagccggggtaaggccgcgcgcttcaaggcgcgcttcgatttgtgggcgcgaaccgtgcaccagtaccagccgcacgcccaggctgtgcagcagcaccaggtcgtggacgatattgccgaagttcgggtgttccacaccatcgccgggcagcatgaccacaaaggtgcagtcgcggtgggcgttgatgtaaggcgaagcgtgacgaagccaattgacgtattcgggcataaaacctgggcctgtaataaaaagcagccaaaaaaggatgaatcgcgaaagcgcacagcgggctgatggttatcgtcggaacaggcttggcgacacgctcgctctccttatgtacgaatgggcgggggttaatttatgcaggtttcaggcagtaatgttcgatcagttcccgcaatagacgcactgtaggcgtcaagcgtgacatttcgaggtactcgcccggctggtgggcgcaggcgatatcgccagggccaagcaccagggtttcacaaccaaggcgctgaagataaggcgcttcggtgccgaacgctactgcttcggcacgatgaccggtcaatcgttccgcaacccgcaccagctcggcgtcttcggcctgttcgaacggcggcacttcggggaacaaaggcgcgtagtcgatcttgaccttgtggcgctcagccaagggttcgagcttctgccggatggcatcgcgcagcacctgcgggtccatgcccggcaaggggcgcaggtcgaattccagtgagcattggccgcagatacggttggggttgtcgccgccgtggatgcagccgaagttcatggtcggttgcggcacgctgaattgcgggttgcggtactcgcgctgccacgccaggcgcagaccgcgcagctcgccgatcgcatcgtgcatggcttcgagggcgctgtggcccaggcttgggtccgacgaatggccgctttggcccaggatgtcgatgcgctccatcatcacgcccttgtgcaggcggatcggcttgaggcctgtcggctcgccgatcaccgccgcgcggcccaacgggcgcccggcctcagccagcgcgcgggcgccggacatggagctttcttcatcgcaggtggcgaggatcagcaacggttgtttgaagggctggtccagcaagggcagcacggcttcaatggccagggcgaaaaagcctttcatgtcgcaactgcccaatcctacccagcgaccgtcgacttccgtcaacttaagcggatcggtcttccacagcgcggcgtcatagggaacggtatcgctatggccggccaatacaaggccgccagggccgctgccgaaactggcgagcaggttgaatttgccggggctgacttgctggatgtcgatggcaaaacccaggtcgcccagccaaccggcgagcaggtcgatcaccgggcggttggtctggtcgagagacgcttgggtgcaactgaccgacggcgcggcaatcaacgcggcgaactgctctttcatagtaggtaacggcatgcgcggcctctcaacgtcccggatgagccccactatagaaccatctgcacgacacaataaaccgttgcggcgcgttgccgggctcagtcctgtacactgcacgaccttggcagccactcttttccccggctgcgctcccgatcctggattttccggccatgcagaaagaaaccgaaatcaagctccgcgtcagccgcgaaacactcgccgcgctgcgtgagcacccgctactgaaaaaacgcaacaaaagtggctgggaacgccgtgagttgatgaaccagtatttcgacacccccgagcgcgatctggcccaggccaaagtcgccctgcgcttgcgcaaggacggtgatgaaatcatccagaccctcaagacccgtggccaaagcgtcgccggcttgtcggaacgtaacgaatacaactgggacttgcccaaagccaagctcgacgtgaagaagctcgacggcgagtgctggccagagcaactggccgagctggacaaaaagaccctcaagccgatcttcaccaccgacttcgtgcgtgaacgcgccgaaatcgcctggggtcgtggcaaggccaaagtcgtgatcgaagccgccctggacctgggccatgtggtggtcggcaagcagaaagaagaaatctgcgagctggaactggaattgcgcgaaggtgaaccggccgccctgctggaactggccgccgagctggccgccaccctggcgctgatgccgtgcgatatcagcaaggccgagcgtggctaccgtctgtatgacgccagcagctactcgctgagcctgccggcgccgcagatccacgccgaaatgccgctggacgacgccttcgccgcgatcatgtggcacctgctgggcagcagccagcgtctggccgagcaataccgtttcaacggccactggcgcctgttgcaggactgggtcgacaacctgggtgaattgcgcgcattgatcggcagcctcggccaggcagctccgcgtcaatccaccagcgaactgcgcagcgcactcgacgcgttgctggaagactggcgcccactggtgcaggccggtgacgacgacgaagacatccgcaaagccgcaccggaacagtttgtcgaagaactggaagacgtgcgctggggcttgttctcgctgaacacctcgcgctggctgctggcccgcacctggaccgccgaccgcaacgtgcgtggcaaccgccagggcgctgcgcaaatcaccaactggctgccacgcctgctggctgacgacgccgttgccctgcaactgtcgcgctatcagcagcagccggaagacctggccgagcaactgccgcgcatcgaacgcatccaggcctggctgcaccacgcgcgtcaggtggtggacatcccggagctggaccgtttgtatggcgagctgaacaagctggccgtattggctaaccagccgatcaccgacgagtcgctggatgcgcgtatgcatcaggcgattgcggtgtatcagaaccgcgcgtggaagacgttgctgcgtctgtaataccgggcaactcggtcaaatgtgggagcgggcttgctcgcgaaagcggtggatcagtcgacttcttggtaactgacacactgcattcgcgagcaagcccgctcccacagtcaacgcaacactggcaagctggtggtggacttgatctccgacaaggccacaatcgaattcacctcctgaatccccggcaccatcgacaacttctcgaagaaaaaccgctcatacgcctcaatgtccgaggttacgatgcgcagcagaaagtccaccgcccccatcaacacataacactccaacacttccggaaacccgcgaatcgcttcggtgaactctgtgaagttggatcggccgtgggcgttgagtttgacctcggcaaaaatctgcgtgttgaggccgatcttcttgcggtccagcagggtgacctgaccacgaatcacgccttcttccttgagccgctggatgcgccgccagcacggcgattgcgacaggccgacctgctcagcgatctgcgcgctggaaagcgaagcgtcctcttgcagtaacgccaggatgcggcggtcgtaggcgtccaattcgctgtgcataaaaatacccgtgaaagtgcttaacttgaatcgctttagtctattttctgctgatatggcccatcttagataagaaatctccccaggcgaatgtaaaaatttctccagtcgaatttggagagttagcatgcacgccgtcgaaaccacccaccctgcaacccgcgtcgatgcgtgggccgtcaacagcgcccagtgtcaggcgcattatcaaatcatcgccgaggcagaaccggatgtgctgtgccgggtacttaactatttcgcgctgcagttcctgacgccgcaacaggtcaatgtgaaccgcgaagatgacctgttgaacatagaaattgtgatggacggtttgagctggcaccgcgcgcaagtgattggtgaaaagattcgaaacctgatcagcgtgtgttcgctggagctgtggccagctgattgtttgcggcctgcggcggtggcggcggccagtctgtaaaaggctgaaatacaccctgagcggcgttttttcaggggctgactagcctaggattacgcccgacgccacccaggaaatccgcatgcccaccgctttgcacgatcacccgctggaactgcatgagttgctgcctgacctggttgaacaaaggctggtgacagcggacatggcgcaacgcttggcgacggagccctccactcaacatcctttggaatacattgcggcgctggggccttgcctggaaaggctgactcaatggttggcagggcatgtcgggcagccttatctgcgtatcgacccgctgaatatcgacgtggcgacggtggtgccattgatgtcccacgcgtttgcgcaacgccatgccattcttgcggtggctgtggatgcacagaccgttaccgtcgccagcgcccagccctatgtctgtggatgggaggctgggttggcgcaagtgctcaagcgctcgatcaaacgcgtggtcgccaaccccaaggacattcagcgttgcatcgacgagttttaccggttggccaagtcggtcagcggcgcggatcaaaaggtggcggtggcgggcaacgtcgacctgctcaacctcggcgccggtgacaaggaaccggacgccaatgacgcgcatatcgtcaatatcgtcgactggctgttgcagtacgcctttggccaacgggccagtgatatccatattgaaccgtgtcgcgaacagggccgggtgcgttttcgcatcgacgggttgttgcatgacgtctatcaattcccgccacaagtcaccatggcggtggtcagccgcctgaaaagcctgggccggatgaatgtggcggaaaaacgcaaaccccaggacggccgggtcaagaccaaaagcccggcgggcgtcgaagtggaactgcgtctttcaaccttgccgacggcgtttggcgaaaagctggtgatgcggattttcgacccacaggtgctgctcaaggattttgaccagctaggcttgtcgtctgaagaccagcagcgctggcatgccatgacccgtcaggccaacggcatcatcctggtcaccgggccgaccggctcgggcaaaaccagcacgctctacaccacactcaagcggctggcgacccgcgaggtcaacctgtgcacggtggaagacccgatagaaatggtggagcccgccttcaaccagatgcaagtgcagcacaatatcgacctgaccttcgccagtggcattcgcgccctgctgcgccaagacccggacatcatcatgatcggtgagattcgtgaccaggaaaccgcagaaatggcgatccaggccgcactcaccgggcacctggtgctgtcgacgctgcacaccaacgatgcacccagcgccatcagccgtttgcaggagctgggcattgctcattatttgatcaaagctacgctgataggggtgatggcgcagcgcctggtgcggcttttgtgcccgcactgcaagcgtgcggcgaatactgcgggcgatgcgcatgaggctgtcggctgtgcgcaatgccgtgacagcggttatcgcggccgggccgggctctacgaaatcatggtggtggacgagaagctcaaggcgctgatcacccctggcgccgacgtgcaagctctacgccgtgcgtcgctggcgcaaggcatgcacagcctgcgcatggccggcatcgacaaagtcaacgccgggctcacaacgctggcggaagtattacgggtaacgcctggggattcagatacaaatgcttttattgttgggccgtgaaaccgtccttatctgtgaccagaccgttacaatcgaccgaacgttgtttcactgacaccatcagatagggaatcgcaatgcagatcggaaccgtactgcttcttttcgtgggtttggccgtggccatcctgttcatgggttttaaagtggtgccccagggctaccaatggacagtcgagcgtttcggccgctacaccaacaccctcaaacccggcctcaacatcatcatcccggtcatggaccgcatcggtcgcaagatcaacgtgatggaaagcgtgctggatatcccaccccaggaagtgatcaccgccgacaacgccaccgtgcagatcgacgccgtgtgcttcttccaggtggtcaacaccgcccaggccgcctacgaggtcaacaacctcgagcatgccattcgtaacctgctgcaaaccaacatccgtaccgtactcggctccatggaactggatgcgatgctgagccaacgtgacggtatcaacgaaaaactgctgcgcaccgtcgatgaagcaacggcgccttggggcatcaagatcacccggatcgagatcaaggacatcagcccacctgccgacctgatggccgccatgtccggccagatgaaagccgagcggatcaaacgcgcacaaatcctggaagctgaaggcctgagagcctccgccatcctgactgccgagggcaagaagcaggcgcagatcctcgaagcagaaggtggccgtcaagccgcgttcctggagtctgaagcccgtgaacgtcaggccgaggcggaagcccgtgcaacccaagtggtctccgaagcaattgccaccggtaacgtgcaggccatcaattactttgttgcgcaaaaatacatcgacgccttgggtaaactggcctcggccaataacagcaaagtcatcttgatgccgctggaagccagccaagtgattggtgccgtcggcggtatcggcgaaatcgtcaaggcaaccttcgacaacaagaaaggctgaggccatcgccatgtgggatttcctgcagcatctgtcgttctgggattggctggcactggggacggtgctactgattcttgaggtgttcggcgccggtggctacctgctgtggatggggatcgccgccgccgccgtgggcgtgatcaagttcctggttccaccgctcgggctggaatggcaactgctgctattcgccgtgctatcgatcctgaccgctgtgtactggtggaaacgccagcgcagcagcgccaaggtcagtgaccagccggggctgaacatgcgtggctctgagctgatcggtcgcacctttatggtgcatcaggcgatcattgatggccggggcaagataaaagtcggtgatagcgtgtggatggcgaccgggccggacagtccagtaggcgctcatgtacgtgtcactggtcaggacggcgtaattttacaggtcgaaactgtttagtcagtgatggaactcggctgggctatctacaatcaaactgttcagataacccagtcggagtcacccatcatgcgtctcaaatatgctgtcgcaaccctcgctgtgctttcccttcctgtcggctcagccatggccgacagcttctggcgcaatgtcatctcgtccggcgctactaccggctcgacgtacctgacgttcaaggaccacaagctggtggtcgccgctcaagacgacgcaggcagctttgttgccagcgacggcggcatccgcggcccatacctggaagccgccatgcagaaagtacgcgccgataatcctggcttacaagccactgacatggaattggccaacgccatcctcgccaaaaatgctgtgaccgagtaacaccgccctacaaaaaatgccgctccttgggagcggcatttttttgcgctttttcctacgatgacaggaagagagttgctggctgaacaggaaatctcctgtcgatcactctgcacatcaaacaccattctaccgattccctttttacccggtgaatcgactcccatgcgtaaattctcgtccatgctgctcctcgccgctatcgcgacaccttatgctcaggcagaaggctggtatggctcggccaagctgaacagcgcccgccagaacctttccagcgcacaactgaccagcccacgggtgactgatcgggtggaggcacctgatagcaacaaagcattcactggctcattcgccgcaggttacgcctttgcggatggctggcgcctggaaggtgaatacaccacacgcaacagctcgacgttcgactcctattgggcgcccttcaatgccaacgtcaatcgcctggaagtcgacagccagcgcttgatgctcaatggctataaaaacatcccgctcaacgactggctgtcgttttacggaatggccggtataggcatggcgcaaattgatgctgaaggttatcagggcaaccctaaccgtcagttcgccagcaaccgccaatacaatttcgcctacagcgttggcttgggcctggatgccaaggtcagcgaaaaagtcaccctgggcaccggttggcgttacgtggacatgggcaaggtggagaccggctacaacaccttcgctaaccgcataaacgcccgcgatgaacagctcaaaggcaagctcaaagagcaaaatgtgtttcttgaggctcgcgtcgccttctgacctgctgaaaaaaatgccgctgataaagcggcatttttttgtacgcaacatgacgattcattcacgggcgacaggctatattcagtcgagccgtgcaaccatgccggtactgatacgccccttactcatcgcctacctgaaacggatgccttcgtcgttatgagccaacagccctttctgccgttctccaaacctaccatcgatgaagccactatctcggcggtcggcgatgtactgcgctcgggctggatcaccagcgggccgaaagtgcaggcatttgaagcgcaactgtcggaatactttggcggccgtccggtgcgcaccttcaactccggcacctgcaccatggagattgccttgcgcatcgccggcattggccctggcgacgaagtgatcaccacgccgatctcctgggtcgccacggccaacgtgattctcgaagtgggcgccacgccggtgtttgccgatatcgacccggtcacccgcaatatcgacctggcccaagtggaagccgcgattaccccgcgtaccaaagcaatcatcccggtctacctggcaggcctgcctctggacatgccgatgctgtacgcactggccaacaagtacaacctgcgcatcgttgaagacgcggctcaggccctggggtccagctgggatggcgaacgtatcggcgccaccggggacttcgtgtcgttcagcttccaggccaacaagaacatcacctcctcggaaggtggttgcctggtattgaataatgccgaggaggcccgcctggcggaaaaatatcgcttgcagggcgttacccgtaccggcttcgacggcttggacgtggatgtgttgggcggcaagttcaacatgaccgacattgcagcggccatcggcctgggccagttcgcccacatcgagaagatcacggcacatcgccagaacctggcgcggcactatttcaagtgcttcggcagtgacttcgaagagcaatatggcgcgcaactgccgccagcggatttcgaaaacagcaactggcacctgttccagctggtattgccggagcgtcaggacggcctgcctgcccgcgcgacgttcatggaacagatgcaagcccatggcgtcggcattggttatcactacccgccgatccacctgctgagcctctatcgggcgcagggtttcaaggaaggcatgttcccggtgtcggagcgtgttgggcgtttgatcgtgtcgttgccgatgttcacggcgatgacagaggcggacgtggagcggtcggtggcggcggtaaaagcggtgttgaaagcgggttaatccaaatacgccagcggtgtgggagctggcttgcctgcgatagcatcaccacggtgtgactgacacaccgagttgtctgcatcgcgggcaagcccgactcccacacaagccagctcccacactggcttgtgctgttcccactcgttgcgtttattcgccgatggcagctttgtagccagcagcatccagcagtttttccagatcagccgggttgcttggcttgagcttgaagatccacgcgccgtacgggtcggagttcagcagttcaggctcgccgctcaacgcttcgttcaccgcgatcacttccccggcaatcggcgagtagatgtcagaagcggctttcaccgactcgaccacacccgcctgatcttcagcagcaaacacgttgccgacttcggtcagctcaacaaacaccacatcacccaaagcttcctgagcatggtcggaaataccgacggtcacggtgccgtcagcttccagacgggcccattcgtgactttcggcaaaacgcaggtcggcagggatatcgctcatagtctgtgtcctcaagaagaaatgtcagcggcctcaggcctgccggaaatagttagatcaaggttttgccatgacgcacgaaggtcggtttgaccactcgaaccggataccacttgccacggatttccacttcggcccgatcagcagttgccgtcggcacgcgcgccagtgcaatggatttgcttagcgtaggagagaaactaccactggtgatctccccttcgccaacattggcgatacgaaccacttggtgagcgcgtaaaaccccacgttcttccagcaccagcccgaccagtttgaactgcacaccagcggccttttccgcctccagggccgcgcggccaatgaattggcgctcggcaggctcccaggcaatgctccaggccatgttggcggccaggggcgaaacattctggtggatatcctggccatacaggttcatgccggcttccaggcgcagggtatcgcgggcgcccaggccgatgggtgagatccccgcaccgaccaggtcgttgaaaaaacccggcgcctgatcagcgggaaggacaatctccaggccatcttcaccggtatagcccgtgcgggcgataaaccaatcgccgtcggcctggccttcaaagggcttgagctggtggataagcgtgccgcgagactgggtgaccagctcggcgattttctgccgggcgtgcgggccctggatagcgagcatcgccagctcgggccgctcatgcagttgcaccgcgtaatggcccaactgcacctgcatccaggccatatcctggtcacgcgtagccgcgttgaccaccagccggtaaccggcttcggtgcggtagacgatcatgtcgtccaccacgccgccctgctcgttgagcatggcgctgtacagcgcacggccgcagccatgcaaacgatcgacatcattggccagcaggtgctggagccattccttggcctgaaggcctgtgacatcgatcacggtcatatgagatacatcgaacaccccgcagtcgcgtcgcacctgatggtgctcttcaacttgcgagccgtaatgcaaaggcatatcccaaccgccaaaatcgaccattttcgcgccgagggcgagatgcaggtcatacagaggcgtacgctgtcccatgggtttctccttccgggcttggcgaagatgcgcagagttgctgtttgcgctgaaagccctggattacaaggcctgcagctgcatacagcgactcgctccgaaagacggagcgcaccgaatgccgcgcattgtagccgcaagctgtaggactggcacctaaccgatttgtcgtgccgagcgtcggatcaagccgatcactggcaacagccccaccaacaccagcgtcaacgccggcaacgaggcccgcgcccattcaccttcactggtcatttcaaagatccggaccgccagggtgtcccagccaaacgggcgcatcagcagggtcgcgggcatttccttgagcacatcgacaaacaccagcagcgccgcgctcaacgtgcccggcagcaggagtggcagatacactttgcaaaacagtcgcggcccactcaccccaaggctgcgggctgcttcgggtaacgacgggcggattcgcgcgaggctgttttccaatggcccataggccaccgccaggaaacgcaccagataggccagcaccaatgccgaaaggctgcccagcaacaagggcttgcccgcgccgccgagccagcccgacagcggcaccaccagctcacggtccaggtagctgaacgccaacatgatcgacaccgccagcaccgaacccggcaaggcatagccgacgttggccaggctgatgccggagcgaatcgcccgggtcggcgccaggcggttggcaaaggccaatatcaacgcgacgctgaccgtgatcagcgccgcgatgccacccagataaagggtgtggacaatcaaaccggtataacgctcatccagatcgaatcggccacgttgccagaaccaggcgatcagctgcagcatcgggatgacaaaagcgcaggcgaataccaagccacaccacgtgctggctgccgctgccttgaccccacgcaggtgatacaacgccttgccccgtggccgctcattgctcgggcggctggccccgcgagcacgccgttcgccatagagcaccagcattaccaccaacagcaacagactggccaactgggcggcgctggaaaggctgaaaaagccgtaccaggttttgtagatggccgtggtgaaggtgtcgaagttgaacaccgagacagcgccgaaatccgccagggtctccatcaacgccagggcgacaccggcaccgatcgccggccgtgccatgggcaacgccacgcgccagaacgcttgccatggcgattgccccagcacccgcgccgcttccatgaggcctttgccctgagccaaaaacgccgtgcgcgccagcaggtagacgtagggatagaacaccagcaccaacacgatgatcacgccgctggtggaacgcacgcgtggcaggcgcaggccgttgccaaaccactcgcgcagcaaggtttgtactggccctgaaaaatccagcaggccgacaaacacaaaagccaggacgtaggccggaatcgcgaagggcaacatcaacgcccagtcgagccagcgccgcccagggaattcgcagaggctggtcaaccacgcgaggctcacgcccaatagcgtgacgccgacgccgacgcccagcaccagcgtcaaggtgttgcccagcaggcggggcatctgggtttcccacaggtgggaccagatctgttgatcgatgctttgccaggacagcaacagcacgctcagcggcagcagcaccagggcggcgacggtgaagaccggcaggtaccagcggcgttgggcggggtgggccaaggaaaagctctctaagaaatgatgatttagaagtcacctcgaaccaatgtgggagcgggcatgtgtgggagccgggcttgcccgcgatgcagacacctcggtgtgtcagttacaccttggtgatgctatcgcagcggtgcgacgattcgacaagccagctcccacacaagcccgctcccacatttagatcggcggcgtcttacaaattgtacttagttccagccagcgcgatccatcaaccgaatcgcctcggcctggcgcttgcccgccacttccaccggcaaggtgtccgccacgaacttgccccaggtcgccacttccgccgacggcggcacggccgggttggccgggaattcctggttcacatcggcaaagatcttctgcgcctcaggcgtggtcatccactccaccaaggccttggcggcttccgggtgcggcgcgtgcttggtcaggccgatgcccgacaggttcacgtgcacgccacggtcgccctggttcggccagaacagcttcaccgccaggtccggcttctgcttgtgcaggcggccgtagtagtaggtgttgacgattcccacgtcgcactgcccggcgttgatggcttcgagcacggcgatgtcatcggagaacacatcggtggacaggttgttgacccagcccttgacgatctcttcggtcttggccgcgccatgggtttcgatcagcgtggcggtcagcgattggttgtaaaccttcttcgctgtgcgcaggcacaagcggccttcccattgcttgtcggccagggcttcgtaagtggtcaggtcacccggttttacccggtcggtggaataggcgatggtccgcgcgcgcaggctcaagccggtccaggcgtggttcgaagagcggtattgaaggggaatgttcttgtcgatcacctcggaggtgaacggctgcaggatgcccatctgttcggcttgccagaggttgccggcatcaacggtgagcagcaggtcagccgtggcgttttcgccttcggccttgatccgctgcatcaacggggcttccttgtcggtgatgaacttgacctgcacgccggtcttcttggtgtaggcgtcgaacaccggcttgatcagttcatcgatgcgcgaggagtagaccacgacttcgtcggctgcctgcacggtggtgctgccgataagggtgagtgccagggcagtcaggaggcgtttgggtgccaacatgggtgcggtctctcatatgcaaattgaaggcaaatgatagggactcacatttggtggcgctcggtgtaggcgttacgagatgttgcatggctgagatttgtgggaaggctaatggcctcatcgcgggcaagcccgctcccacaggggttggtatttcaagctcagggtttggccagctccgggagatcgcctgtcaaacccaaggcttggcggacgaagacggctttggcttccggcatctggtcgaccagtttcaacccggcattacgcaaccagcgcagtggcagctgatcggcctggaacaaccgttcaaaaccttccatcgcggccatcagcgcgagattgtgcggcatgcgccgacgctcgtaacggctcagcaccttcacatccgccaggcgctcgccgcgttcggtcgccgccagcagcacttcggccagcaccgccgcatcaaggaaacccaggttcacgccctgccccgccaacgggtggatcacgtgggcggcgtcgccgatcagcgccaggccttcggctacatagcgtttggcgtgacgttgacgcaaaggcacacacacgcgcgggtcggcgctcatcaccgtaccaagtcgcccttcaaaggcgcgctccagttcacggcagaagctgtcgtcatccagcgccatcaggcgttcagactcagccggtgtggtcgaccagacgatcgagcaccaatcctcttgcccatcgcgcaccaacggcagaaaggcgagcgggccggtgtcggtaaagcgttgccacgccgtgcgctggtgcgcctggctgctgcgcacgctggtgacgatggcgttatgcaggtaatcccactcacgcgtggcggtgccggtcaggcggcgtacggcggagttggcaccgtcggcagccaccaccagcggcgcgcgcaatttgcggccatcggctaacgtcagcagccattcatcgccggagcggcgcatctgttccaggcgggcattggccaacaggcccaggtcgcaatcgtgcaggcggtcgagcaaggcatcctgaaccacacggttctcgacgatatgcccgagcacttcggcatgcacgctggcggccgaaaagtggatctgcccggtgccgctgccgtcccacacttgcatatcgccgtaagggctggcgcgccgcgagacgatgccgtcccacacgccgaggcgctcaaggatgcgctggctggcagccgacaaggcgcttacgcggggttcgaaggccgcatcctggtcgaacggtttgacgctcagcgggctgccatcgagcaacattacctgcaggccactgccctgcaacgccagcgccagggcgctcccgaccattccggccccgacaatcagcacatctgcgcgcatgtccatgctttaagcctgctttgctggcggcttgcgccgcacgtaaagggttttgtcgacccgcgccaccaaggtgccggagccgtcatgaatctgcacctgaaggtgaggcaagtacttctcgccaccttcggtctgcctgcggatctcgtccagcaaggcctcgtcgatggaaaactcggcgtacaccgggcctttgcccggcgacacaaagtcgatgctcgcggccttgtcccagacgatgtagtcgcggcccaggttctccatcaacagcaacatatagaacgggtcgaccatcgaatacaggctgccgccgaattgcgtgccgacgtaattgcggttgtaccagcccaggcccatgcacaccttggcatggcggaagtcggcactgagttcttgcacccggattccagcgcccaggtacggcgggtacaaggacataacccagcgcaacagccgcgccttgcccaggcgccgggtcagccagttacgcatcagggcgcgtgcccaggcccatggcctgacgggcgaaccagcgcttggccggcggcaacaggtccaggccgagcaggcccatgttgcggcccaaggccaccaacggctgggcactgccaaacaggcgcgtgacttgatcggagaagcccacggtgagcttctggtccaagtgctggcgctcgcgatagctttgcaaggtcgccaaatcgcccggcaccgacggcccggccaacaaagcttcggccaaggcgttcgcgtcacgcagggacaggttgaacccctgcccggcaatcgggtgcaggctgtgggcggcgttgccgaggacggccaggtgcgagcgtacttgttcttcggcttccaccagcgtcagcgggtacaggtgccgcgcgccgacttgcttcaaggtgcccaggcggtagccgaacacgccctgcaattcactgaggaagctgcgctcatcgaggttggccaggcgctgggcgtccatgccgatgcgcgtccacaccagcgcgcaacggttgtccggcagcggcagcaaggccatcgggccttcatcggtaaagcgctcgaaggcctcaccgttgtgggcttcgcttggggtgatgttggcgatcagcgcgctctggttgtagggccgggttttcacgccgatgcccaattgctcgcgcaaaccggagcggccgccgtcggccagcactgcgaggtcgcactccagcacggtttcatcgttgagggtcaggcggtagccatcgggcagcggctccatgcgggtgacttccgccgggcagcgccaactgaccacttctttgtccaggccttgccacaggcactggccgagccaggcgttttccaccacatagccgagggctggcacgccctcttccatggcggacaggcgcgcggtggaaaagcggccacggtctgacacgtgaatctgtttgatcggctcggcgcggcgggaaatgtcctgccacaaacccaggcgctgataaatctgccgagcgccgtaagacaacgccgacgaacgcgcgtcgtagctcggctggtagctgtcacccggcgcaaacggttcgatcagcacgatcttccagccacgcgccttggcgcctgcctgcaacgccaacgccaggctggcgcccaccaggccgccgccgataatggccaggttgacccggctcatcgggcagccgccatcagcgcttcaatctcggcgacggtcttgggcacgccgccggtcagaatttcacagccttgcttggtcactaccacgtcgtcctcgatgcgtacgccaatgccacgccatttcttcgccacgttctggttgtccggcgaaatatagatgccgggttccacggtcaaggccatgccgacttccagcacccgccattcgccgcccactttgtattcgcccacatcatgcacatccatgcccagccaatggccggcgcggtgcatatagaaggcgcgataggcttcgctggcgatcaactcgtcgacgtcgccttgcaacagccccagcttcaccagcccggcggtgatgacacgcaccgtcgcctcatgggcctggttccaatgtttgttcggcgcgatctcggcaaaggcggcttcctgggaggccagcacaatctcgtagatcgccttttgctcgggcgagaacctgccgctgaccggccaggtgcgggtgatatcgctggcgtagcagtcgatctcacaaccggcgtcgatcagcaccaggtcgccgtccttgagcacggcgtcattctgctggtaatgcaggatgcagctgttgcgcccggcggcgacgatggaaccataggccggcatcttcgcgccgcccttgcggaattcgtaatccagctcggcttccaggctgaactcatacaacccggcgcggctggcctgcatcgccttgacgtgggccgcacaggagattcgcgcagcctcgcgcatcaccttcacttctgccgccgatttatacaggcgcatgtcgtgaagcagatgatccagggcaacaaattcgttcggtggctgggcgccgaggtgcgctttagagcggatcacgttgatccactccatcacatgccggtcgaattcggcgttgctgcccatggccgagtacacccggtcgcggccttcgatcaggccgggcaggatgtcgtcgatatcggtgatgggaaatgcgtcgtcggcgccaaagtcacggatcgcgccttcggtgccggcgcgcaggccgtcccacaattcgcgttcggcattgcgctcgcggcagaacagcacgtattcgccgtgctggcgaccgggcatcagtacgatcaccgcttcgggctcggggaaaccgctgaggtactggaaatcgctgtcctggcggtaaacgtgctcgacatcacggttgcggatcgccacggcggcggccggcaggatcgcgatgctgttgggttccatctgcgccatgagcgccttgcggcgacgggtgtattccgctttggggatatggatcatgggcagatgggcttccttacttagtgcagcgacggcttgggtgcggcgggctcagcagatttcttggtctcggtgaacagcagcagcggcgcgacgcgcaggtattccatcacttccatatagtcgccttcgccgtcttcggactcttccagggcgtcttgcacctgggagatggctgccaggtcctgcagcacttccttggcgtcggtgctcagttccaggccgccggcgttcacgccaaaaccgtggaggaagccctggcaccattggcccagcgcggcagcgcgttcggtgagcggcgcgtcgtcggtcggcagcagcaggaccacggtgacgtcatcaccggtcagctcgcctttgaccatttcttgcaggccgatcagcgcattacgcacgttctcggtcggctcggtttccagcagctcggccacatccgccagccagttgtcggcatcaaagccaacaccggtgcaactgcggcccaacagcacgccgtgcagttcggcaggcgagcaaggatgaccgctggagctcagcagtttggaaaaagcgtcgtacggggagttctgaataggcatggtgagctaggcgccagacggcgcaatgtctagaatgaagcgctgtatcctagcaccggcagacgtaccaagactatcgagggcgtcagatcgtttatcctgcagttgccattcatcagacaaatccagtggaacccaatggaagacaccgacctgcaagcgctgatggccagactcgagttgctaattgatcgggtcgagcaacttaagagtcaaaacggactcctattagctcaggaaaagacctggcgcgaggaacgcgctcacctcattgaaaaaaacgaaatcgcccggcgtaaggtcgaatcgatgatttcgcgcctgaaggccctggagcaagactcatgagttcaagcaatagcgttaccgtgcagatcctcgacaaagaatattcgatcatctgcccccaggaagaacgcagcaacctggtgagtgctgcccgctacctggacggcaagatgcgtgaaatccgcagcagcggcaaagtcatcggcgccgaccgtatcgctgtgatggccgcgttgaacattacccacgatttgctgcataagcaggaacggcctgacgtgcaggccagcggctcgacgcgcgagcaagtgcgtgacctgctggaacgcgtcgatctggtactttctaccgatccagagccacccaagggctgattgccgagactgtttaaggtatactcgccccactccctggcgtgtttgccagtcggcgatgtccctgagccgattcgcactaccctggaagttgcacgttgggctggtgtgcatgtccgctagacggaaagccttaaagcctactgcatcttccaccttgaactttcgggttcaagggctaagtcgacagcggctctgtcggggagcctgaatttccaaactcaatgccagtcccaggactggcattgttttatgagccgaaaaaccatgaccgaacctgcgccgctttcccgtccgcaacttcgacgcatgttgcgcaaagcccgccgcgccctcacgccgagcgagcagcgccaggccgcccatggcctgtatcggcaactggcgcagcacccgctgtttcgtcgggccaaacatatctctttatatctaccgacggacggtgaaatcgatccgcgcttgctgctgcgcgccgctcagcgccggggcaaggcgacttacctgccggtactcagcgcctggccacgcaccaagatggtattccagcgcgtacggcctggggataagttgcagcccaaccgttttcgcatcctggagccacgtgtgaacgccaatcgccaacgccaggtatgggcgctcgatctggtgctgctaccactggtggggttcgatgatgtgggtgggcgtttgggcatgggcggcggtttttacgaccgcagcctggcctacctcgctcggcgccaaagctggcgcaagccgacgctgctggggctggcccatgaatgtcagaaggtcgagcgcttggcgcaagcgagctgggacgtgccgctggcaggcactgttaccgataagcagtggtatgtcgcagaaacgtcgctggaatcagcgacgccttgaaaagctgttaacgcttgaacggttgtggctgctgctgagccagttcaacgggcgcatcggtcttgttcgaccacaagctttgcgcatacccggtggtcacgacgcccagaccaaacaaaataaccaaaatccatagtaaatccggtttacgttgcatcgattgccccccttcaggcatctcgtacacgatgacaacaacgttccaaagtagtccgttgcagctgcgtcaagcttaaaagcgggcattctgcggtaacgtgaaccaacacgcaaaccttggcgccaaccgactgtcggtttgtcatggaattgcctgacaacttgcccaatgcctttttcaggagcccaaaaatggcctactggctgatgaaatccgagcccgacgaactctccatcaacggcctggaaaagctcggcgaagcccgctgggatggggttcgcaactaccaggcgcgcaatttcctgcgtgccatggccgttggtgatgagtttttcttctaccactccagctgccccgagccgggcattgccggcatcggcaaaatcatcgaggccgcctacccggacccgactgcactggaacctgaaagccactatttcgacgccaaggccagcaccgagaaaaacccttggagcgcaatcaacgtggcgcacgtcgagacgtttccaaaggtgctgggcctgggctatttgaaacaacaaaccgcgctcgccgagttgcctctggtgcaaaaaggcagccggttgtcggtgatgccggtgaccgccgagcaatgggcagcggtgctcgccctgcgctgaaaaggcagaaccctgcggtcacacttctggcgcatgcatctgagtgccaagcgggttaggcttgcgcttcatttgaccggtatcaacggcccctcgggcgataccggtcaaactaggatgctaatgccgcaggatgcagccatgtctacccaccgttctatgtcacgcctatttgccgttgccctgatcgccctgttgctgggcgccggaggcttcggttactggcgatccacccaagaccgcctgcccgcaggcttgagcatgggcaacgggcgcctggaatccaccgaagtacagatcgccgccaagatccccgggcgcctagccgaagtgcgtgtggatgaaggcgataaggtgctcaagggccaattgcttgcgcgcatggacacccgcaccctcgaagcccagcgcgcccaggccgaagccgaagtgctgcgcgccaaggaaaacttcgccgccgccgaggccaacgtgcagttgcgccaaagtgagcaactgctggccaaccaggaactcaagcgcacccaggaactgtacaagcgcggcttcgccagcagccaattgatcgaccagcagcaagcgcgccagaacaccggcaatgccgcggtgatcgccgcgcaggcccaggtcaacgcggtgaaggccgccatcggcgccgcccatgcccaggtggcgcagctcaccagcgaaatcgacgacagcagcctgcgcgcgcccatcgacggcatcatccagttacgcctggccgaaccgggcgaagtgctcggcgcgggcggtcgcgtgttgttgctgattgatccgaatgatcaatacatgaacctttacttgcccgcctccgtcaccggtcgcctgaccgtcggcagtgaagcgcgcatcctgctcgacgccctgccccagcagccgttgccggccaaaatcagttttgtcgcggccaagtcgcagttcacgcccaaggaagtggaaacccgcgacgaacgccagaagctggtgttccgcgtcaaactgcgcctgacccaacccagcgccgtgccgcaagccaaaccgggcatgcccggcgccggttatgtgcgcacggcggatatcgactggccggccaacctgcaatgaccggcctggcgctgcacgccaccggcatcaaccaccgctacggcaagcaacaggcactggtcgacatcgccttcagcctgcccgcgggtacgcgctgcgggctgatcggcccggatggcgcgggcaagtcgagcctgctggggttgatcgccggggttaaaaagctgcaggcaggccagcttgaggtgctcggcggctcgattgaagaccgtcgccatcgcaacagcctctacccgcgcatcgccttcatgccccaaggcttgggcggcaacctgtatcccgaattgtcgataggcgagaacatccgcttcttcgccacgctgttcggcctgtcgaaagccgattgcgaacagcgcatgcacagcctgctgctggccaccgacctcgcgcgcttcgccgagcgcccggccggcaagttgtccggcggcatgaaacagaagctcggtttgtgctgcgcgctgatccacgacccggacctgctgatcctcgacgaacccaccaccggcgtcgacccgctgtcgcgccggcgcttctgggaactggtcgacagcgtacgccgcgagcgcccgcaactgacgctgctggtggccacggcctacatggaagaggccgaacagttcgagcattgcctgatgctcgatcgcggcaaactcattgccgacggcctgagcagtgagctggcagccgcaacacccagcggcaaactggatgaagccttcacccacttccagggcgacagcgcccataacaaccagccactggtgattccgccacgcgaaagcggcaataccgacatcgccatcgaagctcacgacctgaccctgcgctttggtgatttcacggcagtgaacaaggtcagcttcgcgattggtcgcggcgagatctttggttttctcggctccaacggctgcggcaaaaccaccaccatgaaagtcctcaccggcctgatgccggccaccgagggcagtgccacgctgctcggcaacccggtgaatgccaaggacctggcgacccgcaagcgtgtggggttcatgtcgcagagtttctcgctgtacggcgaactcagcgttgtgcaaaacctggtactgcatgcgcaattgttcgacttgcccaaggccgatagccgcacgcgtatcgatgagttaattcaacgcttcgacctcggcgacgtggctgagcaaccttccggcgaattacccctcggcctgcgccagcgcctgtcattggccgtggcggtgctgcatcgcccggaagtgctgatcctcgatgagcccacttcgggcgtcgacccggcggcgcgggatgatttctggcggctgctgattgaactgtcccgcgagcagggcgtgacgattttcctctccacccatttcatgaacgaagcccagcgctgcgaccgcatctcgctgatgcacgcgggcaaggtgctggcgtgtgacacacccgatgcactgcaaaagcaattcaatggcgacaccctggaagcggcgttcgtcacctgcctggagcaggcacagggcgaacccgagcccgccgcgccgagcaaaaccgtcagcgaaagcagcccgccgcccgtcagtaaacgcggcttcagcctctcacggctattagccgtggccagccgcgaaggcaaggagctgctgcgcgacaaagtgcgcatggcctttgccttgctcggggcaatgttcatgatggtgatcttcggctacgggatttccctggacgtggaaaacctcgccttcgccgtctacgaccaggaccagaccccacaaagtcgcgcctacctcgaagccttccgcagttcgcgctacttcgccgagcaggcgccgattcgcgatgcgcgcgaactgcaccggcgcctgcaacgctcggaaatcaaattggccctggaaatcccgccgggttttggccgcgacctgtacgccggccgccaacccagcgtggccgcatggatcgacggtggcatgccgtttcgcgcggaaaccagccgtaactatgtggaagccgtccaccaaggcaaccttcagcaactcgccgaactgagcagcctgccccacagcaaccaagccgctgccaagctggaaacacgttttcgctacaaccaggacgtggtcagcgtgaatgccatcggccccggcgtgatggcgctgatcctggcgtttattccggcgatgctcactgcactgggcatcgtgcgtgaaaaagaactgggctcgatcactaacttctacgccacgccactgactcgcctggagttcctgctgggcaaacaggcgccgtacctggccgtgagcctggtcaacctggcgttgctggtggcgatgaaccgctggctgttcggtgtgccgttcaagggcagcggcgtggcgttggcattcggcggcctgctgtatgtgctggccaccaccagcatgggcttgttgatttctgcgttcacgcgcacgcagatcgcggcgatcctcggcaccatgatcatcaccagcctgccgaccatccagttctcggggctgatcgtgccgcgctcatccctggaaggcgcagccgcagcgatgggcatgctgtttccggccgggcatttcctggacatcgccgtgggcacgttcaccaaggccctggacctgcgccagttatggccgcagtgcctggcgctgttcgggtttttcgttgggttcaccgggctgagcctgatcatgctcaagaagcaggaggcctgatgcacaagctcgctcatatcctgcgcctgggcctcaaggaactcaccagcctgcgtcacgacagcgtattgctgctgtttctggcctacgcctttacggtcgcaatctatatgcccgccgccggctcggtaattggggtgcacaacgccagtgtggcgtttgtcgatgaagaccacagcgcgctctcgcgccagatggccgaggcgttgcaaccgcccgaattccagccgcctgcgccgctggcctacgaccaactggacaaggtcatggacagtggcgagtacacgttcgtgatcaatgtgccggcgaacttccaggctgacctgttagcgggtcgccagccgggtgtgcaggtcaacgtggatgccacggcgatgagccaggcatttatgggcgcggggtatatcggccggattttccagcgcgagttgctcaactacagcggccaggccgacgccagccagaaggcaccagcactgctgaccacccgcgcgctgttcaataccaacctggaaggcggctggttcctggcggtgatccagatcgtcaacaacatcaccattctcgccatcgtgctcaccggcaccgcgctgctgcgcgagcgtgagcacggcacgctcgaccatttgctggtgctgccgctgaccgcgctggaaatcatgctggcgaaaatctggagcaacatgctggtggtggtgctgtgtacgtggctatcgctggagctggtggtcaaaggcttgctcggtgtgccgttggccggatcgctgagcctgtttctgtttgtgacggcgctgtacctgtttgcgagtaccgcgctgggcatcttcctcgccaccctggcgcgctcgacgccgcagttcgggctgctggcgattccggtgattatcccgatgctgttgctgtcgggcggcagcacgccgttggacagcatgcccgagtggttgcagtgggtgatgcagggctcgccgtcgacgcactttgtgagtttgagcgcggcgattctgttcagggatgcgggtgtgagcgtggtgtggccggatttgctggcgctggcggggatcgggttagtgttttttgcggtggcattggccaggtttcgcaagagcctggcgtcttaattgtgaagagcgggcttgtcgtggcgagcgggcttgccccgcgttgggtggcgaagccgccccagaaccatccgcctcggtacacctgaaaaatgtggtgggcctgaatggggctgctgcgcagcccaacgcggggcaagcccgctcgccacgacaaaccgactcctacacagacggcgggttactgaatgatcaagttgttgaacaacagatcttccaccatcggcttgccggtttcgtcgttcatcacttgctgcgtttgcttcagggcttcctggcgcagtttttctttgccctcaacggtactcatcgcttcgttggtctgctgggtaaacagtgccaccagttggttacggatcaatgcatcgttggctttgaccgcggcagcagcttcaggcccggtcacgcgcagggcgatgtcagccttgaacaccttgagctttgcgctgccgtccaggccatagttacccacgaagggcggtgtcaggctgatgtagctgaccttcggcgcttcgccttcttttgcttcttcggcctgggctgccatcggcaaggtcagggcgagcatcaacaggatccaagctttcacggttcattcctcaaattcggttgccgggtagcataacgctagcaaggctgagcacaagcttatggcgacttatcaggcccgggcatgctcgttgacccacgggcgtaccctcctacacttatcggccacgacaccaaaaggaatagcccgatgaaagctgtgctgtgcaaagccttcggccccgccgaaaccctggtgctggaagaggtcgcaagccccgcgatcaagaagaacgagatcctgctggacgtacacgcggccggggtgaacttccctgacacgctgatcatcgagggcaaataccaattcaagccgcccttcccgttttcgccgggtggcgaagcggcgggcgtggtcagtgaagtgggcgagaaggtcagccacctgaaagtcggtgaccgtgtcatggcgctgaccggctggggcagctttgccgagcaggtcgcggtgccgggctacaacgtgctgccgatcccgccgagcatggatttcaacaccgccgccgccttcagcatgacctacggcacctcgatgcatgcgctgaaacaacgggccaacttgcaacccggcgaaaccctgttggtgctcggtgcctccggtggcgtgggcctggccgccgtggaaatcggcaaagccatgggcgcccgcgtgatcgccgccgccagcagtgccgacaaactggccgtggccaaggccgccggtgcggatgaactgatcaactacagcgaagccagcctgaaggatgagatcaagcgcctgaccgacggcaacggtgtcgatgtgatctacgacccggtcggcggcgacctgtttgaccaggccgtgcgcggcattgcctggaatggccggctgttggtggtcggttttgccagcggacgcattcccgagctgccggtgaacctggcgctgctcaagggcgcgtcggtggtcggggtgttctggggctcgttcgcccagcgccagccgcaggacaatgcggcgaacttccagcagttgtttacctggtatgccgaggggaaattgaagccgctggtgtcgcaggtgtatccgctggagcaggcggcacaggcgattaatgacttggggcagcgcaaggctgtcggaaaggttgtcgtccagacccgctaaccgctttgaaatgcaattcaatgtgggagctggcttgcctgcgatagcggtgggtcagccaaacccacttagctggcagaccgcaatcgcaggcaagcctgctcccacagttgatctgcatgggccttaagcactgataccgacccacacttatctattcgcgacatgttcataagagaacatgcaattgctcccatttcctgtgtttgcggataagaggcgatgctattttcggtaacgaaactgtaacattcgcatccgcagtcaaaacaagaaatttggagctcttgaatgtttgctttctttcgtcctgccgcacaccaggcgcctctgcctgaagaaaaaatagacagcacttaccgacgcctgcgctggcagattttcgccggtattttcttcggctacgccggttattacctgctgcgcaaaaacttctccctggccatgccctacctgatcgacgagggttacacccgaggtgaactcggcctggcgatgtcggcgattgcgattgcctacggcctgtccaagttcctcatgggcctggtgtccgaccgctccaacccgcgctatttcctgcccttcggcctgctgatctcggccggggttatgttcattttcggtttcgcaccttgggcgacgtccagcgtgaccatgatgttcattttgctgttcatcaacggctgggcccagggcatgggctggccgccaagtgggcggaccatggtgcactggtggtcgcagaaagaacgcggcggcgtggtgtcggtctggaacgtggcgcacaacgtcggcggtggcctgatcggcccgctgttcctgctcggcatggcctggttcaacgactggcacgcagcgttctatgtgccggcgaccgtagcgctgatggtggcggcgtttgcgttcatcaccatgcgtgacaccccgcaatcggtgggcctgccgccgatcgagcaatacaagaacgattacccggaaggctacgacgccagccacgaagacgaattcagcgccaaggaaatcttcgtcaagtacgtgctgcgcaacaaaatgctgtggtacatcgccttcgccaacgtcttcgtttacctgctgcgctacggcgtattggactgggcaccgacgtacctcaaggaagccaagcacttcgacgtggataaaacctcgtgggcgtatttcttctacgagtgggccggtattccaggcacgctgctgtgcggctggatgtcagacaagatcttccgtggcaaccgtggcctgaccggcatcgtgttcatggccttggttaccgtggcgaccctggtttactggctcaacccgccaggcaacccgatgatcgacatgatcgcgctgttctccattggcttcctgatctacggcccggtgatgctgatcggcctgcaggcgctggaactggcaccgaaaaaagccgcgggcaccgcagccggtttcaccgggttgttcggttacctgggtggttcggtggcagcgagtgcggccatgggctacaccgttgaccatttcggctgggatggtggttttgtgctgctggtgggcgcgtgcctgttggcaattgccttcctgatcccaacgctgtggcacaccaacagcgtcagcaaggcgcgttaatcgccggaacaatccttcttacaccgcttgagccgcgcctccagatttttatctggcatggcgtggctacgcagggcgttaacggtttgctcgacataatcgcgcgtagtgccgtaacgcccgcaagcgctttccagcacgtggttaagcacgatgtcgggcaagttgccggcgtagctgggcaaatgccgctccaacacaaaccccaacgcctgcacctgagtgccatcttccagacggcagttgagccagtgtggccggtaagaagggtaaggcatctcgcgttgccataaggcgtaaagcgaggcttccagttgatcgtccggcaagcggtaggcaaacccgctgcaggaaccgccgcgatccagcccgaacaccaaacccggtgactccggcgtgcctcggtgctcgtgggaccacaagtacaagccccggtgatagccgtaaacccgtgcgcgcatgcgctgggtcgacgagcattcggggcgccagatgagcgaaccgtaagcgaacagccagaccggcccacccttatgcttggccatggtggcctgcatcgaactcatcaattgctcgtgagtaagttgcggccccaaatcgagccgcggagggtaagccaattgcaaaagatcggtttcaataacggtcatggcggatcgcttaggtctcctgtgtgactgcagatgttgctatgagaatctattaccagttgtaagcaactttaccgtaatagaacgcgccgctgtaaccgtacggcgaaaaagtgctataggcgaggttgccgccgctgctggcgtaagcattgaccttctccgggtatttgtcggtgacgttgtcgccgcccagggtgaaggtccagttcttcagcttgtagtccgccgacacgtccagcacccacgcggccttgaaggtctggtcgttgaccttgtcggcctggtaactggtgaactcaccatagcgcaccaggttgctgtgcagtgcccaattgccataggtgaaatcgttgcccaggctgagtttgtgctgcggggtggtgtcgccgagcaaaccgatccgctcgcgacggtccactcgcaccaggttggcacccaggctgtccagaatggccgggttggccttcacgtctgtcactttggtgtggttgtagttgtagcctacggtgctattccaacgaatgccgttatcgaactggtagcgatagttggccaccaggtcgacgccgtcggtgctggtgtttgtggcattggtgaagtagcgcgcgctggtgtagttgatgttgccgacaccattggcttgcaggtacgcaacggtcgcggggttcaagttgaggttggaggacaggctgatgcggtcgcggatgtcgatgcggtagacatcgagtgtcacggtcaggtcatccgcaggctccagcaccaggccaaggctgtagttgcgcgacttctcggccttcaggtcttcggcgccgagcagacgggcgaccttgctgttggccgggaacgtgcccgcttcctgaatggtgctgccaatcaactgcgacgaggtgtaggcaaagttctgctgggccagcgacggcgcgcggaacccgttggaaatactgccgcgcaacgccacttgcggggtgaagtcataacgcgccgacagcgagccactgacgttggagccgaagtcgctgtaatcctcatgccgcacggccgccgaggcgctgagtttttcggtgaagttggtttccaggtccaggtactgggcccagttgtgccgcgagctgctgccggcgtcggcatcccggaaaccgcccaggcccgagctgccggtctggtagtaggaggccgggtcgccggcttcgatttcatagccctggcgcaggtattcgccacccaatgccacggacaccggatacggcaggaagcccacgtcaaattcacgggacaggtccaggctgatttgcttctggtcgttgctcaaggtgccgttgtcgaacttgcgcggcgtggccaggccgagtgaggtgttgatggtttcggtactcagctcgtactggtttttaccgtagttggccgacaggtcgtaatgccagtcgtaggccagcaagccgcgcaggccgaccaccaatgaggtgtcttccaggttgcccttgatcagcggcaggtagccattggggttgagcgcggggatattattggacgcattgctcgcccggtagaacgccgccgtctcgccgcgccgtttgctgtagccgccgaaggtgtagaactcggctgcatcgttgaaggaatattcggagttgaactggaacttgccttcgttggtggccggttcaccctggcggaatacgcgctggccataggtagtggaacccacgctgcctgggcgcaaatcatcaccggcgcggttggtgtagtcgttgtcggcaccttcgcccgacacgttgataaagccgttgtcgcccaaggcaaacccggtattgccgctgacattgcgctggatgccgtcaccctttttgtattcgccgaacttggtcgagatcgagccgccatggtcggcgtgcttgaggatcacgttgatcaccccggcaatcgcatccgagccataacgcgcagaggcgccatcacgcagcacttcaatatggtcgaccgccgacagcgggatggcattcaaatccgccggtgccgagccacggcccacggcgccgccaaggttaacaaaggcactggtgtgacgacgtttaccgttgaccagcaccagtacctgatccggcgacaggccgcgcagctgcgcagggcgcaccagttcggcaccgtctaccaggcttgggcgcgggaagttgatcgacggaatcaggcgcgccaacaccgcacccagctcatcggagccggtgctgcgcaaggtatcgccggaaatcacatcgatgggtgacagcgaagcactggcggtgcgctcttgggcgcgggtgccggtgacaatcacggtgtcgagttttggtgcgtcggcggtggccgtttcggccgccaggactgaattgaatcccacagcggtcagcaaattggccgacaaaatcgctgtgtacagcgcgtgtttcttgtagctccccataccgctccccttttgaatcaacaatcagaacttcaatgctctgagttcgtacgatcgatccggctggcggcggtggcggtcatttattggttattggctgatagtcggtagtccgttgccttatagcttaatgagattattcctacatctaaaatacccaaaaagaataagcataggcagccatgttttcagcgcaggttcaggccgcgcagaacgttagccgccaaactgtagaagtttagcgacccccattagccgcccattcaaacgactatcgaggtcggaccatgaagtactttttttctggcttactgctgatggcacaagccgctgccgccctggcctctgaggccgccgccgaagacgataagggcttctggtacgcccagacgagcgtctacacccggcacttttcgccagacccacagcacaacaataatcaggatttgatcaacctggagcgtaatgaagcctccgggctggtgtatggcggggcgacgtttcgcaactcgttcagccaacgttcatattacgtttacgccggcaaacgctatgacattggcgaatcgccgttctatatgaaagtgactgcaggcgcgcttcagggctatcgcggcaagtaccgtgacaaaatcccactcaaccgttttggcgtggcaccggcgatcattccctctgtgggcgtgaacttcggcccggtggccagcgagttggtgttgctgggtttcaatgcggcgatgctgacggcgggtgtgcgtttctgaccatcaggcaagctgaataagctcccacagtttgatggggtacaaaatcagggacgcggcgcgtaggcgaacacgtcggcgcgcatctggtgcgcatccatgccggcgtcgaccagcgcatccaaggtgccgtagatcatcgccggcgaaccgctggcatagacatgcacggccttgaggtcgctgatgtcttcacacaccgcctcatgcagcagcccgcagcgcccttcccaaccgcacaggtcgctgacgactttgtgcaggaacaggttgggcaattgctgccactggtcccagtgttcgatttcgtagaaatcttccgggcgacgcacgccccagtacaggtgcaccgggtgcttgaagccggaagcgcggcagtgttcgatcaggctgtgcatctgcgccatgccggtgccggcggcgatcagtaccagcggcccgtcgggcagttcggccaggtgtgtgtcaccaaacggcagctcgacacgcgccatttgattgcgctgcaattgctcaatcaggttgcgggcactgtcttcgcgcaccagcacatgcaactccagctcccgccccgcgtggggcgccgaggccagggagaatgccgacttctcgccattgtcccgctcgatcatcaggtattgcccggcgtggtaacgcacggccttaccggccggagcacgcaggcgcacgcgccatacatcgccaccgacttccacacactcactcaattggcacgacaacttgcgcaacggcaactctcccggcgccagcacgccatcccacaacacaatgcaatcttccagcggctcggcgatgcaggtgtagaactcaccatggtcacgtacttcaccggcttgctgcacccggccttcgaccagcagcgccgcacacacatggcacacgccattgcgacaggcctgcgggcactcgtagcccaggcggcgtgcgccttcgaggattcgctcgccagggaccagctccagtaccgcgccggaaggttgcagggttacacgcatcaatctattcccaattctttccagatcgcatccacgcgcgcggtcacggcttcatccttgacgatcacccggccccactcgcgggtggtttcacccggccacttgtgggtggcatccaggcccattttcgaacccaggcccgacaccggcgaggcaaagtcgaggtagtcgatcggcgtgttatcgatcatcaccgtgtcgcgcttggggtccatgcgcgtggtgatggcccagatcacgtcgttccagtcccgcgcattgatatcgtcgtcggtgacaataacgaacttggtgtacatgaactgtcgcaaaaacgaccacacaccgagcattacccgcttggcgtggcccgggtacgacttcttcatggtcacgatggccatgcggtacgagcagccttcgggcggcaggtagaagtcggtgatctccgggaactgcttttgcaggatcggcacgaacacttcgttgagcgccacgccgagaatggctggctcatccggcggacggccggtgtaggtgctgtggtagatcggcttgatccgatgggtgatgcgctcgacggtgaacaccgggaagctgtcgacttcgttgtaatagccggtgtggtcaccgtaagggccttcatcggccatttcgcccggatgaatcacgccttcgaggatgatttcggcggtggccggcacttgcaggtcgttgccacggcacttcaccagttcggtgcggttgccacgcagcaggccggcaaaggcgtattcggacaggctgtcgggcaccggcgtgacggcgccgagaatggtcgccgggtcagcgcccagggccacggacaccgggaacggcttgccggggtgtttttcgcaccactcacggaagtccagcgcaccgccacggtggctcagccagcgcatgatgactttattgcggccgatcacttgctgacggtagataccgaggttctggcgatccttgttcgggcctttggtgacggtcaggccccaggtgatcaatgggccgacatcgccgggccagcaggtctgcacgggcagcatgccgaggtcgacgtcatcgccctcgatcacaacttcctggcacacggcgtctttgaccaccttgggcgccatggcaatgatcttgcggaagatcggcagcttcgaccacgcgtccttgaggcccttgggtggctcgggctccttgaggaaggccagcagcttgccgatctcgcgcagctcgctgaccgactcggcgcccataccaaaggccacacggtccggtgtaccgaacaggttgccgagcaccgggatatcaaaaccggtcgggttctcgaacagcagcgccgggcccttgttgcgcagggtacggtcgcaaatctcagtcatttccagcaccggggaaatcggcacctggatacgtttcaactctccgcgctgctcaagttgctgcacgaaatcccgaagatccttgaatttcattaaccatgccacccgtaaaataggcgtacatcctacctgctcttaagagcgctgacagcttattgcacgtcattgcggctcatggctgagtcagcagatgtattgcgcagcgtgcggaacaagggttcaaggaacccttccacaagccgcgagcccgcgattgaaaggtgattgtcatcggtgtagagcgcgtgaccatcaagctcgaccctgcaccagctgttgacgtcacacagcttgggcgccgggtccagcacccgaacgcctgggtcagccgcggccatgcgctcaaaggtggcgcttataaaggcctgtcgctgcaggtgttcggccagtggcaagccttccttgtcggtcgggcgccccaacatcgccaaacgggcgagccggaaaggcacgttgaaatcctgcagcggcacttccttgaccaaccatacccggtgaccactggcacgcaattgctgcacccgcgccttcaaaccctcggcgaacagctgctgcgcaatggctcggtcatatttccccgtcgccgggtcatggatggaagccccggtatcgccggaacgctccccataaacgtagaggctccaacgtgcgaccagcgccacatcgctgaaatgctcgtggctcaacaacgctgcggtgcgttcgttgaaagctctgcatccgggtgtattttcttcccgaaagaaaggcaggcagccggcgtacccggcttgagtgatgctgaagtcgtatttgattgacccatctttcaacgccgggatcagcgccgacgcatggctgtcaccccacaccagcgcccgcgccgtgctcgcttgcgggccaaaatggcaaggttcacggtgattgtttttcttgtcatcccccaggcagctcatgagtttggggctccaggtatgcgtctgggcaaattgcagtgcttcgggtgacaaccgttgcgcaaagccatccgaccacaccaggccctttccggccaggcccaggcttacaagggcaatgacacccgccaccaggatcgagcgatttcccgccaacaggcgccgctcacgaaacggcccttcgacaaacctccaggagccataacccagcagcaggctcaagaagaacagcgccgtaagctccaaaggcgtgaggccaaagatactggcgtacttgccaaacaccagcaccggccagtgccacaggtaccaggaataggaaatcagccctatgcccaccaacacgcgactgcccagcaggcgaccgaccagggttgtgtgttggccgttggcccaaatcagccccaccacacccaacacgggcaacagcgccgccgcgcctgggaaagccgtgtcggcgtcataaccaaacaccgcgaccagaatcaggcccaggctgatcaagctgacggtctgtgccaaccccaggcttacccgctgaacgcgaaccggcaacaccgccagcatggcgcctgccaacagctcccaggcacgcataggcagcaggaaaaacgccttttcgggcgcatgggacaccgcccacacgctggcagcaaatgacaccagcagcagcacaaacaacgcgctgcgccatggcttcagccagctcgagagcaatgccagcaacagcggaaaggcaatgtagaactgctcttcaaccgacagcgaccaagtgtgcagcatcggcttcatgtcggaggcggtctcgaagtaaccgtcctgacgcatgaagaacaggttggagatgaagatcacctggttgtgaattgagcgtcccagctcttcgtagtccttgggcgccagcagaaaccagccgaccaccaatgacgcaagcatcatgacaatcagcgccggcaggatacgccgggcccgccgggcccaaaaatccagaaagctgaaatgtccggcctgacgttcgcgccaaatgatcgaggtgatcaggaaacctgaaatcacaaagaacacatcaacgccgacaaagccgccagtaatgccgggaactccaaaatggaacagcacgacagccaggacagcgatggcacgcaggccatcaatgtctcttcggtaagcaagagaggtcataaaaggtagtcagtttgatacggttggaggtaagcgtaggcgctctcacctttattgttcatttactgacaacccttgcgcgtaaacctcccctttatggcgcaaaaaaaatggcgcccctgagggcgccatttttcggacctgaagcgtcgtattacttacgcttcatcgacaagaagaactcgtcgttggtcttggtggctttcagcttgtcgaccaggaactcgatggcggcaacttcgtccatcgggtgcagcagcttgcgcaggatccacatgcgctgcagttcgtcgtcggcggtcagcaactcttcgcggcgagtgccggagcggttgatgttgatcgcagggaacacacgcttttccgcgatacggcggtccagaggcagttccatgttgccagtacccttgaactcttcgtagatcacttcgtccatcttcgagccggtttcaaccagcgcggtggcgataatggtcagcgagccgccttcttcgatgtttcgcgcggcgccgaagaaacgctttggtttctccagggcgtgggcatcgacaccaccggtgaggaccttgccggagctcgggatcacggtgttgtaggcacgggccagacgggtgatggagtcgagcaggatcaccacgtccttcttgtgctcgaccaggcgcttggccttctcgatcaccatttcggcaacctgcacgtggcgggttggcggctcatcgaacgtcgaggcaaccacttcgccgcgcacggtgcgctgcatttcggttacttcttccggacgctcatcgatcagcagcacgatcaggtgaacttcaggattgttacgcgcgatgttcgctgcaatgttctgcagcatgatggtcttaccggctttcggcggtgcgacgatcaggccgcgctggcctttaccgatcggggcgcacaggtcgatgacacgaccggtcaagtcttcggtggaaccgttaccggcttccatcttcatgcgcacggtcgggaacagcggcgtcaggttctcgaagagaatcttgtttttcgcgttctcgggacgatcgaagttgatcgtgtcgaccttgagcagggcgaaataacgctcaccttccttcggaggacggatcttgccaacgatggtgtcaccggtgcgcaagttgaagcgacggatctggctcggcgagacgtagatgtcgtctgggccggcgagataggaagcgtcagcggagcggaggaagccgaagccgtcctggagaatctccagcacgccatcaccggagatttcctcgccgcttttcgcgtgctttttgagcagggagaaaatcacgtcctgcttgcgcgaacgggccatattttctatgcccatttcttcggccaattggagcaggtcggtaatcggcttttgcttgagttcagtcagattcatataggaatgacgtaatcatttatggaggggggaaattaagcttttggcttaatgaggccgcgccgcagagaaggcgacaggatcgcgtactaatcgaaaaggaatgcgtcggcgacggcttgcagggggcagtggagaaaccagtgcggggccgaatgtaccacctgaatttcggagcgtctagccctgtttcacgaaaaagccccgcgatttgcggggctttttttacgacgcttagatgttcgcgtcgaggaaagcttgcagctgagacttcgacagcgcgcccactttagtggcttcgacgttgccgttcttgaacagcatcagcgtcgggataccacgcacgccgtgcttggccggggtttcctggttgtcgtcgatgttcagcttggcaatggtcagcttgccttcgtaggtggtcgcaatatcgtccagaacaggggcgatcattttgcaagggccgcaccattcagcccagtagtcaaccagcaccgggccttgagccttgagtacttgttcctcaaaggtcgcgtcggtgacgtgcttgataagatcgttgctcatggatgtctccggattgtaagcaaaaaaaacgtggcccatcatagccgcccttcccccgttcaggaagccgcctctgattgactcttgctatggtggtgcatgagtttgggtatagctcaactcacgacgacacgggagtcacgaatgcgatgcccgtgcgcaacgccgcattgcgcacgtgttcctgcatggttttctgcgccgccgcactggcgcgtcgggccagggcacgcaggatcttgcggtgttcctgccaggtttccatcgcccgctccggccggatgaacggtagtttctggctctccaaaaacacctcggcactcgcactcaggatgctcaccatcgcctggttaccgctggccagcaggatccgctggtgaaattcgaagtccagccgggccgcagcttcaaagtcgccagccttgagcaccttgcgcatggcctcgacgttgtcttgcaggctgtccagctcatcgacgctcagcgtcaccgccgccagccccgccgcaaagccctccagggcgtaacgtaattggaagatatccagcggcgtcgcctgggccgcaaagggccaggcaaacccgggtgactcgtcgaccgcctgcacaaacacgcccttgccgggctgcacactgaccacccccaaggcactcaaggacgacaacgcctcgcgcagcgacgcccgactgacccccaactgcaccgccaggtcgcgctgggacggcaacgcatcgcccgctgcaaagccctgttccttgatcagtttgcggatggcctgcagggccgcttccggtacggcttgggcgatggaattcataaaaaactcatagttccagacaacggagcggctagttgtaaagctattcgaagccggcggcaagccacgccccaaaggggctcgcggcgttttgtcgacgctcgaaaaaggtgcgaaaagcgcaagtactgttcagaccagtaagaccaccgcgcctcaacaaatcccggcgttgcaggcgattcgagcggtgatggcatgggctgtgcactgagcaaactcagaaaatcccttcgcctttttcggagagttgccatgaccaagcgctacagcgccctgctcactgccctgtttgccagcctgatgctgagccaggcacccgcccaggccaatggtctggacgacatcgtcgcccgtggcaccctcaaggtcgccgtgccccaggacttcccgccgttcggctcggtcggccctgacatgaagccccgcggcctggacatcgacaccgccaagctgctggccgaccagctcaaggtcaagctggagctgaccccggtcaacagcaccaaccgcattccgtttctcaccaccggcaaggtcgacctggtgatttccagcctgggcaaaaacgccgagcgtgaaaaggtcatcgacttttccaaggcctatgcaccgttctacctcgctgtattcggcccgcctgaggccgccatccacaccaccgatgacctcaagggcaagaccatcagcgtgacgcgcggcgccatcgaagacatcgagctgaccgccgtagcgcccaaggaagccacgatcaaacgcttcgaagacaacaactcgaccatcgccgcctacctggccggccaggttgacctgattgccagcggcaacgtggtgatggttgcgatcagcgagcgcagcaataaacgcgcgctggagctgaaagtgaaactcaaggactcgccagtgtacgtgggcgtgaacaagaacgagccggcgttgctggaaaaggttaatcagatcctggtggcggccaaggccgacggcagcctggaaaagaatgcgatgcagtggctcaaagagccgttgcctgcagatctttgaagcgacggagctgattcatggcgtatcaatttgactttatgccggtgctggccaataccgacctgctgctgcgtggcgccctgttcacgctggagctgacggccatcggcgcgatcctgggcgttgccgtgggcaccgtcggcgccgtggtgcgagcgtggaagatccagccgtttgcctggttcttcggcgtgtatgtcgagttgatccgcaacacgccgtttctggtgcagctgttcttcatcttcttcggcctgccatcactgggtctgaaaatcactgaatggcaagccgctgtgctggcgatggtgatcaacttgggggcctactccaccgagatcatccgcgccggcatccaggcaatccctcgcggccagctggaagccgcagccgcactggcgatgacgcgtttagaggcgttccgccacgtggtgctgctgccggcgctgggcaaggtgtggcccgccctgagcagccagatcatcatcgtaatgctcggttcggccgtgtgttcacagatcgccaccgaagagctgagctttgccgccaactttattcagtcgcgcaacttccgcgcctttgaaacctatgcgctgaccaccctggtgtacctgtgcatggcgctgatgattcgtcagttgctcaactggattggccgccgcttcgtgatgaggaacagccgatgagtgatttctccttctgggacatcgtgcgcaacctggccaccggcctgcaatggaccctgttgctgtcgctggtggcgtttgtcggcggtggcctgatcggcttgctggtgatgacgatgcgcatcagccgcaaagcgttcccgcgcaatgtcgcgcgcacctatatcgaactgttccagggcacgccgctgttgatgcagctgttcctggtgtttttcggcattgccctgctcggcgtggatatttcgccctggctggcggcggccattgccttgaccctgtttaccagcgcctacctcgccgagatctggcgcggctgcgtcgaatccatcgcccacgggcaatgggaggcgtccgccagcctggcgctcaacccgtttgagcaactgcgctacgtgatcctgccccaggccctgcgcattgccgtggcgcccaccgtggggttctcggtgcaggtggtcaaaggcaccgccgtgacctcgatcatcggctttaccgaattgaccaagactggcggcatgctcgccaacgccaccttcgagccctttatggtctacggcctggtggccctcggttacttcttgctctgctaccccttgtccctcagtgcccgttacctggaaaggagactgcatgcctctgcttagaatttccgccctgcataagtattacggcgatcaccacgtactcaagggcatcgacctgacagtcgaagaaggccaggtggtggcgatcatcggccgcagcggctcgggcaaatccaccttgctgcgtacccttaatggcctggagtcgatcaacgacggtgtgatcgaagtcgatggcgaatacctcgacgccgcgcgcgccgacctgcgcagcctgcggcagaaagtcggcatggtgttccagcagttcaacctgttcccgcacctgaccgtgggcgaaaacgtcatgctcgcaccgcaagtggtgcagaaagtgcccaaggccaaagcggcacaacttgccaagcagatgctggagcgggtcgggctgggggaaaagttcgatgccttccctgatcgcctgtccggtggccagcagcaacgcgtggctattgcgcgcgcgctggccatgtcacccaaggtgctgctgtgcgacgaaatcacctcggccctggacccggaactggtcaacgaagtgctcagcgtggtgcgtcaactggccaacgacggcatgacgctgatcatggtgacccacgaaatgcgctttgcccgggaagtgggcgacaagctggtgttcatgcaccagggcaaggtgcatgaagtcggcgacccgaagacgctgttcgccaaccctaaaacgccggaattcgccaacttcattggctcggtggaacagccgagctgagcagttcgaaactgccctgcccctccaggcgcgtttcgtcgcgcacgtgcatgtcacctgcgggcaggtcggtgtcgatatcgacttgagcggtcaatcgccgacctatcattggcattcctgcgactcgtgccatcaacgtctggccgggcagcagctgcccgctggcaggctcgccgggcaaatgcgcagccacccaaccgacagcatgtccatccacctgggcatgtttgaggctcaggcgaaaacgcccttggcggccaaaccgaaaaccctgaccatccgctgcgacgccgataaagcgcaacgtcatttgcgcaggttccacgcacaggacattcaactgcaaagaacgagtgccaagtgtcacggcggctctttcaacaagcgcctctttgcgaatagcgccgtagtcaatgcgcggctggctcaccgacaaccggcaattctcagaccaggcgtaaggcgctgtcagcagtgtgcacagcagcaccaaaggcaggcttttaagcgtcgcggccatggcacaccgccgcggtggtttcatagaacttgtcattgtttggcttggcctcaaggttaaagcgcaacaggcaggtggacgagtccggcaacgaaacccgcaggttttgcacctcgtcgacgtcgttcaggaaaatcatgccttcacccacaacactggtcaggaagcgattggctttgccgaacacggcggctccctgaggcaagggccggccctgctcatcattcgcggtgagcaacacgcgacgtactttcaccacatcgaaattcacggtattgaacgacccacggcccgcagcgagcacctgggtgccgtttttcaggtcgacacgcttgggcagcgactgggtctgcacttcgactcggctgttggtgtaggcgggcaaacctgcgatcaccgcttgcccgctgtagtcggtccacaccgggccttggggtgtctcgacttttgcagcgcctatgtcgcctaccgagacaatgccgaacgtgtcctgcacggtataaggcgagaaggtcaacccaccctcgtgagccactacgccgccctgcaactgtccggtgtagctggtgccgcgagggtcacgactgacacccagccccacctgggtataacgcggcaacacgtccacctgcccgcgaatcgattgctcccgcgccctgaggtcgcggtcgaatcccacctcatagttcacatactcattgacccgatccctgagtgctgtacccgtggtaaagcggtcgccgcgacgactggtgtagctcgtcacacgacgatcaccgcccaggggcacgctgacctgcaaccgcagcgacaggtcgttctcctgggcgctgtcccgtcgcctgtcggcagacggagtgtcgcggcccgaccgggtgccgcctacctgcgagtccgcgatcaacgcaacctcggcgtgactgaatgacttattccacgaggccgacacatgttcgctcgttcgcccgtcaaattgagcactgcgggtaaaacccgttgagaaaacgcccaacgtgggatcggcccagctgatgcttgccgtgtactggtttttggaacgcgaacccagctcatcggccctgtatgtccggccggcttcaacgacctcgcgataaccgcgggtttgggtagttgcgctgaggctcacatcgatgccgccggctaccgggctgctcacggacacgctgctacgtaccccggacacctggtttttgctgtctcgagacaggttttgccgcgtgcccacggaaacccgctggaaaaatatgctgctcagggtgccacctgccgcccagtagtcatcggtgctcaacaaaccaaagcccgcagacgaatcgcgccccaacccccaagtgccgccgcccatggcgaccaacggtgtcgggccttcctcagtcgcgttcttgcgcagcttgccggcagaaaaatagtaaccaggcaccgctggcacagcccccgcgaacgaagcggccggcacgacgaaactgcgccttgcgccacgcacatcgatcacgctgacttgcaggtcactggtgccattgagcaatggcaggcccgtcagccgaaaaggcccctcgggcaccaacgtgctgtggatcaatacgccggactgacgcacttcaatgcgtgactggctctgcgcaagcccttcgactaccgcatggttgctgctcgccggcgtgcgtgattggccatcggggaaaaactgcagcccggataactggacgccatcaaacagcggattattactggagatctggcccacctggaaagtcgattgcaaggcggccagatcccgctgggcataggcgttcagatgctcggtacggaccttgccgttgtcggccacataaaactggcgactgcgcaaaatccagtcatccaggttaaaccctgcctcggtataggctgaaacgaaccgactggacccactgcgcgaacggctgtcgaaacccagtacgttgtagttgaatatcgccgccgacccgcctttggagaaatgcccggcgtcccactgtgggtcacgcaatgactgggtcggaaccaccagcgccacctcgtctatgccgggacgcaacctcaccatggtggtcgggaactccccgaaaaagtcatgacaggcctgatccggggtgaggccttgctgaatgagcgcgcggggctttaccaagccggctttatccagcaatccgggcgtgaaacataatcggccttcatgatcgaaccgtgcgtccaccagcccaagcgggtttccattgacgcgcaacccgaccacttggacgccctcgcgaaaacgcgccgcgccacggaagtactccgacactttcgggtcgataccgtgggccgtcagcgccgcaacgtcaaaaccttcgccaagctccagcgcagagacaagaccgggtgccccccacagcgtcgcaaaccccatgagcagcgtcggccggcaaaacagaaaagacgcgggggtgacgtgattcgaagggcgtgccatgagccggtcaactctcatcagcattgattgcggcccgatatttgtctaccgcaaacccatagacagtcgccggctgaaactcgacctcggccacaccgcccaaggggcttgcggctgacacggcgagcgcttcgcccggcaaaatataggcacgcggtaatgctgccttgatgccttgtggaagcaactgcacatccgccgccatgcgcacgacataggcactgtcgttatgcaccgtgagatgctcacccacccgcttccacttcagtaactcccagggtgtttgatgccggggcaggccttttgggtgcaggatcagcggcaagttctggcggatggtgataccgatcgtggccccctgttcggcgcgcgcctggggaatgccctcgaaggacacgcgcttgagtcgctgagtcttgagcggctccttcaaggtactgatgaagcgcaccaattgcgtgtcgcccgcctccacgcgcgtaatgggcggtgtgacaatcaacagcggctccaggtcctcgggcacattctctaccactgaatgaagcaacgccgggcctgcatccgtattcttgatgtttattgtggcttcgccctcttcttcatagagcagtaccaccgttgtttcaggctgcataccgtccgccgcagccactgcagtaaacaacaggctaaaaaacaacgctcgacttagtatcgaacaacaccgcattgaatgttccccacaacgtataaagttgatttccggcagacaaacgcccacaaaaaaacaaccgaccagaacgcgttagtttccggatcggttgttttacgttgcttaggtgtagttcagtacaatcgttgcacgcccattaagggagacgtcgttcctcaagtccaactccgccgccctgttgataacagctttaactgcaatagtgccagtcaattgactgattgaagcgggcgtcagggccgagccattgcgccacgagtactgggtcaggtgggcaactttgccatcactgtgatgccacgagacgccggtacgcatgatgggatatagcgtcgtattggatgcccgcaggttggtaagcgcgaccgagtagccgccggttcgccgggtacctacagcgcccaagccaaagttctgcgcttcggtatagcccgcacccaggatgcccggcaccttggagcccgcttgcaaatcggtaaaggtgaccccgaaagtggtcggcgcattgcaaaggatgttcaagccaacggtcttctccgtgagcgggttgaacgccgtctgggacaattcgcccgagcgaatattgccgtagttgatttcaccgttgccagtaagattaaggctgcacgctgcaggcttgatcgtgccgatgacggtcaatgtcgcgctgttcgtggttgcctgggcacttaaagccgcagccaggcaggtaataccgagagtcaaaccaacaatttttttcatgctcatcctgtcactaaaataagttatcaggtgttctttatttgtgtttggcgactccatcgcccaactatttatcttccgagacatgcataacaataaataaataccaccaggcaaaattgccgggtgacagtctgtcgctttggcacttgattaaagaatcagacaacacaacagtcgctgtaggaggcatataaacaaattgtccctctaactcgatgagcgggtggtacaaaagcaaataatgccgagtccatttactcgtttactgtaggtaaattcagcgcaggtcttacaatggagcgtggttatctactcctacagcctcgaaggcgctattcaactattgcttacaaacccgccctacatttcccacgagaattccctacagccagcctcacggcaattactgaagcacaacgcgttggcgccagcggtcgatcgtggcacgatggtcgggttatcgaccgagacccccaaaccatgccgcaatcccaagccaagaatctgtccctgatcgccgccatcgacctgggctccaacagctttcacatggtcgtggccaaggcccagaacggcgaaatccgcatccttgagcggctcggcgagaaagtacaactggctgccgggatcgacgacgagcgccagctcaatgaagaatccatgcagcgcgggctcgattgcctcaagcgttttgcccaactgatcaacggcatgcccttgggcgctgtgcgaatcgtgggcaccaacgccttgcgagaagcccgcaaccgtggcgaattcatccgccgcgccgaggaaatcctcgggcacccggtagaagtcatttccggccgtgaagaagcgcgcctgatttacctcggcgtgtcccacaccctggccgacacccccggaaaacgcctggtggcggacatcggcggtggcagtaccgaattcatcatcggccagcgtttcgagccactgctgcgcgaaagcctgcagatgggttgcgtcagctacacccagcgttacttcaaggatggcaagatcaccccggcgcgctatgcacaggcctacacggcggcgcgcctggagatcatgagcatcgaacacgccctgcaccgcctgacctgggatgaagccatcggctcgtccggcaccatccgcgctatcggcctggccctcaaggccggcggccatggcaccggtgaagtcaacgccgaaggcctggcttggctcaagcgcaaactgttcaagctgggcgatgccgagaagattgactttgacggcatcaagcccgaccgccgcaccattttcccggctggcctggcgattctcgaggcgatcttcgacgccctcgaactgcaacgcatggaccactgcgacggtgccctgcgcgaaggcgtgctctacgacctgctgggccgtcatcaccacgaagacgtgcgtgagcgcaccctcagctcgctgatggagcgttatcacgtcgacctggaacaggccgcccgtgtggagcgcaaagccctgcacgcgttcgaccaagtggccgaggactgggacctggaagacggcgtgtggcgcgagctgctcggctgggccgccaaggtgcatgaagtgggcctggacatcgcccactaccattaccacaagcatggcgcctatctgattgagcactcggacctcgccggtttctcccgcgaagaccaacagatgctcgccctgctggtgcgcggccatcgccgcaacatccccaaggataagtttgccgacttcggcggcgaaggtatcaagctgattcgcctgtgcgtgctgctgcgctttgcgattctgttccaccacatccgtggcacccaggaaatgccccaggtgaccctgcgcgccaacggcgacagtctggacgtggtgttccccaaaggctggctggacgaaaaccagctgacccaggcggacttcgcccaggaagcggaatggctgacgcgggtggggttcacgctgaacctgcgttaatcgcgcaggcggccactggggcttgttgtggcgagcgggcttgccccgcgttgggctgcgaagcggccctaaaaccaaacgccgcattctgtcagacagaatgcggcgtttttattgagtctgcttcgcagcccaacgcggggcaagcccgctcgccacacaagcccgctcccacattggatctgctcaggtttttagttcaccgccagaatcgggctacccaacttctccagcaacgttgcctgcgcactgcgcgggttctggttgccggtcggcgtgttacgcacgtaacggccgtccgattgcaggctccaactgtgggtgttgtcggtcaggtagctttccagctccttcttgacgcgcatgatgagtttcttgccttccaccgggaagcacgtttccacccgtttatccaggttgcgctccatccagtcggcactggagaggaacatctgctcctcgccgccgttgaggaagtagaacacccgcgtgtgctccaggaagcgaccgatgatcgagcgcacatggatgttgtgcgacacgccgacaatgcccgggcgcaggcagcacatgccgcgcaccaccaggtcgatgcgcacaccggactggctggccttgtacagcgcgcggatgatcttcggatcggtcagcgagttgaacttggcgatgatgtgcgccggcttgccgtcgagggcgaactgggtctcgcgggcaatcatgtcgagcatgcccttcttgagcgtgaacggcgcgtgcagcagcttcttcatgcgcaaggtcttgcccatgccgatcaactggctgaacaacttgccgacgtcttcacacaaggcgtcgtcggaggtcagcaggctgtagtcggtgtagagcttggcgttgccggcgtgatagttgccggtgcccaagtgcgcgtaacgcacgatctcaccggcttcgcggcgcaggatcagcatcatcttggcgtgggtcttgaagccgaccacaccgtagatcaccaccgcaccagccgcttgcaggcggctggccagttgcaggttggactcttcgtcgaaccgtgcacgcaactcgatcaccgcggtgacttccttgccgttacgcgcggcgtcgaccagtgcatcgacgatttccgagttggcgccggagcggtacagcgtctggcgcacggccagaacgtgcgggtctttggcggcctggcgcagcaggtcgaccaccggggtaaacgactcgaacgggtgcagcagcagaatgtcctgcttgctcaccacactgaagatgttctcgctgttttgcagcagtttcgggatctgcggcgtgaacggcgtgtattgcagctccgggtgactgtccaggccggtgatgctgaacaggcgcgtcaggttgaccgggccattgacctggtacaactcggactcggccaggttgaactgcttgagcaggtagtccgacaggtgtttagggcaggtgtctgccacctccagtcgcaccgcgtcgccgtagcggcgtgagaacagctcgccgcgcagggcacgggccaagtcttcgacgtcttcggagtccagtgccaggtcggcgttacgggtcaggcggaactggtagcagccttttaccttcatgccctggaacaagtcgtccgcatgcgcgtggatcatcgacgacaggaatacatagttgtcgccagcgccacccacctcttccggtactttgatgatccgtggcaacaggcgcggtgccgggatgatcgccaggcccgaatcgcgaccgaaggcgtcgatgccttccagctcgacgataaagttcaggctcttgtttaccagcagcgggaacgggtgcgtcgggtcgaggccgatcggcgtgatgatcggggaaatctcgtcacggaagtaacggcgcacccaggttttgatcttggtggtccagtgacggcgacggatgaagcggacctgatgtttttccagttccggcagcaggatgtcgttgaggatcgcgtattggcggtccacatggccgtgcaccagctcgctgatgcgcgccagggcttgatgcggctgcaggccgtcggcgccggcttgttcgcgggcgaaggtgatttgctttttgaggccggcgacgcggatctcgaagaactcgtccaggttgctggagaagatcagcaggaatttcagccgttccagcagcggataggactcatccagcgcctgctcgagcacgcggatgttgaattgcagttgcgacagctcgcggtggatgtacaggctgctgtcatccaggttggtcaccgccgctaccggggccggcgcgggcgcctcggccaccacggcaggcggtgccggctccatttctggcggcgtttcggtgacttgttccaccaccgggtgagcgtcttttacggcaacttctgagagtccttcggtattcatcgagtgttcctgtgagggctattgttgctctctaagcaattgggcagcgcgggcggcgaagtaagtcagaatgccatcggcgccagcacgtttaaaggcagtcagggattcgaggatcaccccttcactcaaccaaccattctggatcgcggccatgtgcatggcgtattcaccgctgacctgatagacaaaggtcggcaccttgaattcctctttgacccggtaaaggatgtccaggtacggcatcccgggcttgaccatcaccatgtctgcgccctcggccaggtcggccgccacttcgtgcagggcttcatggctgttggccgggtccatctggtacgaagccttgttggccttgcccaggttcagcgccgagcccaccgcatcgcggaacgggccgtagtaggcgctggcgtacttggccgaataggccatgatccgcacattgacgtggccggccagttccagggcttcgcgaatcgcctggatgcggccgtccatcatgtccgacggcgcgacgacctgggcgcctgcggctgcgtgggataacgcctgcttgaccagcgcatcgacggtaatgtcgttttgaacatagccgtcttcgtcaagaatgccatcctggccgtgggtggtgaacgggtccagcgccacgtcggtgatcacccccagttccgggaagcgctcacgcagcgcgcgggtggcacgctgggcaatgccttgcgggttccaggcttcggcagcgtcaagggacttgagttcagacggtgtcaccgggaacagcgccagcgccggaatccccagttcaacccaattcgccgcttcttcaagcagcagatcaatggtcaaacgctccacacccggcatcgacgccaccgcttcccgacgattttcaccgtccagcacaaacaccggcaggatcagatcgttcgtcgtcagcacgttttcacgtaccaggcggcgagaaaaatcatcacggcgattgcgacgcagacgggtggcggggaacaggcgattggcaggggtaaagctcacgacagactcctgagcccgcgtttacgggcgagcgttgcagttataagcggccattatgacgaaggaatgacagttgtgcttatcgatgcgacctgtagtcgcattcgtcgtttatgtaggaattgttcacttcgtgacacatctcgatactttcatgaatgttcacgaaggcgtaggctgcgcgttcatttcgccagcaccccagaccatgcttcaacaatttctgcatgacttcggctactttgcgctcttcctgggcaccttcttcgaaggcgagaccatcttggttctcgcaggcttcctggcgttccgtggatacatggatatcaacctggtggtggtcgttgccttttgcggcagctatgccggcgaccagctgtggtacttcctggggcgcaagcacgggcgcaaactgctggcacgcaagccgcgctggcagttgatgggcgacaaagcgctggaacatatccgtaagcatccggacatctgggtgctgagcttccgattcgtctacgggctgcgcaccgtgatgccggtggcgattggcttgtccggttatccgcctttgcgctatttgctgcttaacggcattggcgcggcagtatgggccgcagcgcttggcgctgcggcgtaccattttggcgcggtgctggaaggcatgctcggcagcatcaagaaatatgaactgtgggtgttgggcgcgctgttgttgctgggcctggccctgtggctgcgtcgccgcttcaagaacgcgcgcattgcccgccaggcctgcgaagatgccaaggcccggctggcggcggaacaactcgccgagcccgccaagatcgacgcgcctaagacgccaatcgagtaagccggtctctgcagcaatagagaccgatgacgctgagcaagctgtaactcaccaggcccagccagcccaaactgctggccggccacagcccgaccagcggcgccagccacaccagtggcacattcagccccaggcgcaccagctcggccttcaacgcccaggggcggttttccagggcgacacccaacgtgaacaaccccagtgccatcgcactccagcccaagaccaaggccgccgtcggcagcccttcgccgaaattcatcaaatagctgccaaaccccacatacgcggcaaattgcagggcaatgtaaacctgctggcgcgcatccaacggcacttcgaatttgcggaactggctcaagtcgggcttggccagcgggtacttggccttcacgtccgccgggcgccagccggtgcgcatgaaccagatgcgcagcttgtcccaccaacgctcggtacgtcgcgcatcactccacagctgggcataaaactgcaggttggcccacagcgggttccagctggccaagggcgtggtcacgccaaagattaccggctcgttttcgtcttcttcctggaagctgccgaacagccggtcccaaataatgaacaccccgccgtagttgcgatccatgtagagagcattctgtgcatggtgagcccgatgattggacggtgtgacaaagaaccactcgaaccagccgagcttgggcacgtggcgggtgtgcacccagaattgatacagaagattgagcgacgccacgctgataaacaccaccagcggcacaccgagcacggccagtggcaagtagaagatccagctcagcagaaacccggtgctggtctggcgcaaggcagtggtgaggttgtagtcctcactttggtgatgcaccgagtgcgcggcccacaggatgttgcgctcatggccgcagcggtgcagccagtagtagcagaagtcgtagaacacaaaggcgaacacccaggtccacacacgctcggcgggcaactcgaccagcgccaggtgcttgagggcgaatgcgtaagtcagcagccccacgcctttggtcagcaagcccgtggtggtggacagcacacccgtgctgaggctgttgatggcatctgcgacccggtaattgcgctcgccgcgccagcggtctgccagcagctcaaccacgatcaaggcgatgaaaaacggtaccgcgtaaggcacgaagtccatgggctagtccggtctatttttgttacatcaagattaggggcagcggcgtgatatcccattggcaacaggtgacaaattagtagacatttaacgccacgaaatagggagaaatattcatgagcaaaaagattgcagtgatcctttccggctgtggcgtgtacgacggcgcagaggtccacgaaagcgtaatcaccttgcttcgcctggatcagcgtggtgctcaggtccaatgttttgcgccggatatcgcgcaacaccacgtgatcaaccacctcaccggcgaagagatgcccgagtcacgcaatgtgctggtggaatcggcacgcattgctcgcggcgaagtgaaggatatagcgcaggcgagtgccgaagacttcgacgcgctgatcgtgcccggcgggtttggcgcggcgaagaacctgtcgaactttgccgtggaaggcgcgcgttgcagcgtcaacccgcaggtactggcgctggccgaggcctttgccgaagcgggcaaaccggtggggctgatctgcatctcgccggcgctggccgcgaagatctacggccccggcgtgacctgcactattggcaactgcgccgacaccgccgcggccctcgacaaaatgggcgccactcaccaggaatgcggggttgaggatattgtcgaagacaccgcgcgcaaactggtgagcaccccggcctacatgctcggcaagcgcatcagtgaggtggcgtcaggtatcaataagctggtggatcgcgtgctcgaattgactcacgagaatgactaattgtagccagcggtcgttcggtggcgagcgggcttgttgtggcgagcgggcttgccccgcgttgggctgcgcagcagccccaattcaggcggcgcagttagtcagttagcgcgcggttgtaggtttcagggcggcttcgccacccaacgcggggcaagcccgctcgccacgacaaggcgcgctcacacagaaaaactgcctgccacaacaagcccgctcgccacaaaatcaggccgggcgcatcaaccgcgtaagaatccgatccagagcattggcaaacgcctgcttgtccttttccccatggggcggtgggccgccgcccatctggccttgctcacgcagatcagtgaacaggttacgcaccgccagcctctcactcatgttcgccgggctgaattcctttccccgcggatcgagggccgtcacgcccttcttcaccagccggtcggcaagcggcacgtcactgcagatcaccagctcaccgggcaccgcgtgctccaccaggtagtcatccgccgcgtccgggccgctgggcaccacgatcagtttcacacaggcaaaactcggcttgatctgactctgccccgccaccagcaccacgtcgaactggcgcttgagggcgaacttcacgacttggtccttggctgcgcgcgggcaagcatctgcatcgatccaaacgcgcatcgtcatgctgccacgcggcgtttttccgccaggcggctgcggccatacagcaccacaattgccaggatcgccacggcctgcgcactcaacgaataggcatcggcgtgaatgcccagccagtcgaagtcaaagaacgccaccggccgcgtgccgaaaatgccggcttcctgcaacgccttcacgccatgcccggcgaacaccaccgacagcgcgcacaacagcgccgcgttgatgccgaagaacaacgccagtggcagcttcgccgaaccgcgcaggatcacccacgccaggcccaccagcagcaccagcgccgtggcgccaccggccagcaccgcgttgtgcccagcggggcctgcctgcaaccacagggtttcgtagaaaaggatcacttcgaacaactcgcggtacaccgagaagaacgccagcatcgcaaagccgaaccgcccgccgccgcccaccaggctgctcttgatgtaatcctgccaggccgctgcgtggcgtcggtcgtgcatccacacgcccagccacagcaccatcacactggcgaacagcgccgtgcaaccttcaagcaattcgcgctgggcgccgctgacgtcaatcacatacgccgccaacgcccaggtcgccaggccagccaacagcgccaggccccagccgacgttaacgctgcgcactgccgactgctggccggtgttgcgcaggaatgccaggatggccgccagcaccaggatcgcttccaggccttcgcgcaacaggatcagcaagccggagatgtagctcaacgaccagctcaagccatcactgcccagcaagccggccgattcagtgagcttgcccttggccacgtccaggcgctgctgcacctgctcgatcggcaggccgtcctgcaatgactgccggtaagccatcagggctttctcggtgtccttgcgcacgttggcgtcgacgttatccagcgagctttccaccagctcgaaaccttccaggtaagccgctaccgacaagtcataagcctgttcgtgatcaccgttgcggaaggcggcgaggcttttgtccagggtcgtggcggtgtagtcgagcaactgcgccgggccacgcttgacctgcggcggttgcgcacgctgggtgcggaatgtggcggccgcggccgggccgtcagcggccagcacttcattgggggtttggcgcgccaggtcggcgaggttgaaaggttgtgcgctgtttgctgcggccgggtcggcagtgaagccggcgatataggttgccaagtcccagcgctggcggtcatccagttgatcggcaaaggacggcatgtcggtgccttcgacgcccaggccgagggtgttgtagatcgcataaagactaaggcgatcaaggcgcaccgcgtcgcgcaggttagcaggcggcggcgtcatgcccgttgacgcaggaccatcacccgcgccggcagtgccatggcacaccgaacaatgctgggcgtagagcggcgcgccacgcgcggggtctggtgtgatcgccggagcctggctgacttcatacgccaccgcgagcttggcgcccaattgacgggcttggcgggcgactgtcgtgccctcttggcgagcggttaccgccgctaacaattcatcgacgcccttgaccagctccacgcgctccggcctttgcggcagttcagccaccaggccctgcaacacgccgagaaactctaattgttcgcggtattcagactcatcgaccacctcgcccgccgccaccgtcggagggtagtcagcgccgatgtaatccagcaaatgcagggctttcggggcgccctcggcagtcgcggccagcaggttgacgctgcacgacatcaacgctggcagcagcagccaggcgagaaaacggtagggggcagtcatgaatgaatctcaagtggaaatgcgaagtaacacattgtttatcgttaaaacgtttgactcaaggcgttaatgatttcgcgttgaaaggatgactcatttcgaaaatagcggtggtggcacttgacgatcacatcaaagcaaaaagccattgttttgccagtctcggtgcctataatgccgcgccctgttattgcgaaagggaatttatttcctctttcttatgaggaattagagcatcagctgattactttcagggaagacgtttaaatggcttttcgcgccctaactccgctcgcactcgcgatggtgaccttattatccggttgctcgatgttccgcagctacgacactgagctgcaagccaccaaccagcagttggccacaggcaatgtcgacggcgccctgaccctgttggaaaaaaacaacaccagcgaagacaaggacctgctctatttctttgaaaagggcgagctgttgcgggccaagggtgacctcaccggcagccagaccgcctggcgcagcgccgacctgcaagtctacaagtgggaagagtcggtcaagttcgacagcgagaaatacctcgcccaattcggcagcttcatggtcaacgacaaagtgcgtcgttacgaaggctatgactacgaaaaagtcatgctgaccacccagatggccttgaacctgctggccctgaatgacttcgacggcgcccgcaccgagatcaagaaaacccacgaacgcgaagccgtgatcgccgacctgcgtgacaaggaatacctcaagcgcgaaaacgaagccgagcgccaaggcgtcaccacccagctcaaagacctgcgcggttacccggttgaaaccctgaacgcgccggaagtggtcggcttgaaaaacagctaccaaagtgcgttcagccattacctggcaggctttgtctacgaagccctgggcgaaaaagacctggctgcgcccggctatcgcaaggccgccgaactgcgccccaacacaccgctgctggaacaggcattgctcgacctggacaagtccagggtcggcgccgatgagactgacgtgctgatcgtggtccagagcggcctggcaccggcgcgtgattcgattcgcctgccactgccgatcccgatcgacggccactttgtaattacgccactgtcgttcccggtgatcaaggccgacaattccaccgcgccatttgcccagatcggcgtggatggcaagcagcagaacctcaccgcactcaacagcaccaccgccatgtcgcgccgcgccctgcgtgacgacatgccggggatcatcctgcgcaccacggtgcgtgccgtcagccgaggcatcgcgcagaacaatctgaacaagaccaaccccatggcaggcctggtgctgggcatcgcctcggccgtgaccgaaggcgccgacacccgcacctggcgcaccctgccggacatgacccaagtgacgcgcctgcgcctcaagcacggcgaccatcaggtcagcctgcccaacgccctgggcggcacgctggtaacggtcaaggccgaccagcgctaccaggtgatcaccctgcgcgtggtcggcaaccaagtattcgctggcggcctcgcggcccacgtagtgccgagcacctccactcaagccatcgccctcaaacaaccttaaggaacacgctatgcgtcatttcatcctcggcgctctggcgctggtcctgctcgcgggctgcgccaccccaccgccgccagagcccggcagcgccgccagcaaaatcgtggtgatgggcaaattcaaaggcatcgccgtcggtgccattcgggtcgcccgtgaaaacggcttcctcacggccaaggtgcagttgagcaacatcaccagcagcaaccagatgatgtattaccgcttcgcctggctgggggccgacggcttcccggtaggcgatgaagaaacctggaaagtgctgaacctgtacgccaaccaggcgaccttcctgccggcaatcgccaacctgccccaggccgcagacttccgccttgaagtgaaaaccccttgagccgcggctcaacccgtattcagagagatttccccatgtttgcacgcttctcgattatcgccgtcgttgccctcctggccagcggctgctcaaacacctcgccggtactcggcggcaagaacatcagctacggcgacaccaaggccgtggaactggtgaccaacgagttcggttccaccgacctgcagatgatcgccgaaagcatgacccgctccctggcccagtcccgcatcttgcaaggccgcccggtggtgcaggtgtacgacgtgaagaacaagaccagcgagtacatcgacacccgcgagatcaccacgtcgatcaagacccagctgatgaagaccggcaccgcgcgcttcgccagtgacaacaccgacatgcagagccaggtcgaccagttgaagctgcagaaccagagcggcttgtacaagaagtcgaccgtgagcaagaccggcaacatggtggccgccaagtaccgcctggaaggctcgatcagctccatcgtcaagcgcagcgcggactacaaggacgtgttctacaagttcagcctgcagctgatcgacgtcgagagcggcctggccgaatggatggacgagaaagaaatccgcaaaaccacggagcgctaaacaatgcgtgtatggatcggcatgatcggcctgctgtgcgcctttggcgcctcggccgccccgaagatcgcggtgactgaccttgcctacgaggcgcgggtcgaggaatacatccacgcggtctcggccagcaacaacttccaggccagcgcgtatcacgccagtggtgcgtcgaactacagcgagtacgagcgccgcaccagttacatcgaacagaccgagctgcgtaaattcagcggtgatatcaagggcgagattctcaagtcgcaccagtttcagctggtgcaaggtacgccctataccgccgacgccaagggcgacgtgtatgacgtgatcaagcgcatcaaggccggtcacttcaagggcgcagactacgtgctgttcggcacgctgtcagacatcgacttcacccaggacatcaacgccctggaccacaccaacagctactcggccgtactgggcctgacactggtggcggacttcagcctgatcaacacccgcaccttcgagatcacctcggcgtttaccgccatgggcgaaggccaggacaccaagctggtgaacagccgcgatgtgcgcgtgagcctgaaccggccgcgcgtggtgaaggaagtgtcgaaagccttgggtgaggatgtggcgcggcaattggcggagcagctgggcggcggctatcaagaccccggtaaacctgcgttgcgtaataacctgccgagggatgaagcgccgaagattttgcgctgaaccaaagcgttcacagacaacgcaaaaccaatgtgggagcgggcttgctcgcgaattcggtagatcagtcaatacatcctgtgactgacactccgctttcgcgagcaagcccgctcccacttttttgattgggttccttcagttcaattgcggcttacgtcgttgcgcgatgcaagctggccaggaaacccgcagccccgacgaacaacccggcaaacgtacggttcatgcgtttttgctgcttaggcgtgcgcaacaggcgcaagaccttcgacgccaacccggtataacccgccatcacgatcatatcgacgctgatcatggtcgcacccaggatcaggtactggatcagcagcggcgcgtgcgggtccacgaactgcggcagcaccgccagcatgaataccagggctttagggttgctcgcattgaccaggaaccctcggaacatcatcgccagcggcttgccgatcggacgaatcgccgcgtcctcgctcatgtccatgggcagggcacgccattgcttgatcgccaggtacaccaggtacgccacgccaaaccatttgatcgcatagaacgcattggaagacgccgccagaatggcacccaggccacccgcgaccacggcaatttgcatcgccaggcccagttgcaggccaatcgcattccagtaaccgcgcaggaaaccgtactgcaggccgctggacatcgaagcgatggcaccggcgccgggggaaagggaaatgatccaactggccaggaaaaaggccagccatgtgtcgagtgccattacacacctctgagggagagttagcggttatgcctaaagctaactccaccgcccaaaggctggctatctatttttaatcgcgcgggatgtcagcggtcgcccggaaacacgtgggtgccgggccaacgccgtactgagcgctggaagaacaagctgttaggcacctgcaccatcgcgctgtcggaacctgcttcttcgacttcgatcaacgtggtgtagagcagattgattgccaccacccggccttttacgccgggtttgtcgacggtatccaccagttcgacgatatcaccgaggcggaatggcccgacagtgaaaatcagaatggcgcacaacaggttggacagcaccgaccacatggcgaagaacgccacggcggcgaccgcgacaaaccccgacagcgccgtccacaacactgtggcggacacaccgaggcgacccagcacgaagatcatcgcactgcccatgatcagccagcgcaggccgccacgcaggggcatcagcagttgcggcgggaatgggtagcgctcacccaggcgagtgaggcccttggcgacgaagcgttgagcgaggtagccggccagcaggatcagcaggatttgcacgccaacccaggcaggctcgacccactgggtgggcaacggcagctgcagcgcctccatcaggacagcgcctccagctccgcttgcaggctttcgagcagttcgagggcttccatccaggtttcctccaactggccttcacgcaccttgagcttggcttgttcggccagcaggtcgcgcagctcgtccttgcgcgcggcctcgtacacggcgctgtcgcccaggctggcttcgatcttggccaggcgctcgtgcaccttgcccagctcggcttccagcttgtcggcttcgcgcttgtgcggcgccaactgctggcgcagtgcggcggcggcttggcgctgggccttcttgtcggttttgtccgggttgaccggcgtgttgctggtcggcgcattgcgcaggcggtagtccgtcagccagcgtgcgtagtcgtccaggtcgccgtcgaactcttcgactttgccgtcggccaccagcaggaagttatcggtggtgctcttgagcaagtggcgatcgtgagacaccaccagtaccgcaccgctgaattcctgcagggccatggtcagcgccaggcgcatttccaggtccaggtggttggtcggttcgtcgagcagcaacaggttcggccggtcccaggcgatcaacgccagggccagtcgggccttttcgccaccggaaaaattcagcaccggctcatcgatacgcgcgccacggaagtcgaaaccgccgaggaagtcgcgaagggtttgctcgcgctcggtcggcgccaaacgttgcaggtgcaacagcgggctggccttggaatcgagagagtccaactgatgctgggcaaagtagcccaccaccaggttctcaccccgggtcaggcggccggccaggggctgcaactcacccgacaggttcttgatcagcgtcgacttgcccgcaccgttagggccgagcaaaccgatgcgcgcacccggcgttagctgcagcttgaccttctccaggatggttttgtcgccataacccaggcgcgcatccgacaggtccagcaacgggctggagatcttcacagactcgcggaacacaaagtcgaacggcgaatcgacgtgagctgccgacagctcttccatgcgctccagcgccttgattcggctctgggcctgacgggccttggtggcctgggccttgaaccgggcgatgtagctttccatgtgcgcacgctgcgcctgctgcttctcgaaggcctgttgctgctgggccagacgctcggcacgcgcgcgttcgaacgcggtgtagccgccacggtagagcgtgattttcttttgttcgacgtgggcgatgttgtcgaccacggcgtcgaggaaatcccggtcgtgggaaatcagcagcaaggtgcccgggtagctcttgaggaagtcttccagccacaggatcgcatcgaggtccaagtggttggtcggttcgtcgagcagcaacaggtccgacggacacatcagtgcctgggccaggttcaggcgcatgcgccagccaccggagaagtcggcgaccgggcgatccatctgctcgttggtaaacccaaggccggcgagcatcttgcgggcgcgcgcgtcggcggtgtagccgtcggcgctgtcgagttcggcgtgcaggcgggcctgggcggcgccgtcctgggctttctcggcctcggcaaggtcgtgttgcacctggcgcagacgcaggtcgccatcgagcacgtagtcgatcgcgatgcggtccagggtgtcgatctcctggcgcatatgggcgatgcgccagtcggccggcagcaggcagtccccggaatccggggtcagctcgcccagcaacagcgcaaacaacgtggatttgccggcgccgttggcaccgatcaggccggctttgtgaccggcgtgcagggtcagctcggcgtcttcaagaagacgttgcgggccacgctgtaatgttaggctttgaagtcggatcataatggcggcggagtctaccagcttcgttggccgctggcttgggtgtgaatatgtgcgctgacctgtggagctttgccctctcgacttacgcccgctcagggtgcgaagccgcttgcctgcgcctgcaggcgcaaggcgcggatgtatgcctgttgctctgtggcgcgtggcttgaacagcgcggtgtggcgtcgacacccgaacgcatgcaggcgctgcagcgcattgcccagccgtggcagaaagaagtggtcgaacccttacggcaggtgcgcgtgcaatggcgagccatggcgcaacaggatgcgcaattggcggcgttacgcgaacgggtcaaagccctggaattggaagctgaacggcagttgctgacgcgcctggaagcgctggcgcaagcatggccgatcggagaaagcgagggtcaacaaggatggctggaaggcttggcgaccgaagccgccaaccttgaccatgacgcgctgcagttgctgcgcgtcatggccaccggcacttaggaagcgctggttggggtggtgcttggcgctaccggtgcaggtgtgctgctggccgatgcggtcggagcggtggacgctgccggagtagcagccggagctgccggggttgctggcttggccggtgcaggcttggcggcagcaggttttgcggctggtttcgcagcagctggcttggcagctggttttgcagcagctggcttggcagctggttttgcagcagctggtttagcggccggcttggcagctggttttgcagcagccggtttagcggctggcttggcggctggtttggcagcagcggttttagcggctggcttggcagctggttttgcagcagcggttttagcagctggcttggcggctggttttgcagcagcagttttagcggctggcttggcagctggtttcgcagcagcagttttagcagctggcttggcggctggttttgcagcagcggttttggcagctggcttggcggctggtttcgcagcagcggttttggcagctggcttggcggcagctttagctggcgtacgcgagcccaatactttagccacggcctctttcacacgaccaacgccctgggccagtttcaggctttcctgagcatcttttttgagttgggaaatgtaggtgcgggtttcagcttggcgatccttgagagcgtcgagcaggtcctcaagttctttgacagcgtctttggctttggcttgagccttggccttgccggcagtcgcggcgtcttgcagtttggtgcgggatttgtgcagcttttcttgcgctttaccgcgttgtttttccagtttggcgagcagtttttctgcatcggccaaggcttgggaacacgcgctttccagatgttcgagcaagctgcccgaaagttgttggagtaaatgcaacggggtatttacaggcttctgtttggccgacatggtttacctcctggctgacgtgggtgcggctcatactagccctctgctcttaccgccgctagggcatgttgacagtatcgtttgccttgcgttgcaccgtgagtaaattcttatcgatataacaaaaaactgcggcactttttgcgcactcacactggcataatccgtcgcactttcggcgggagaatgcttatgtcgcgttacctttttctagtgctcggcttggcggtttgcgcggccaatgcgggtgaacaatcgccgccaaaaaccactgcccaagacccacatgatctcgcttatagcctgggggcgagcctcggcgaacgcttgcgccaagaggtcccggacctgcagatccaggccctgatcgacggacttaaacaagcctatcagggcaagccactggcactggataacgcacgcatcgagcaaattctcgccgagcacgaggcacaaaatgcagccgacgcgcaggcgccgcaaagcgaaaaagcactggctgcagagcagcaatttttggccagggaaaaagccgcagatggcgtgcgtgaactcgcggatggcatcctgctcacagagctgaagcctggcagtggcagcaagccgctggccagtgatgaagtacaagtgaactacgtgggtcgtttacccgacgggaccgtcttcgataagagcactcagccgcaatggttccgcctgggcagcgtgatcagcggctggagcagtgccctgcaacagatgcccgtaggcgcgaaatggcgactggtgattccatcggcccaagcctacggcgccgacggtgccggcgagttgatcccgccgtatacgccgctggtgttcgagattgaattgctcggcacccggcactgagccaataaaaaacggcgcgcaatgcgcaccgtttttttatctcaccgttgagggtcaggcctgggtggcagcctcttccttgtgggcgttgtgcagcacttcgatcaagcaatcttccagttcgaaacgctcgtgtagcaggccacccagctctttgaatttttcggcaacacatttgccggcatcacacaggtctgtgaacaccagcagcttttccgtgatgacatcgatgcgcgggtaaatagtctctgccaggtccagaccgcgctgatcatcaaaggcttctgcttctttggtcagttgttcgtagacaccgaaatgtccggcagacacgtagtccaccaacacaccacagaactcctgcaacggttcacgattctcagccagtgcctcaggcttggcgccgagagcatcaaaggcccgaaccagttcgtgacgtgccttcaaccagctgtcgatcagcttgtgcaccccaccccagcgttcctgagcattctgacaactttccagcatgatgatctctcttccctatagggggcgctgccgctctgtgcccgcgcaacacttcaaggataaaagcggcagccggacaaggccgcatctgacaatcggtttcgataatgcgtgcgggccagattatgcccgcatgactatggcttcaaggtacgcaggagagaaagttcatacaagtgtttaatcctgtcctacacactgcgacgtacttctattgcctcgccaggcccaagcggcgggcgaaaagcagcggtgaaaactgcataacgcccaggatcaacatcgccacgaagaacaacaggctccactccgggaggctcaggtcaaacagtgtccagttgagctccacgcagtcgacagtgcctttgactgtcgactgcaaggcctgccacagcgacaggttttcaatcatgtattgcaggctcggccagcaattggcggcctgctcaggtgcgacactttgtaacagcacctgacgcactgcagtgatagcgccgagcaacgcacagcccatgctcgccagaccgtaaaagtaggccatggagcgctttgggctgtgaaacacagccaccagattgagcaacgtgaaaattgccagaaagatgcgttgcacctggcagaggaaacacggacggagcagcgcgccatactcaagataaaaagacgcacccaacgtcagcgcaccagccatgaacgccaggagaaacaaggagcgtgaaggggccaaagacattgtcatccgtaccgcaagagataggccgttacggtagaggaaaggcccgactcctttcaatacgcgctagcgcagactattccgcgagagcatgaggatatgccgtcagaacctggacgactttgagcagctaccagtaggaattcattacgtagcgctttagacccagtatttacacggcaatggagggttggccctcagatacgtctgagccaaccctcgcactctttcctacttcaaactcgtgcaggtaccggtaatggcgacgccagcaaacggctgtccaaaagccccaggccttcctggaacaactggttactgcgctcggtgtcacccagctgggccagtagacgcgccagctcagcacaggcttcgggattgcgctgcacctgcaggctgctttccaggtaatcacgcgccttgccccacagactgttttgcaggcacaggcggcccagggtgagcagcaagctggcatcccccggatgatccttgagccagccctcggcaaacttcaactgccgggccgggtctgcgccacgcagcaaaccgtaaagccggatcagatggctgtcgtaaccgcgcttgatggcgccgcgcagcacttcctcggccttggtatcggcgcccaatcgacgcagttgctcggcgtacgccagcaccagttgcggctgctggcgttgagcggaagtcagttgctcccaagcccggtccagcgcctgcaaacccgcttcaccttgttcttcgcgcagagcagccaagcccaggttttcaccccaggcacggcgctccagctcggccagctcgctggccggcaggactttgtccttacgcagctccggcaacaggcgaatcactgacgaccagtcgccccgctgctgatacagacgctgcaattgacgcaagacttgtgggttatggggatgacgctcgtgcatcgcctgcagggtgaccaaggcgccttcagtatcgccacggtccatctgcaactgcgcatggctcaaggcaacagccaattccgcctgcggttggcgctcaagtgcgcgctccagcaagccgtcagactcttcataacggccctgttcattggccgcgcgtgctgcgccgaggtagtacagcaatggctggcgctcggcttcggcggcgcggtgcaggtggcgttcggcgctggcccagcggccttcggcgaggtccatctggccttgctcgatagcaatctgtacccgccggctacggttgcgccgcgaccacgggttgaccacgccaccggaggtggtcaccaggccaagcagcacgcggatcaggtagatcgccaggatgacgatgaacacggccgccaacgtcgcccacaagctcgactcgtaatgcagcacatgcggataggtaatcagcacgtagccggtgtgcttggaaatgcccacggccagtgccagggcgatggcaatcgccagcaccaggatcacatagaaacgcttcatcggctctactccttggtcgccggcgtgcccgccgacgccttggcttcatcggcagacagatgacggcgctcaaggtaggcctgcacggcggccaaactggcagccaggtccggcgtggccacggagacagccttgggctcaagctcggcaatacgcgccagcatcgccttgctctgcgggttgtcctgattgaagttgtcctgcagcacaccgcgcgcctcacccaaggcgcggctgtacaccgccgtttcgccattgagcgcagcccattgggcttgctccaaggccaggctcagggccaggcgcacctggttcaagccctggccggcgagcagcgggcgaatgttgtcgtcagggttgaagtcgatgcggaagtagcgggagatctgctcccaccactggctccagcggctgtcggtatccgaggtcgggcgaccttgggcagccggctcggtgagctggtattccggcgcgatggccgccaattgcacgacctgatcacgcaaggccgccagttgcaggtacagcccggtgcggtccggctgttcggtactgcgcagcgcggcgaggctcttggccaattgctcacgcgcggcgtaggcgcccggatcactctgctcgcgcagaatttcgtcggcgccctggaccagtgcctgagcgctgttgatgtcctgcagggccgagaggcgcaagctggccagacggatcaagtgctcggcttcagccaggcgccagtcctggcggctggcacccagcaccgtttccagacgttggctgaggcgctgctgatcaccctgcaattgcgcgaccagacggcgacggtcttccagttcatccgccgcaggcaactgcgccaggcgagcggtcaactgctgctgattctgcttgagtgattgggcttggtcatcgagggtctgcacctggcccagctgctgctggctgctggcttgcagggcgcggacctgccagatgccccaaccgccggcggcaacaccagcggcgccgagcagcaaggcgacaattgccaggccattgccacggcgtggcgcggtgaccggtgactcagcgggcgcatcaagtacgggctgggcttcatctttaggcaaggctgtttcgctcacgtatccgtcctttgcgtatcagagagtgggcgcggcatgcctcatagggcactgctgcgtaacgccactaacaaggccgcggcactcgcgccgcgacaatccacaacttttcctgcgccagcggcccgcgccatttcatagacccgcgggctgggcacgaacaacggcagctgcgccaccacaggccaatcttcgccggccagggcttgcaggtgcaaaaaaccctgcccactgctgaccactatgccattcaagcgttccaactggatgcgttgcatcaacgccccggcgtcgtaagccggaaggagacgacgatacaactccagatagtcgacactagcaccttgctcgcgtaaacgctcagccagcagctcccgcccaccctcgccacgcaggatcaacacccgagcaccggggcgtgcgatagcctcgcgcaaggccggcaaggcaagcaaggcctcgctgtcgtcgccactgggcggatagtgaacgttaaggccgtggtcggccaggacctgcgcagtggcggcaccgacgctgaaccacggcaactgcggccagggttgatccaacaggtgcaaagcaagtcgcgccgccggtttgctgaccacaatgaccgcgctataacggcccaggtcacgaaaaaccgcgtgttgctcggccgtcaccggcaaggcttcgatgtccagcaaaggcaagctgctgctgaaaatgccggcttcagataacgtcgcggccagggccgatgactcctcggcaggccgcgtcagcagcacacgccagtcggtcactgcgggccggcctcgccgtagactttctgcagaatggcgccagcgcctttttccaatagttcctctgccacctggatacccagggcagtggcgtcacgctgtggcccgcgcacctcggcggtgagcagcgtgccgccagccggatcgccgaccagcccacgcagccaaaggttttcaccttcgagcacggcgtagcaggcaatcggcacctgacagccaccgttaaggtgtttgttcaaggcgcgttcggccgtcacacgaatctcggtgtcttggtgatcaaggggtttgagcagggcgtggatttcactgtcggcggtgcggcattcaatccccactgcgccctgcccgcctgcaggcaagctgtcttcgacgctgatggccgaggtgatccggtcttcgaaaccgaggcgaatcaaaccggctgctgcgaggataatcgcgtcatattcgccggcatccagcttggccagacgggtgttgacgttgccacgcagaaagcggatttgcaggtctgggcgcctggtcagcaactgcgcctggcggcgcaggctcgaggtgccgacgatactgcccagcggcagttcatccagggatgcgtaagcgttggaaacgaacgcatcgcgcgggtcttcacgctcacagatgcaatacaggcccaggccttcagggaagtccatcggcacgtctttcatcgaatgcacggcgatgtcggcttcattttcaagcagcgcggtttccagttccttgacgaacaggcccttgccgccaatcttcgacaatggcgagtccagcagcttatcgccgcgactgaccatgggcacaagagacactttgagacccggatgggcctgctcaagacgtgcttttacgtattcggcctgccacaaggccaaagcgcttttacgggtggcgatgcggatttcgcgagaggacatggatcaatccgtactgaatagatacggcagataataacagctcaggcaaatacgctttgatttgaatcagcaagtgcggggcctccctggccgcatcgcaccgggataaaacatgcaggcctcgccaaagcccttgggctaaagctgctgcatcatcttgcgcacaccggcgacgtggcggcggctgacgatcaaggcgtcgccattgagccctttcaggaacaactgaaagtgccccaggggcgtgcgctgcaggcgctctattcgctcgcgagccaccagcgcgttgcggtggatgcgtacaaagcggtcgccgaattcatcttcaagggccttgagcggctcgtcgagcaagacttcgccagtctcgtgacgcagggtcacgtacttgtggtcagcgataaaatagaccacctggctcagggggatcagctcgatacctttgcgggtccgcgcgctgatatggctacgcggcccgttgccactttgcgccgccggctgggtcagcgcggcgagctggacgcggttggggcgctcggcttttttcagggccttgagcaacgcctcggcggtcgccggcttggcgacaaagctgacaccgctgtcttcgagcgtctgcgcagaaaactcttcttgagctgcgcataacaccacggcaggcggcgattctcgctcgctcaggcgggcggccacttgcaagccatcaaggcctggcaggcgaatatcgagcaacaccacatccggcttgaggctgtcgatcagcgtcaacgcctcctcgccgttggtggcgctcggttcaaggactgtataaccctcgagttcactgaccagacggctcagtcgctcgcgggcttggggttcgtcatcaacgatcaggacattcatattgcgctggattcctgcgtgagtctcgcacaaggatagcgtagacaggtgcggtgacttgcgtcacagcgatccacgctaagactagcgcgagcggcaaaaagtgccctgagagcggcacccatatttacccggacctgttcaatagcgcccaagacctgctgcctgcgggcatcgtcgtagggtttgctgatacacaatccgaataccccccttttttaatggatagtctgggctatgaccgcatcacccgactttggtgcattcacacactatcagtccaactgtagacgctggctgagacgacattgctcaatcgacaaatatcgtttcaataagcccctgcctccagtctcgtcctggacgcgttcggcggcaaggcacttagccatccttcgcacaaataaaaatgccgaccacccgcagcaccgcctccacgggcaaccctgttattatcggcggcacacctccacgcctcttttaagcagatcacgagcgaatccatgagcaccgacaagaccaaccagtcctggggcggccgcttcagtgaacccgtcgacgccttcgtcgcgcgcttcaccgcctccgtcactttcgaccagcgcctgtaccgccacgacatcatgggctcgatcgcccacgccacgatgctggccaaggtcggcgtgctgaccgacgccgagcgcgacagcatcatcgatggcctgaccaccattcgcggtgagatcgaggccggcacgttcgactggcgcgtcgatctggaagacgtgcacatgaacatcgaggcgcgcctcaccgaccgcatcggtgtgaccggcaaaaaactgcacaccggtcgcagccgtaacgaccaggtggccaccgatatccgcctgtggctgcgcgatgaaatcgacctgatcctgggcgaaatcacgcgcctgcaaaaaggtttgctggagcaggccgagcgtgagtccggcaccatcatgcccggcttcacccacctgcaaaccgcacagcctgtgacgttcggccaccacctgctggcctggttcgaaatgctcagccgcgactacgagcgcctggtggattgccgcaagcgcgccaaccgcatgccgctgggcagcgccgcgctggccggcaccacttacccgatcgaccgcgagtacaccgcacaactgctgggttttgacgcggtgggcggcaactccctggacggcgtgtcggaccgtgacttcgccatcgaattctgcgccgcggccagcatcgcgatgatgcacttgtcgcgcttctccgaagagctggtgctgtggaccagtgcgcagttccagttcatcgacctgccggatcgcttctgcaccggcagctcgatcatgccgcaaaagaaaaaccccgacgtgcccgagctggtacgtggcaaaagcggccgtgtgttcggcgcgctgatgggcctgctgaccttgatgaagggccaaccgctggcctacaacaaggacaaccaggaagacaaagagccgctgttcgacgccgccgacacgctgcgtgattcgctgcgtgcgtttgccgacatgatcccggcgatcaagcccaagcacgcgatcatgcgtgaagcagcgctgcgcgggttctccaccgcgaccgacctggcggactacctggtgcgccgtggcctgccgttccgtgactgccacgaaatcgtcggccatgccgtaaagtacggcgtagataccggcaaggacctggcggaaatgagcctggaagaactgcgccagttcagcgaccagatcgagcaggacgtattcgccgtgctgaccctggaaggctcggtaaatgcccgcaaccacgtgggcggcactgcgccggcgcaggtcaaggccgccgtggtgcgtggccaggaactgctcgccagccgctaaaggctaaaagcatcgccggcaagccagctcccacatttgaatcggtttaaaaatcaaaatgtgggagctggcttgcctgcgatggcgtcctgacaggcgccgatgatctatttcttcgccgcaatcatcgccataaacgccggcatcgccgcttccctgtccgccgccaccttctgggcgttgggcatgccatgcagtcgctccagcaacgctttggccttcggcaaatcagccagcaaatccacgccaaacagcttctcgcccactgcacaggcgaggttcacgctgtacatgaaatacagatcggcaatcgtaaagttctcccccgccacgtatggcgcaaacttgccgtgtcgccccaaagaaccgatccccaacagcagctcggccttggatttttccttgatcgcctccggcaccggcattgcgaagaacgcctcggcgaaacacgcgcgggcgggcagttcgatgtacagctcgatctccctgcacagcgccagcacctgcgcacgctggaaaggctcggcgggcagcagtgacgggccttcctgggtgtgttcgaggtactcaaggatcacgctggtttcgttgataaacccttgtttgacgcccagcaccggcactttgccgcgcgggctgactgccagggcttccagggtctggcctgcgtaaaacggcacctcttcaaacggcaaacctttctccagcagcgccagtttgaccatgttgtagtagttgctgaccgaaaatccgtaaagcttgagcatcgcgaatgcctccaggccgggtgtggggttggctgcagaagttatagagcgtcgaacccgacctgaccagcagcatcacccgcctgaatgggcgtagactggcgccctttccttgaggagccccgccatgagcgagccaaccgatatcgacaacgacgaagaagagttcaccgaaagtacgctgacccaggccatcgaaaaccagatcgaaagcgacaacccgcctgcggccaaggccaccttcaacaagctgaccctggtcggttatgagcgcgacgacatcttgaacctcatggcccacgtgctggccgtggagatcgacaaaatgctcgaagaagaccgcgcattcgataccgaatggtacgaaaccgcactgcgggcactgcccgagctgccgcctgaaaacgactgaatccagtacctttgtggcctggaagcctgcttcctcgccacaaacctgcgccatatcaagacccacgactttctcactggacagcccggcaaagtgcgttcaccttatgccctgctagcctctaataaattttagaaagtctggagtccttatgtcgtatacccctgagttggttgccgaactggaaatccttgtactctttcccttggacagcaccaaggaaggtctgaaagtccaccagaccgccgcccccactgccatcgccgctgccaagcgcctccacgtcaaagggcttatcgaccagccagacgggggctacctgaccagcctgggccgtgatgctgccgagcaagcccaaaccctgctgaccatcctgaccaccgccaccaccaaagaagctgcctgacacctgatcccgcccatggagtccgccttctgcggattccgagggcgttgctgtggaagacacaaaattctgacgtcaataaccctttccctctaaacctcctacgcttctggctgtaaactcctacacggccgcccacgtcgggctctgcgagccaacgacctagaaatgacccgcacccacgaaatccgccccgacctggacgaaggcatcgaccgcaaggtgctggcccagttgcgcgcgcggttcatggccctcaatgcaggccgcatggcccgggccattgaggggctgacaccacgccaacaaagcgtgctgaccctgttgccgctgtttttccacgtcaatcatccgttgctgccaggctatgtctcgggcagtacgccagcaggtctgtcgaacttcgagcccgacgcccaggcgcttaccgaagcccagcgcctgacccgctcgttctcctacaagccacgtcatggcaacccaccccggccgatccacggcctgttcctgatgggcagcctcggcaccctggcccaggcggatcaaagcgacatggacgtgtgggtgtgccatgcgccggaccttggcgaaaccgaactggccgagctgcgcaaaaagtgccagttgctggaagcctgggccttgagcatgggcgccgaggcgcactttttcctgatcgagccgacgcgctttgtactcggtgaacgcgacacgcaactgagctccgacgactgcggcaccacccagcactatttgttactggatgagttctaccgcaccgccatctggctggccgggcgcacgccgatttggtggctggtgccggtgtacgaagaaacccgctacgccgaattcacccacacgctgatttccaagcgttttatccgcgcggatgaaaccctggacctgggccacctggctcacattccgccaggcgagttcatcggcgccgggctgtggcaactgttcaagggcatcgagtcgccttacaaatcggtgcttaaactgctgctgactgaggtctacgccagcgaacacccgaacgtgcattgcctgagcctgcgcttcaagcgtgcggtgtttgccaaccagatggacctggatgagcttgacccgtacatcgtggtctaccgccgcatcgaggaatacctcaaggcgcgtaacgagccggaacgcctggaacttgtaaggcgcgcgctgtacctgaaggtcaatcgcaagctcagcgccggccaacgcggcacaagctggcagcgcctcttactcgagcgcctggcccatgaatggggctgggaccaacgccaactggccttgctggacagccgcagccagtggaaagtgcgccaggtcgcctccgagcgccgtgcactggtcaatgagctcaattacagctatcgcttcctcactcagttcgcccgcaccgagcagaccgtcagcctgatcaacaaacgcgacctcaacgtgctcggccgtcgcctgtatgcggcgttcgaacgcaaggccggcaaggtcgagttcatcaaccccggcatcgccccggatttggccgaagacaccctgaccctggtgcaatcgcccaaccgcaaagagcccggccaacaccattggggcctgtacaacggcaacctcacggcgctggagtgggagcactttgcaccgatcaagcgcagccgcgacctgttggaaatgctcacctggtgccaccgcaacggcgtgatcgacagcagcacgcgcctggcgctgcacccgggcgtcagcgacatgaccgaattcgagctgttcaacctgttgggcagcctgcaacagaccatcgccctgcccttggccagcgtcgatgaagagcgtttattgcgctcggcggtgccggaagaagtgctgctactgatcaacgtcggcgtcgacccgctcaagcatcaccgcgacctgaatatcctgatgaccaccgagcgcaccgactccttgagctatgccggtgtgcgcgacaacctggttttgaccctggatcaggtcacgctcaacagttggaacgaggtgctggtcagccgctacgacggcccccacgcgctgctcgattgcctgcgcgactacctcaaccagttaccgccggaccacttgccacgcctgcgggtgcgttgtttctgtcacaaccgtgcgcagttcattgcccagcgcgtagaggaaatcttcgacactgcgcagaacctgctgctgggccagggcaatcaccgctacttgctgcaggtgcagcagcactaccacgtgatggaactgatgccgggccaggccacccatgtgtcactgccgacccaggatgcactgatcgcctacctcagtgaagaactggccagctacagcccgctgcacctggacgccatggccctggaagaccacgacctcgcgctgctgttgcccatgggcctggccgattgtgtacaggtgttctaccgggtcaatgagggcttcgccgagttgtatgtgctggatgaattcaacgcgctgtggcagcaacgcttgccgttccatgacgaacaaagcctgttggcgccgttgcagcgttttctgcagtcgatcatctaccgccgcgaagcgctctcgccgctggacacgcaccagccgttgggcgaggtgcaaaccttgtattaccaactgttgccgtccggcagccatcgcgcacgaggcatcgagccccggccagcccctcagaaccccgccaacaagccgttttatgacgtgcaggcgattatcggcaaggccgcgcccggccaggtcggcatcacgctgtactgcaatcaacgggagttttcggagttggagttcggcgaccaactgtttgcagtggtcgcccaggaaatcgtcggccagcgccgggaaaccgagcgctaccgcagctacatcaccgacctggacctgtccggcctgctcggtgatgtgcaaagcccgagcaacttgtacctgcgctacaaggccgagctggagttgtcactgaatgcggcgctgagccagatttaaagcgagaaggcgccgccatctttgggctggccttcaacactgagcagttcaagcttgagggttttgccgcccggcgccggccagtcgatgtgctggcccacttgcaggccgagcaacgcgctgcccaccggcgccaggatcgagatcttgccttcgtcggcattcgcgtccttgggataaaccagggtcaggtgatagtccttgccgctgccttgctcacggcaatgcacgctggagttcatggtcacgacgcttgcaggcacttcatcgtggccaaccacttgttcggcacggtcgagctcggcttgcagcgcgacaacacccgactgagtctcgtccatgcggtcgatcagttgctcaagacgctgcacgtcaagacgggtaagaatgatggaaggtgcggtcatgattcaggcagactccttttttctgcacaaaaaagcaaaaccccgccaggaaaaggcggggttctcacggacctcgatgagttgaggcgtacccggacactaccacagcgtcacaaataaacaagacgacctcaggcgaggctccgacgctgctcggcctcggcacagatcacccggcgccgggcatcgtcggcggagcgccattcacggatgtcttccacgtggcggaagcagccgaggcagactttttgctcgtccaggcgacacaaactgatacaaggtgacggcaccgccgggctgacattgctgaacagcggcttgggcgggcgtacaggtgcaggctgggtcacgatcaaatctcgtcgaagtccagctcgacgccggcttgttcttgaaccaggcgtgcgagcatttcgctcaacagctcatcgctggtatcgcactgccaattgttgtcttcttcgctgaagtcgaagtgaaaaccacccgaacgcgccgccagccacagctgacgcagcggctcctggcggctgaagatcagttgggtgccgttttcaaacttgacggtcagcacgccggccgagttttccaggtccacgtccaggccgctgtcgtcgaaaatatcttccagcgcctgctgggtcgaatccaccaggtcgtgaaaacgggcttcggtcaaactcattgtggcaacctcaaaagtgtctggttttgctcaagcgccgcacgatacgggcgagccccgctgattgcaaaggataccgagttcattaccgatggcggtatgaaatatccacggccagcgtagcctgcttcccagccatctcggcaaacccccgccggacgggtattccggcgcataggcaagctggcgggtggtcggtatactcgggcgcaattaatgcatattcaaggatttcgccatgaagcgcctgatctcttcccttgctgcgctcgtcgcggtcgcttgcctcgttactgcctgtggtcaaaaaggcccgctgtacctgcccgatgacagcaaagacccaaatgatcaggcgcagtcgtcacaaaagccgtcaaaggcgcacaagcacgacacctatcaataagggaaacccatggacgcttttaactaccgggacggcgagctgttcgcggaaggcgtggcgctgtccgcaattgccgagcgctttggcaccccgacttacgtgtactcacgtgcacacatcgaagcccaataccgcacctttgccgacgcgctcgaaggcacgccgagcctggtgtgctacgccgtcaaggccaactccaacctgggtgtactgaatgtcctggcgcgtctcggcgctggtttcgacatcgtttcccgtggtgaactggagcgcgtgctggcagccggcggccaacctgacaagatcgtattctccggcgtcggcaagagccgcgaagacatgcgccgtgcccttgaagtaggcgtgcattgcttcaacgtagaatccaccgacgagctggagcgcctgcaagtggtcgccgccgagatgggcgttcgtgcgccgatctccctgcgcgtcaacccggacgtcgatgccggcacccacccgtacatttccaccggccttaaagagaacaagttcggcatcgccattgccgacgccgaggacgtgtacatccgcgccgcccaattgccaaacctggaagtgctcggcgttgactgccatatcggctcgcaactgaccagcctgccaccgttcctcgatgcactcgaccgcctgctggcgttgatcgaccgcttgggcgaatgcggcatctacctgcaccacatcgacctcggtggtggcgtaggcgtgcgctatcgcgatgaagagccgccgctggtggctgactacatcaaggccgtgcgcgagcgcaccgaaggccgtgacctgacgctgatgttcgagcccggccgttatgtcgtcgccaacgccggcgtgctgctgactcaggtcgagtacctcaagcacaccgagcacaaggatttcgccatcgtcgatgcggcgatgaacgacctgatccgcccggcgctgtaccaggcgtggatgaatgtcaccgccgtgacgcctcgcgaaggcgaaggccgcgcctacgacatcgtcggcccgatctgcgagaccggtgacttcctggccaaggagcgtcagctggcgctggaagaaggcgacctgctggccgtgcattcggccggtgcctacgggtttgtcatgagttccaactacaacacccgcggccgtgccgccgaggtgctggtggacggtgatcaagcgtttgaagtgcgtcgccgcgagacggtagccgagttgtatgctggcgaaagcctgctgccggagtaagccatgctgctgcgttttaccaagatgcacgggctgggcaatgactttatggtcctcgacctggtcagccagcacgcgcacatcctgcccaaacacgccaaacagtggggcgaccgtcacaccggcatcggttttgaccagttgctgatcgtcgaggcgccgagcaacccggaggtggatttccgttatcggatcttcaactccgatggttccgaagtggaacagtgcggcaacggtgcgcgctgcttcgcacgctttgtgctggacaaacgcctgaccgccaaacgccagattcgcgtcgaaaccaaaagcggcgtgatcgaactggacatccgcagcgatggccagatcagcgtgaacatgggcgcgccacgcctggtgccggcggatattccgttccaggccaccgagcaggcgacccattacgcgctggaggttgatggcaagacgctggatatcgccgccgtgtcgatgggcaatccccacgccgttctgcgggtcaacgacatcaacaatgcgcccgtgcatgaactggggccgaaaatcgaacatcacccgcgctttccggcacgggtcaatgtgggcttcctgcaggtgatcgaccgtacccgcgcgcaactgcgcgtgtgggaacgcggcgccggcgaaacccaggcctgcggcaccggcgcttgcgctgcggccgtggccgcgatcagccaggggtggatggattcgccgctgttgatcgacctgcccggtggacgcttgtccatcgaatgggcaggccctggccacccggtgatgatgaccgggccggcctcgcgtgtatacgaaggacaggtccgtctatgagtgagccaagctaatgaccgataagcctcaagtacccgcccaagcaaacccaagcgaaagtctggaggccgctgcagtcgcggcgtaccttgaggctaacccggacttcttcgtcgaacacgaagagctgctaccggccctgcgcattccccaccagcgcggcgacaccgtgtcgctggtggagcggcagatgaagatcctgcgtgagcgcaatatcgaaatgcgccacaagctctcgcacctgatggacgtcgcccgcgacaatgaccgtctgttcgagaaaacccgtcgcctgattcttaccctgatggacgctaccagcctggaagaaacggtgatcgccgtggaagacagcctgcgccaggacttccaggtaccctttgtcagcctgatcctgttcagcgacaacccaatgccggtgggtcgctgggtcagcggtggcgaagcgcaaaccgcgattggcggcctcctctctgaaggcaagaccatcagtggcaccttgcgcgagcatgaattggacttcctgtttggtgccgaacagcgcaagcagatcggctcgactgccgtagtcgccctcagctatcaaggcctgcatggcgtattggccatcgccagccgtgatccgcaacactacaaaagctcggtgggcacgctgttcctgacctacatcgccgaagtgctcggccgggtactgccgcgcttcaccaccgccctgcgcgcggtgcgctagccatggaacggcaactggacgcttattgcgctcacctgcgcaacgagcgccaggtgtcgccccatacgctggaagcctatcgacgggacttgaacaaggtcttggcgttctgcgaaaaacaacagatcgccagctggaaagctttggatatccagagcctgcgcagcctgatcgcacggctgcaccagcaaggccaatcttcgcgcagcctgtcgcgcctgctctcggcggtgcgcggcctctatcactacctcaaccgcgaaggcctgtgtgaccacgacccggccaacggcctgtccccacccaaaggcgagcggcgcctgcccaagaccctcgacactgatcgcgccctgcaattgctcgacggcgccgtcgaagacgacttcctcgcacaccgcgaccaggcgattcttgagctgttctattcctcgggcctgcgcctgtcggagctgacgggcctgaacctcgaccaactggacctggctgacggcctggtgcaagtgctcggcaagggcagcaagacccgcgtgttgccagtcggccgcaaggcgcgggaagccttgcaactgtggctgccgctgcgtctgttgaccaaccccgcggacgatgcggtgtttgtcagccagcaaggccggcgcctcgggccacgggcgattcaggtgcgggtcaagctcgccggtgaacgcgagctggggcagaacctgcacccacatatgctgcgacattcttttgccagccatatgttggaatcgtcccaggacctgcgcgcggtgcaggaactgctcggccactccgacatcaagaccacgcagatctacacccacctcgacttccaacatctggcgacggtgtacgacagcgcccatccacgggccaaacgcatcaagggcggcgactcatgagtatcaagctgatcaccttcgacctggacgacacactctgggacaacgtacccgtcatcatcggcgccgaagcgtcgatgcgcgagtggctggcgatcaacgccaccaaagtcggcgaattgcccctggagcatttcgcccgcttgcgccaacaggtgctggagcgccatcccgagctcaaataccgcatcagcgtcctgcgccatcgggtgttgatgcacgcgtttgaagaggccggttatccacagcctgaagccacggaaatggcggatgtgtgctacgaagcgtttattcatgcgcggcaccaactcacaccattccccgaagccgagccgatgttgcaggcgctgcgccagcactttttgctgggggtgatcaccaacggcaatgccgatgtgcagcgcgtcgggctggcggactatttccattttgccctgcgcgccgaagatatcggcatcgccaagccggatgcgcggttgtttcaagaagcgttgcaacgcggtggcgtggacgccagtcaggcggtgcatatcggcgatcaccccggcgatgacatcgccggggcgcagcaggcagggctgcgtgcggtgtggtttaacccgacgggtaaggcatgggaggcggataagcgcccggatgcggaaattcgtaacttggcggagctgccagcgctgctgcgtagctggatctgacgctatagccgcaacaatgaagatcaaaatgtgggagcgggcttgctcgcgaatgcggtctgtcagtgactggtgaggtgactgatacaccgcattcgcgagcaagcccgctcccacatttgactgttagtggccggtagaattgttacagccatgaaaaagcccgcagcgacggcgggctttttcttacaagcgagcggctgaccttagataggacggctgccgtacttgttatccggcttcttcggcgggtctgccaccacgttagcctcgacttcctgcactttgccgcctttagcgaggaattcttccatcgcacgggccagcgcatcgcgctctttgttcttggcttcaacgctcggcagttcgtctaccgatacagcggccttggctttgcctttggcggctttggcgggcgcgtcatcgctgatttcgtcgccatcgtcagcaacgtcttcaaccgccgcttcaagaccctcttcggtctcgtcgtcgtcgcctacttcaagttcgtcgttgtccagatcatcgtcgctcatgttctacctcatgacttgcgaaaagcagattagttatagcccagcttcaccctctgtcgagtttgccggaaaaaatcacatccaccggattaccagtggcttatgccccatcaccgtgcaaggtggcgaggactttacgagcaccgccatgatcacggtgctcgcccagataaacaccttgccaggtccccatcgccaagcggccggccttgaccggcaaactcagctggcagcccaggagactggccttgaagtgcgccggcagatcatccggaccttcgtcgttgtgttcatatcccgccatgccttgcggcaccagcgcattgaaaaaacgctcgaagtcacggcgaaccgccgggtcggcattctcgttgacggtcaacgaggccgaggtgtgctgcagccacaaatgcaacaagcccacgcgacaagccttcaattcaggcaagccggcgagcaactcatccgttaccaggtgaaagccccggggctttgcccgcagggttatcagggtctgttgccacatacagttctccgcccatcggcgcgcattctagcgcgctcagggaaaaaacaaagtaccgaatacgcctacatgcatgtaagacttttgcacgctgaaaagtaccgtgtgcgcgccatcacaaactctgcgcaaaaaccggtacaggtcctatcactgacaaacgccaggcaaaaaaatgcccggcaagccgggcatctttttttcgcgtacttacaagttgtagccgcgctcgttgtgttgcgccaggtcgaggcccacggcctcttcttcgtcggtaacccgcaggcccatgacggcatccagcaccttgaggatgatgaaggtcacgatagccgtgtagatcacggtgaaaccgacgcctttgcactggatccagacttgcgccgcgatgtcagtggtggctgcgttgaagccgcccagggaaggcgcagcgaacacgccggtcaggatcgcgccgaggataccgccgataccgtgcacgccgaaggcgtccagggagtcgtcgtagcccagtttgcgtttcagggtagtggcgcagaagaagcacaccacgcccgccgccaggccgatgaccagggcgcccatcgggcccacggtgccggcagccggggtgattgccaccaggccagcgactacgcccgaggcgatgcccagtgcgcttggcttaccgtgggtgacccactcggcgaacatccagcccagcgccgcagcagcggtagcgatctgggtgaccagcatcgccataccggcagtgccgttggctgcggccgcggagccggcgttgaagccgaaccagccgacccacagcatggccgcaccgaccagggtgtaacccaggttgtgaggtgccatcggcgtggttgggaagcctttacgcttgccgagtaccaggcacgccaccaagccggccacaccggcgttgatgtgcaccacggtgccgccggcgaagtccagcacgccccagtcacccagcagcgaacccggaccgccccacaccatgtgcgcaatcggtgcgtagaccagggtgaaccagacgcccatgaagatcagcatcgcggagaacttcatacgctcggcgaaagcaccgacgatcaacgcaggagtaatgatggcgaacgtcatctggaaggtgacgaacaccgcctcagggaacagcgccgcagggccggtgatgctcgccggggtcacgcccgacaggaacagtttggacaggccgcccacgaacgagttgaggttgacgacgcctgcttccataccggtggtgtcgaacgccatgctgtagccgtaaacgaaccacaagatagtgatcaagccggtgatggcgaagcactgcatcatcacggaaagaatgtttttggagcgaaccatgccgccgtagaacagcgccaggcccggaatagtcatgaacagcaccagcgcggtggacgtgagcatccacgcggtgtcgccggaattgaggactggagcaggggctgggtccgccgccaatgccagggccggcattacgagggacaacagggctcctagccctgcgaatttacgcagagtcatattgttttctcctggggcgttgggggtttggcggcttagattgcgtcggtatcggtttcgccggtacggatgcgaatagcctgttccagattgaccacgaagatcttgccgtcaccgatcttgccggtgttggccgccttggttatcgcctcgataacccggtcaagatccttgtcgtcaatggcgacatcaatcttcaccttcggcaggaaatcgaccacgtattccgcgccgcgatacagctcggtgtgacccttctgccgaccgaagcctttgacctcagtaacggtaatgccctgcacgccgatctcggacaacgactcgcgtacatcgtccaacttgaacggcttgatgatggcagtgactagcttcatgaaaactctctcccgaattggtggacttgccccaggaaaacaaacccgtctcaagtctaagcgcagtgcctggctttgtaacgcgtcgtcgcctcggcatttaccgttgcgacgccagcgaaccactggtgacgaaacctgtacccctgatccgtcggcgcactgcattcgtcacagcgactgcatcagtgcatgggtcatgatcgtctaagcagaaaccttgccagctccgtaaaaatcactgaaatcagtcctttgcccacttatgcccacctgcgggacgaattggcggccgcaatgcgcacaaaaacagtgcgcagccgcccggccctctgcgcgaaaagcgtgcgctcacggccgtgaaaatgactatagacgctgcgtgatacactgccggccaacagttttccggaatatttcccatgctcgcgcccaaagacctcctcgacgccctgagcggccacgcctctcgcctgttcagcggcgacaccccgctgccccgcaacgaaatcgaaagccagttcaaggcgctgctgcaaagcggcttcagcaaactcgacctggtgagccgggaagagtttgatagccagatggtggtgctggcccgtacgcgtgcacggttggagagtttggaggcgaaggtggcagagctggaagcgcggctgacgccaccctctgctgaataaacgcagtcagtgtgggagctggcttgcctgcgatgcagacgcctcggtgtatcagttgcacacaggcgatgctatcgcaggcaaaccagcccccacatttgctctacatcgcgcttcggatacgttctgtaaaacctcccccgcctcgctcttccccacctcgtctacccttgaaaaacccgcaggaagcggcctctctttcaaggaacgagcatgtccctcgccatcgtccacagccgcgcccaaattggcgtcgaagcccctgccgtcactgttgaagtgcatatggccaatggtctgccgtccctgacactggtgggcctgccggaaaccgccgtcaaggaaagcaaggaccgcgtgcgcagcgccatcctcaactctgcgctgcaatacccggcacgccgtatcaccctcaacctcgcgcccgccgacctgcccaaggatggcgggcgttttgatttggcgattgccttggggattctcgccgccagcgtgcaggtgccgtcgttgatgctggacgacgtggaatgcctgggcgagttggcgctgtccggcgaagtacgtgcagtgaaaggtgtattgccggcagccttggcggcgcgcaaggctgggcgcaccgtgatagtgcctcgggcgaatgccgaggaagcgtgccttgcctccgggttgaaggtaattgcggtggaccacttgctgcaggtggtggcgcacctgaatgggcatgtgccgattgagccctataaatccgacggcctgctgtacttgaacaagccctacccggacctgagcgaagtgcaggggcaattggcagccaaacgcgcgctgctgattgcggcagcgggcgcgcataacctgctgttcagcgggccacctggcaccggcaagaccttgctcgccagccgcctgcccggtttgctgccgccgctgagtgaacaggaagctctggaagtggcggcgattcagtcggtggtcagcctcgcaccgctgagccattggccgcaccgcccattccgccagccgcaccattcggcgtcggggccggcgttggtgggcggcggttcgaaaccgcagccgggggaaatcaccctcgcccaccatggcgtgctgtttctggatgagttgccggagtttgatcgcaaggtgctggaggtgctgcgagagccgctcgaatccgggcacatcgtgatttcccgtgcgcgtgaccgggtgagtttcccggcacgctttcaactggtcgcggccatgaacccctgcccttgcggctatttaggcgagccgagcgggcgctgtcggtgcacgccggagcagattcagcgctatcgcaacaaactctcggggccgctgctggaccggatcgacttgcacctcaccgtcgcgcgggaaaccacggcacttaacccgacccagcaggccggggataacacggcgaaggcctcggcggaggtggccgacgcccgcgagcgccagcaaaagcgccagggctgcgcgaatgcctttctggatttgccagggttacgcaaacactgccaattggcgaaagccgatgaaggctggctggaaagcgcctgcgagcggctgacgctgtcgctgcgtgcggcacatcgtttgctcaaggtggcgcgcaccttggccgaccttgaacgggttgaaaacatcgctcggcatcacttggcggaggcgttgcagtaccggcctgcgtcggtgagctagcctgaaaacccaaaatccatggccagcgggtttgtcgtggcgagcgggcttgccccgcgttggagtgcggagcgctcccaatccgaccgccgcggttctactgataaacccggtcgccaggtcctggggctgctgcgcagcccaacgcggggcaagcccgctcgccacggaggaatatgctggccgccaaaagtggtgtggcggcctatgctggaaagtccagcaacagcctcgccacttccatcacttcacccaacaccgcttctgccgattcagttgacggcttgagcatcaggtcatcggcataccccatcgccaacgcgaaaatctgccgggcagcacgttggggagaatcacttcgaaaaaccccttcagcaaccccctgctcaatcacctcggcgagcatgccttgccactgggcattaatcaccagatacgcctcggccatttgcgggtcgtgcatcgcttcgtcccaggcatccagccacaacgcccagccggcgtcggcggtgcacggcaggcagtcgcgcaagaaccccaccagcgcttcctgcggcggcacgcccaccagcggcgcgcgtacttcctccagttgctcgttggcaaagcgcacaaaggcttcgcggcgcagttcattccagtcgctgaagtagtgatagacgtggctgcgcgacaggccggcatgttcggccaagtcgcgggtggacacatcggcaaaccccttgctgcgaaacagctccagggcggcggcgatgatctggtctttacggtcgatacgcgacatgggcaattccttcgggcgccggtagatgagcggcgcttgcttttgagcgatcgctcaagaatacttgagcagtcgctcaataatagcgtctatcactcctttggtgcaccccatgtcatccgctaccccgcaaatgctgatcgaagaaagcaagaaaatcggccagcaatccgccagccagaccctcaaggcgatcgcccgcgcgtatcccggcaagctgttttgcacactgtcgctggttgcgctggagaacgcactgctgttggcgtatccactgtttgccgggttcgcagtggactcgatcatccgcggcgatgccggcagcgccttgttctacgccgccgtggtcttggcattctgggtcgtcggggccgcgcgccgagcgctggacacgcgcaccttcacacgcatttacgccgacctcgcggtgccggtgatcctcaaccaacgcctgcaaaaccacagcacctcacgggcggcggcgcgggtggtattggcgcgggactttgtcgacttcttcgaaaagcacgtgccgatcatcgccaccgcgctggtgtccatcgtcggtgcggcagtgatgctgctggtgatcgaaccgtggatcggcctggcgtgcctgacggcgttgctgttgtgcaccatcttgctgccacgctttgcccggcgtaaccagcagttgcatgagcgcttgaatgaccgcctggagaaggaaatcggcctggtggaaaaagtcggcgcgcagacgttgcagcgtcactatcaagtgttgtcgcgcctgcgcatctggctctccgaccgcgaggccgccgcgttcctgtttatcggtacgctggcagccttgctgtttgtggtcgcgatcagccaattggcgttgtcgccggcggtcaaggccggccatgtctacgcggtaatgacctacctgtggaccttcgtcagcagcctggacgaagcaccgggcatggtcgatcaactggcgcgcctgaaggacatcggcaaacgcgtagacccaggcctgggcgagcgctaagcctcaacgaaagcggtccacctcatggcgcaagccggccgccagggtttccagttccttggcggtaacggccaggttcgacaccacttcacgctgctcgctgttggccagggcaatgctctgcaggttgctgctgagcaaggtcgcggtgctgctctgctcctgcgtcgccgtggtgatcgcggcaaattgctgaccggccgagcggctctgctcgtcgatccgcgccagcgccgaggccacgtcggcattacgcgacagaccttcctgcatcaacacattgccctgctccatggtgctgatggcgttgccggtttcctgctgaatgctctggatcatcccggagatttcgtcggtggcctggcgcgtacgcgacgccaggttgcgaacttcgtcggcgaccacggcaaaaccacggccttgttcaccggcacgggcggcttcgatagcggcgttgagcgccagcaagttggtctgttcggcaatcgaggtgatcacgccgacgatcccgccgatttcctgggagcgttgccccaaggtattgatcaccgtggccgtgctgttcagtgccgccgcgatatgttccagcgacgacgacgcctcttgcatcgaggtgcgaccgatgcgggtctgctgggcgttctcctgggcaaggcgctcggtattgcccatgttgtcggcgatgttcagcgaggtggcgctgaattcttccaccgcgccggccatgctggtgatctcgccggactgctgctccatgccttcataggcaccgccagacaagccggacaaggcctgggcacggctgttgacgtcttccgcggctttgcggatgtgcgagaccatcgtcgacagcgcttcacccatctggttgaagctgcgcgccagttgaccgatttcgtcatggctggacacattcaagcgcgcgctcaaatcacccgcacccaaagcttcggcctggcgcaccaagtcactcaacggctgcaacttactgcgcagcagccagaccgccgcgcccaccgccagcaacatcgccagcatgctgccgatcaccaggcgaatccccacagcccaggtgactgcgcggatctcggacttcggcatgctcgccaccaccgaccacgggccaccttcaaacggcaccgagacgctgtagaagtcttcgttcttgtcgctccagaagcggccttggccgggttttttcgccaggtcgagcatcaccggaatcgcttgatccaacgcctgcacgcccgcgggtggcaccagccagtgtttctgttcatccagcaacgccagggaaccggtctggccgatacggaagcgcttgaggttgtcgaactgggctttctgctcatcggtgtaatcaaagccgataaacaacacggcgatcactttgccgctggcatcacgcaccgggctgtattgggtcatgtaggaacgatcgaacaacaccgcccgcccgatgtaattctgcccggccaacaggcgctgataggccgggtgctggtgatcgagcaccgtgccgatggcgcggttgccatcctgcttggtcagggaggtgctgatgcggatgaagtcttcgccgctgcgcacgaacaccgtggccacgccaccggacatctgcttgaactcatcgacttcatcgaagttgttgttcagcacctcatcgcccagcagcaggctcggagtctgcacgccggccacggtgaccggttgatctgcacgcacactcaacccggcgacgaagcgtttttcaaacagcccgctcaaacgctgggtactttcgcgcaaggtgctgtggaaggtgttgagttggtcggcgagcaagcgcgcctcgctggccaggtgttcctcgcgcgtgtcgaggttggcggagtcgagggaacgcagggcgaaaaccgtgctgccgctgatgacgacagccagaataacggcgagtgcgaggcctaattgtgaggcgatccgagcgcgaggttgggacatgacagctcctggccgaggccaggatcatcctgatctcatagcgctgctcggcaaattatctagtgggaaacgttggcgcacgatagttccaacacaccttattcggcgggtgcgggcaatacttgagcgattcacaggggtatcgcgcaaacgattgcattaacggcccgccgcgtgccagtcgagacgctcgacctggggcaattccatggccttgacctcaccttggagaaactccgccaaacgccgcagacgctcgccaccggggcgggttttcggccataccaggtagtagttttccccactggccaccgccgtcggccacggcaggctcagccggccctgggccacgtcttcggccaccatcagcaggtcgcccatggacacgccataaccccgcgcggcggcgatcatgcccagctcaagcgtatcgaacacctgcccgcccttgagcgacacctgggacgacagccccatgcgctccagccaattgcgccagtcgcggcggtcgggcgtggggtgcagcaattcggcggacgccaaccgcgtgacgtcccaaggcccgtcttccagcaggttcggtgcacccaccggaatcagcaattcggggaacaggtagctggcttcccagtccgccgggaaatgcccgtaactcaacaacaccgcgcaatcgaacggctcctgattgaagtcgacttcatccacgctcatccatgcactggtcaattgcacttcgttacccggctgcaacgcccggaagcggctgagccgcgccagcaaccagcgcatggtcaaagtcgatggcgctttcatgcgcaggatgtcgtcttcggcattcagggtatggcaggcccgctcaagcgcggcaaaaccctcgcgtacgccgggcagtagcaggcgcgccgcttcggtgagttgcaagttgcggccgctgcgctggaacaggcggcaggcgaagtgctcttcgagtgtacggatgtgccggctgacggcactttgcgtaatcgacagctcctccgccgcccgggtaaaggagttgtgccgcgaagccgcctcgaatgcgcgcaaggcatacagcggcgggagacgacgtgacataaacagacctcctacagagcaatgtccaaccctagcatgagttttaatcatgcgaacgatcgcttttatccttttgtgtaatgcgtcaagagcgccgaaaatcaacccttccccaaccctctgacttcctgagcgtgatgatcatgcagcatccggtgcgtactgaactctgggccattctgcggctgtcggggccgttgattgcctcacagttggcgcacatgttgatggtgctgaccgacaccctgatgatggcccgcctgagccccgaagccctcgccggcggtggcttgggtgcggcgagctattcgttcgtggcgattttctgcatcggcgtgattgccgccgtcggcaccctcgtggccatccggcatggcgcgggcgacattgaaggcgccacccgcctgacccaggccgggctttggctggcctggctgatggccttggtcgcgggcttgctgctgtggaacctcaagcccgtgctgctgatgttcggccaaaccgaaaccaacgtgcacgcggcggggcaattcctgaccatcctgccgttcgccctgcccggctacctgagcttcatggccttgcgcggttttaccagcgccatcggcaaggccaccccggtgatggtgatcagcctgtgcggcacagtgctcaactacgtcctcaaccacgcgctgatcgagggcatgttcggcctgccgaaactcggcttgatgggcatcggcctggttacagcgatcgtcgccaacagcatggccctggcgctgatgtggtacatccgcagcaaccgggcatacgcggcctacccgctaagcaacggcctgctgcgcctcaacacccaatacctgcgcgagctgtggcgcctgggcctgccgattggcggcacctatgcagtggaagtcggcctgttcgccttcgcggcgctgtgcatgggcaccatgggcagtacgcaattggcggcgcatcagattgcgctgcagattgtctcggtggcgttcatggtgccggcggggatgtcgtacgcgatcaccatgcgcatcggccagcattacggcgccgggcagttactggcggcgcgcatggccgggcgagtcggaatcggctttggcgcggcggtgatgctggggttcgcggcagtgttgtggctgttttccgatgcgctgatcgggctgttcctcgaccacaacgacccggccttccacgacgtcatcgtgctggccgtcagcctgctggccgtggccgcgtggtttgaattgttcgacggcgtgcagaccatcgccatgggctgcatccgtgggctgaaagacgccaagacgacctttctggtcgggctgggctgctactggctgatcggcgcgccgtcggcgtggctgatggcgttcaccttgggctgggggccaaccggcgtgtggtggggcttggcgttggggctggcgtgtgcagccgtgagtttgacctgggcgtttgaggcgaagatgaaaaggatgattcggcgggagccggaaattcgcgctgaattccaagccatgcagccagactagcgactgtactcggtcaatgtgggagctggcttgcctgcgatggcatcacctggttatgccagacacaccgaggtgcctgcatcgcaggcaagccagcttccacacaagccagctcccacccttcagcccagcaaagcctgctggctcttgccgaatgtcaggtactccaccaactccgccaacggcaacggcttgctgatcagataaccctgcgcctgatcgcaaccaaacaaccgcaacagcgccagttgctcaggtgtttccacaccttcagccaccacttccaggttgaggttgtgggccaggttgatcatggcgtgcaccagcttgcggttttcttcgcgctcttccatgccgccgacgaagctcttgtcgatcttcaacaaggcaatcggcaggctgttgaggtgcacgaacgaggaaaaaccggtgccgaagtcgtccagggaaaaccgcacacccaggcggccgagggcgtccatggtctgcttgaccaggtcactgcggcgcatcacggcagtttcggtcaattcgaactccagccactgcgcctccacgccgcgctcggcaatcagccggctaagtgtcgagagcaactggctgtcctggaactggcgaaacgacaggttgaccgccatgtgcaacggcggcaggccgcgttcgcgcaagtcttgcatgtcgcgcagggcgcgggagatcacccagtagcccagcggcacaatcaggccgctctgttcggccagcggcacgaattcgctgggcggcagcaggccgcgttcgccgtggcgccagcgcaccaaggcttccaggccgacgatatgcccgtcgtccaggtccaggcgcggctggtaatgcagttccagctcatcacggcgcaacgcgcggcgcagttcgctttccaggtcggccaggctgcgcgcgttgcggttgatgcgttcattgaaaatatgaaaggtgcagccttgggtgcttttggcttgctgcatggcgatgtgtgcgtgccacatcaacgggtcggcgccggcgcgtgcgcgggcatgcgccacgcccaggctgcagccgatcagcaggctttcgccatccacccaatagggttcggccatggcttcagtgatgcgttcggcgatccattcggcacgttgcggcgcgcggcgggtatcaatcagcagggcaaattcgtcgctgcccaggcgcgccagttggtcgccggcttcaagctggctcttgaggcgcgagaccacttgcaggatcaatcggtcgccggcctggtggcctagtgcgtcgttggcatgccggaagttgtcgaggtcgagatggccgagggccaggccgcgaccctcgttctcggccaaccgcgccgtcagcaaggtctgaaacccctggcggttggcgatgccggtgagcgggtcttgttcggccaggcgttgcaaggtggtttccagcacgccgcgctcgcggacatggcgcaagcaacggcgcaatgtatcggcatccagaacatcaaggatcaaccaatcgctcacaccgagcggcgaaaccagtggctcctgttccaacagcaatacgcacggcaggttgcagcggccagggccgggttgcaggctgggcgtggtcaataacacggcactgtggtcgtcatcgaacagacgactcaccgagtcccagttgggcgcactgatcagcacagccccttcgcccatcggcgccaggcactcgcgcaacaacgctgcccacgctggctcatcagccagtagcagcaaacgcaagggttcgacaggcgtagacaagctagctccctagactctgcaaaagtgtgttggcggcgggcattatgacgcgcggcctgataatcaccaatgataagggttatcaaatacgctgactgtaaggattagtcgcaaccttagccgtaaaagcctcccacatcctgcggcaaagtatcaaaagcggcaaatttagatcgagtggtacgtcacactgtcgttctgtgagagcagaatcctgcgagcctgttaaaatgcccgcccttttgaacaacgactccctgaattccgtatgtcccgactcaatccccggcagcaagaagccgtgaactacgtcggcggccctctattggtgctcgccggtgctggctccggcaagaccagcgtgatcacccgcaagatcgcgcacctgatccagaactgcggcatccgcgcccagtacatcgtcgccatgacctttaccaacaaagcggcgcgcgagatgaaagagcgtgtcggcacgctgctcaaaggcggcgaaggccgtggcctcacggtgtgtacattccacaacctgggcctgaatatcatccgcaaggagcatgcgcggctgggctacaagccgggtttctcgatcttcgacgaaaccgatgtgaagtcgctgatgaccgacatcatgcaaaaggaatacgcaggcgacgacggcgtggatgagatcaagaacatgatcggcgcctggaaaaacgacctgatcctgccgcctcaagccttggaaaacgcgcgtaaccccaaggaacagaccgccgccatcgtctacacccactaccagcgcacgctcaaggcgttcaacgcggtggacttcgacgacctgatcctgctgccggtgaagctgttcgaggaccacgccgacatcctcgaaaaatggcagaacaaggtccgctacctgctggtggacgaataccaggacaccaacgccagccaatacctgctggtgaaaatgctgatcggcaaacgcaaccagttcactgtggtaggcgacgacgaccagtcgatctacgcctggcgcggcgcccgcccggaaaacctgatgctgctcaaggacgactacccgtccctgaaagtggtgatgctggagcagaactaccgctccaccagccgcatcctgcgttgcgccaacgtgctcatctccaacaacccccacgagttcgaaaaacaactgtggagtgagatgggccacggcgatgaaatccgtgtgatccgctgccgcaacgaagacgccgaagccgagcgcgtggccgtggaaatcctcagcctgcacttgcgcaccgaccgcccgtacagcgactttgcgatcctgtatcgcggcaactaccaggccaagctgatcgagttgaaactgcagcaccaccaggtgccgtatcgcctgtccggcggcaacagctttttcggacgccaggaagtaaaagacctgatggcctacttccgcctgatcgtgaacccggacgacgacaacgccttcctgcgcgtgatcaacgtgccgcgccgggaaatcggctccacgaccctggaaaagctcggcaactacgccaccgaacgcaagatctcgatgtacgccgccaccgatgaaatcggcctgggcgagcatctggacacgcgcttcaccgaccgcctgtcacgcttcaagcgcttcatggacaaggtgcgcgagcaatgcgccggcgaagacccgatcagcgcgctgcgcagcatggtcatggacatcgactatgaaaactggctgcgcaccaacagttccagcgacaaggccgcggattaccgcatgggcaacgtctggttcctgatcgaagcgctgaagaacaccctggaaaaagacgaagacggcgagatgaccgtcgaagacgccatcggcaagctggtgctgcgcgacatgcttgagcgccagcaggaagaggaagacggcgccgaaggtgtgcaaatgatgaccttgcatgcttccaagggcctggaattcccctacgtgttcatcatgggcatggaagaggaaatcctcccgcaccgttccagcatcgaagccgacaccatcgaggaagaacggcgcctggcctacgtgggcattacccgcgcgcgtcagacgctggccttcacctttgccgccaagcgcaagcaatacggcgaaatcatcgattgtgcccccagccgattcctcgacgagctaccgccggacgatttggcctgggaaggcaatgacgacaccccgaccgaggtgaaggccgttcgcggcaacaccgccttggcggatatacgcgcgatgttaaagcgctagaatcgactactttttaatctactttcggcgcacaccgcgccattagaggaagctttccgtggaagcactgcacaagaaaattcgcgaagaaggcatcgtgctttccgatcaggtactcaaggtcgacgcctttctgaaccaccagatcgacccggcgctgatgaaactgatcggcgacgaattcgccgcgctgttcaaggactcgggcatcaccaagatcgtcaccatcgaagcatcgggcattgcgccggcgatcatgaccggcctgaacctcggcgtgccggtgatcttcgcgcgcaaacagcagtccctgacgctgaccgaaaacctgctgtcggcgacggtgtactccttcaccaagaaagtcgaaagcactgtggcgatctcgcctcgccacctgaccagcagcgaccgcgtgctggtgatcgatgacttcctggccaacggcaaagcctcccaggcgctgatctcgatcatcaagcaagcgggcgcaaccgttgccggtttggggattgtgatcgagaagtcgttccagggcggccgtgccgagctggacgcgcagggttatcgggttgagtcgctggcgcgggtgaagtcgttggcgggtggcgtcgtcaccttcatcgagtaatcaaaaatgtgggagctggcttgcctgcgatgagggcctgacagtcgacatctctgtcgactgacactccgcaatcgcaggcaagccagctcccacatttgatttttggtgcccgtcagtgcgcggtggcctgcaggccggcgagcaacagccgctgatacagatcctctttcaacccctccggcttatccaagcgcatccgctccaggtgcttgggaaacgcctccggctccggcgcatccagggctgctttgcccagctccagaatttcggtcagcttgaatttgctcttgagccagttcagcgctcgcaacagatccctttcctcatccgtgaaatcagtgcccagcggatactccgggaacaaccggtgatgccgcgcctgaatggccttgagccgctgcggtgtgttgtcggcaaagcgcgggtccagctggaaatccttgggcagcttgccagccttttgcgcttgttcgatcaagtcattctggaagcgcgagtcagtgatattcagcagcgcctcgatcaccttcgcatccgtctgcccacgcaaatcggcaatcccgtactcggtgatgacgatatcgcgcaggtgccgtgggatggtgcagtgcccgtactcccagacgatattggaactgacctcgcccgccgactcgcgccagctgcgcaggatcaggatcgaccgcgcgccttccagcgcgtggccctgggcgacaaagttgtactgcccgccgacaccgctgagcacacgcccatcttccaactggtccgccacgcccgcgccgagcaaggtcacggtgatcgcactgttgataaaccgcgcgtcgaggcgctgcaaacgcttgagttcttcctggccgtacagctcgttgatgtaactgatgcgggtcatgttgaattcaaggcgcttggcgtgagtcatttcctgcaagcgctggtaaaaactgcgcggcccgaggaagaaaccgccatggatcgacacgccatcgggctgcgcggcgtcgtccagggtgccggcgttggcctgcgcctgagtcgccacatccgggtagaccttgcggcggatgatgccggcgtcggccaacaccagcaggccgttgacgaacatctcactgcagccgtaaaggccacgggcaaagggcgcgacgccgccttcgtggctgattaagggcgcccactgatacacatcgaggtcggtgagtaacaggcgataggcttcgttgtccgcctggcgcgccagcaaggcggcggtcagcgcatcgcccatcgaaccaatgccgatctgcaaggtgccgccatcgcgcaccagggtgctggcgtgcaggccgataaaatggtcctggaaacccacgggcatgttcggcgtggaaaacagtgtggtgctgtcctttgcgtcgatcaggtaatcgaacgcgtccatgcccaactcggcgtcaccgggcatgtagggcaaatcggcgtgaacctggcctacgaccaggatggtttcgccggcctcgcggcgcttctcgatcatcggcagcaggtcgagggtgatgtccgggttgcaactcaggctcaggcgatccggatgttccgtactgctggccaccagctgcgccaccagattcaggccggcggcgttgatgtcgcgggcggcgtggctgtaattgctgctgacgtaatcctgctgcgccgacgcgctgtggagcaggctgccgggctgcatgaagaactgctgtacgcggatgttgctgggcaggctgtcttggtgcaggtgggcaaggaaatccagctcgggataatcaccgaatacgcgctcgataaaaggctcgagaaagcgtttctgcaaaccatcgcccatcgtcgggcggcccagggccagcgcggtatagatcgtcagcgcccgctccggcaacttggcgatacgccggtacagcgcgttgacgaacaggttgggcttgcccaagccgagcggcatgcccatgtggatatgcgcgggtaaccgcgccagtacgtcgtcaactgcttgctcgattgaacacaactgcaccatccgaccctcctgaacattccatgattaggggttggaccgagcttgccgggtctttgctgcaatgaacagcgatgaagtacaaatcgcgggcacaaaaaagccgctgggcagcggctttttggcgaagatcggcgggttacaagccagacatcttcttgattgcgccttcaaggtcatcaaggctgcaatcggagcaggttcccattgggggcatcgcattcaaaccatgcttggcgacttgcgccagacctttggtgcctttctcgggcgcctcgaccttgagttctgccagtactgcgtccacatggccaagccgctctttccaggccgccgtgtcaccgatcttcggcgcattcaacaagccggtgccgtggcacgcattgcaatgcttggcgatgacctcatccggcgttttagccgctccgccgccgcccgctgccactgcaacttccatccctttgcattcctggccctgaacacagacctggccaacaggctccaggcgcttggcaatttcatcattggtcgcagcttgagcgctgacagcccatagggccagtacggttgctggtgcagccagcattttcataattaggttcacgcgttcaccctcaatggtggctattcacgcctgcggccacggtttcgcaggcggcgaaagtataacggttagcccgaccggccgaaacaaccctattaactaaagggagattcggtcgtgcggaatacagctgcgggagtgtctgcaacgctggcagcacgcctcttctgtcaaaagttcgcgggtgtggctgcgctgattagtcgcgccggcacgtcgaacgggttgcgaaaacgatgcggcttggtgctttcaaagtagtagctatcgccggcttcgagcacaaaagtttcaacaccgaccaccaattccagtcggccttccaccagaatcccggtttcctcgccttcgtgggtgagcatttcttcgccggtatcagcccccggcgggtaaatctcgttgagaaacgcaatcgcccggctcgggtgcgcgcggcccaccagtttcatggtgacggcgccgtccgagatgtcgatcagctcattggctttatagacgatctgcgtcggtttttcctggaggatctcctcggaaaagaactcgaccatggacatggggatgccgcccagcaccttgcgcaaggagctgatcgaggggctgacactgtttttttcgatcatcgaaatggtgctgttggtgacacccgcgcgcttggcgagctcacgctgggaaagacccttcagtttacggatggattgcagtcgttcgccgacgtccaatgcaggagcctcctaggattcaggctttgttgtaattgagcgttatcatggcgacagcgttcagtatttacaacacttgggcctaaatcccggccggctccactcgtaggcggcggtcaagccccggaatagagccttggcacgcgacgcaggttgcagaagatctggtagggaatggtctctgcggctgccgcgacgtcactggcgaggatatttttgccccacaactccaccgtggaaccaagcccggcctggggcacgtcggtgaggtcgacacacagcatgtccatggacacgcggcccagcagttggctgcgctgccccgccaccaacaccggcgtacccgtaggcgcatgacgcgggtagccgtcggcgtaacccatggcaaccacgccgatacgcatcggctttggcgtgatgaacttggcgccgtaacccaccggctcaccggccggcagttcgcgcacgcagatgaccttggactccagggtcatcaccggctgcaaacgcgcggcaatggcctggtcttcgccaaacggcgtggcgccgtagagcatgatgcccgggcgcacccagtcgctggacacgctcggccagcccatcaccgaaggcgaattgcgcaggctgacttcagccgacaaaccttggcgcgccgcctcaaacaccgcgacttgttcattgctgcgtacacagtcgagttcgtcggcgcgggcgaagtggctcatcaatacgattttcgccacgttgccgctggccagcagacgctgatacgcctcgtgataatccttgggatgcaggccgacacggtgcatgccggaatccagcttgagccagatcgtcagcggcgtggtcaaccgcgcttgctcaatggcttccaactgccacagcgaatgcaccacgcaccagaaatcatgctcgatgatcagcggcagctcgtcggcttcgaagaacccctccagcaacagcaccggcgcgcgaatcccggcggcacgcagctccagcgcttcttcgatgcacgccacggcaaacccatccgcctcagcttccagcgcctgtgccacacgcacggcaccatggccgtaggcatcggccttgaccacggcgagggccttggcccccgtgacttcacgggccagttgatagttatggcgcagggcctggaggtcgatcagggcacgggcaggacgcatggcggcaggcttctaggcggcagagtgaagaaaaaaccggcaccgacaggcagcatcggcaccgggagagggatcttggtttaaggcagcgcggccacgacggacagctctaccagaatttccggttcgcacagcttggcttcgaccgtggcacgggccggggcgacgcctttaggcagccacttgtcccataccgagttcatgccggcgaaatcggcgtcgatgtctttcaagtagatcgtcaccgacagcaacttggttttgtcggtaccggccaagtccagcagacgctcgatattggccagggtttcacgggtctgctgttcaattgcggcactcatgtcgtcgccgacttgcccggccagatagacggtgccgctgtgaacaacgatctggctcatgcgctcattggtgagctggcgctggattgacatgtcgtgcggactcctggtggctaccgtaacgggaaatatcgaggcctgcggcgctgatctgcggcgttttcttcgccatcaggtcggccagcaagcggccggaaccacaggccatggtccagccgagtgtgccgtggccggtattcaggaacaggttcttgaatggggtggcaccgacaatcggcgtgccgtcgggtgtggtcgggcgtaaaccggtccagaaactggcttcggtcaaatcgccgccctgaggataaaggtcgttgacgatcatctccagggtttcgcgtcggcgcgggttcagcgacaggtcaaaaccggctatctcagccatgccgccaacgcggatgcggttgtcgaaacgggtgatcgcgaccttgtaggtctcgtccagaatggtcgaggtgggcgccatcgcggggttggtgatcggcacggtcaacgagtaacccttgagcgggtacaccggcgccttgatccccagcggcttgagcagcttcggcgaatagctgccgagggccagcacgtagcggtcggcggtttccagcttgccgtcgatccacacgccgttgatgcggtcgcccgcgtaatcgaggccctggatgtcctgttcgaagcggaactccacgcccagctgtttgcacatctcgaccagccgcgtggtgaacatctggcagtcgccagtctggtcattcggcagacgcagtgcaccggcgaggatatcggtgacgctggccagggccggctccacgcgggcaatgccggcgcggtcgagcaattcgaagggcacgccggactctttcagcacggcgatgtctttggcggcgccatccagctgagcctgagtgcggaacagttgggtagtaccgaggctacggccttcgtaggcaatgccggtttcagcgcgcagttcgtcgaggcagtcgcggctgtactcggacaggcgcaccatgcgctctttgttcaccgcatagcggctggccgtgcagttgcgcagcatctgcgccatccacaggtattgatcgatatcggccgtggccttgattgccagcggcgcgtggcgttgcagcagccacttgatcgccttgagcggcacgcccggcgcggcccagggcgaggcataaccaggggacacctggccggcgttggcgaaactggtttccatggcagcagcaggctggcggtcaaccaccacgacttcaaagccggcccgcgccaaatagtaggcactggtcaccccaatgacgccgctacccaagaccagaacgcgcatttttatatcctcatcgcgggcttggccgctgacgtgtgttattcgagcaatgatgagcgcagtgtaaaaaactattgccagtgcatttcactatataagcacctatatttggcgacaattctcggcaaaaacccttttcacagaggcgtatcccctatgcgtaccaacacccagaccaagcgggagctggacaagatcgaccgcaacatactgcgcatcctgcaaaccgacgggcgaatttcattcacggagctgggggaaaaagtcgggctgtcgaccacgccgtgcactgagcgcgttcgccgcctggagcgtgaaggcatcatcatgggctacaacgcgcggctcaacccgcagcatttgaaggggagtttgctggtatttgtcgagatcagcctcgattacaaatccggcgacaccttcgaagaattccgccgcgccgtgctgaaactgccgcacgtgctggaatgccacttggtctcaggcgatttcgactacctggtgaaagcgcggatttcagagatggcgtcgtaccgcaaattgcttggcgatatcctgctcaagctgccccatgtgcgcgaatccaagagctatatcgtgatggaagaggtgaaggagagcctgaacctgccaattccggattgaaatgaaacaacttgatcacatgtgggagctggcttgcctgcgatagcagtatgccaggcgaaacatgtgctgactgatccaccgctatcgcaggcaagccagctcccacatcttgaccgagtacatcgctagaccaagacttgccgggtgctagccatgtactcatgaatctgtttctccacccgtggatgaatcaacgccaccggccctcgcccattggggcacggcagggtcttggtggtgccgaacaaccggcagatcagcggccgctcgtcatacaccgtgcagccattcggcccgaggtgcacacagttcagttcgtccattgccgcgtcctgctcggcagcggtcttacgcggcaggcgtgacatttcctcgggcgaggtggtcaccggcccacagcaatcgtggcaacctggcacgcactcgaacgagggaatttgcctgcgcagcgcgctgattttctgactgttgcaactcatcgaaacccataccgaacagcgaataagcgtggattctgacgcaaaacgccctgcacagacagcgtcgtccgaccgctgtatcctgcgtcaaattttccaaacagggatgctccccatgactgccagcgcccggcacaccgcttcctactacgccgccagcagcgtccctcagcccgaatacccggcgctgacgggcgaagtcagcgccgatgtgtgcgtgattggcggcggctattccgggctgaacacggcgctggaactggcggagcgtggtttcagtgtggtgctgctggaggcgcgcaagatgggttggggcgccagtgggcgtaacggtggccagctgattcgcggtgtcggccatggcctggaccagttcgccaacgtgatcggcgccgacggtgtacgccagatgaagctgatgggcctggaagccgtggagatcgtgcgcgaacgcgtcgagcgctatcagatcccctgcgacctgacctggggttattgcgacctggcgaacaagccccggcacctgcaaggcttggctgaagacgccgaagaactgcgtagcctcggctatcgccatgaagtacgcctgctgcaagccagcgagatgagcagcgtaatcggctccgaccgttatgtgggcggcatgatcgacatgggttccgggcatttgcacccgttgaacctggccctcggcgaggccgccgccgcacagcagttgggcgtgaagctgttcgagcactccgaagtgacgcgcatcgactacggccccgaggtcaacgtgcacaccgccctcggcaacgtgcgcgccaaaaccctggtgctggcctgcaatgcctacctcaagggtttgaatccgcagttaagcggcaaagtattgcccgccggtagctacatcatcgccaccgaaccgttgagccaagcccaggccaccaacctgctgccgcagaatatggccgtgtgtgatcagcgggtgacggtggattacttccggctgtccgctgaccgacgactgttgttcggcggtgcctgccattattcaggacgtgacccgcaggatattggcgcctacatgcgtccgaaaatgctcaaggtgttcccgcaactggccgaggtgaaaatcgactaccagtggggcggcatgatcggcatcggcgccaaccgcttgccacagattggccggctggccgatcaacccaatgtgtattacgcccaggcctacgctggccacggcctcaatgccacgcacctggccggcaagctgctggccgaagccatcagcggccagcagcagggccgtttcgacctgttcgcccaagtgccgcacatcaccttccccggcggcaagcacctgcgctcgccgctgttggcgctggggatgctctggcatcggttcaaagagctggtgtgatcagtcgcgccagaacggcttcaggccctcctggcgcgcttgttcggcggtcagaccaacatcgcgcagttgctcgtgggtcaaatgcagcaaagccttgcgcgtgtggcggcgatgccagaacagactccagcggttgatatcccgcggcgccgtcgcccgctcctgccctgcctgcaattcctgactgtgtaacatcagacgcacatcgcttatgccgctcattttgctgcccctcaatcacctgttgccatgagtgactagagtgagcgcgggcgcaaaagcattacagattcaacctacttttattaaatccatacagatgctgcccatggacgcctgaatcctgtattttcgccttatctgtactggtctcgggagcgaccgccatgaccctttacgtcaacctcgccgaattgctgggcacgcgcatcgaacagggcttttatcgccccggcgatcgactgccctcggtgcgcgccttgagcgtggaacacggggtcagcctgagcaccgtgcaacaagcctatcgtttgctggaagacaacggcctggcgatgcccaagcccaagtctggttactttgtgccggtcgggcgcgagctgccggcactgcccgaagtaggccgcccggcccagcggccagtggaaatttcgcaatgggaccaggtgctggaactgatacgtgcagtgccgcgcaaagacgtcatacagatgggccgaggcatgccggatgtattgtcgccgaccctgaaacccttgctgcgcagccttgcacgggtgagccgccgtcaggacttgccggggctgtattacgacaacatcctcggctgtatggagttgcgcgaacaaattgcgcgactgtcattggattccggctgccagctgacggccgaagacattgtggtcaccacgggttgccacgaggcgctgtccgccagcatccacgcgatttgcgagccgggcgatatcgtcgcagtggactcgccgagctttcacggcgccatgcagaccctcaagggcctgggcatgaaggccctggaaatcccgaccgacccgctcaccggcatcagcctcgaagcgctcgagctggccctggagcagtggccgatcaaggtcatccagctgacgcccaactgcaataaccccttgggctacatcatgccggaggcgcgcaaacgtgctttgctgacgctggcgcagcgctttgacgtggcgatcatcgaagacgatgtgtatggcgaattggcctacagctacccacgcccgcgtacgatcaaatccttcgacgaagacggccgcgtactgctgtgcagctcgttctcgaaaaccctcgcgcccggtttacgcattggttgggtagcgcccggtcgctacctggagcgggtgctgcacatgaaatacatcagcaccggctccaccgcgacacaaccacagattgccatcgccgaattcctcaagaacggccacttcgaaccgcatttgcggcggatgcgcactcaataccagcgtaatcgcgacttgatgctcgactgggtcagccgctacttcccggccggcacacgtgccagccggcctcaaggcagctttatgctgtgggtcgagttgccggaaggcttcgacaccctcaagctcaatcgcgtactggtggagcaaggcgttcaggtggcggtgggcagcattttttcggcctccggcaagtaccgcaactgcctgcgcatgaactacgctgccaagccaaccccacagatcgaggaagcggtgcgcaaggtcggggccgcagccatcaagatgctcgccgaggcggcagactgacctttcgccggttttagccgtcatatgcccacaatcgccctgacctggaagcagcgcccttgatgattcgaaggcttttaccgtttttcctgttgggcgccctggcgctgggcggctgcgctacggtcgacagtccgcgcgtccccagcgatgcgttgcccgccgcgcaatctgcgttcggccgttcgatccaggcccaggcggcgccctatcaaggtcgctcgggctttcgcctgctgcccaacagcagcgaagccttcatggcccgcgccgagctgatccgcaacgcccagagcagcctcgacctgcagtactacatcgtgcacgacggcatcagcacgcgcatgcttgtggacgaactgctcaaggccgccgaccgtggcgtgcgcatccgcatcctgctggacgacaccaccagtgacggcctcgaccaagtcatcgccaccctcgccgcccacccgcaaatcgaaattcgcctgttcaatccgctgcacttgggccgcagcaccggcgtgacgcgggccatgggccgcttgttcaacctgtcgctgcaacatcggcgcatgcacaacaagctgtggctggcggataacagcgtggccatcgtcggcggtcgcaacctgggcgatgagtatttcgatgccgaacccaacctgaatttcaccgacatcgacatgctcagcgtggggccggtggctgaacagctcggccacagttttgatcagtactggaacagcgcgctgagcaagccgattgatgacttcgtctccaccgccccatccaaacgagacctggccgccgcacgcgtgcgcctgcaagactcgctggccgaatcacgccaacagaaccacgccctgtataaccgcttgcgcacctaccaaacccagccgcgcatggacatctggcggcgcgagctgatttgggcgtggaaccaggcgctgtgggatgcgccgagcaaggtgctggccaaggccgacccggacccgcgattgctgctcaccacccaactggcgccggagctggaaggcgtcaaccatgaattgatcatgatttcagcgtacttcgtgcccgggcaacctgggctggtgtacctgaccggccgcgccgatgcgggggtgtcggtgagtttgctgaccaactccctcgaagccacggatgtaccggcggtgcacggcggctatgcgccgtatcgcaaggcattgctggaacatggcgtaaaactctatgaactgcgccgccagcccggcgacccgagtgcaggcagcggcccgcacctgtttcgccggggcgcgttccacggctcggactccagcctgcacagcaaggcgatgatctttgaccgggagaagtcgtttatcggctcgttcaacttcgacccgcgttcggtgctgtggaacaccgaggttggcgtgctggtggacagccccgaactggcggaacacgtgcgcaacctggcattgcaaggcatggcgccagcgttgagctacgaggcgaaattgcaggacggccaggtggtgtgggttaccgaggataacggccaactgcacacgctgaaccatgagcccggcaattggtggcgccggtttaatgcctggtttgctacttcagtcggcctggaacggatgctctgaacacagtgaagaaccctgtgggagtcgggcttgcccgcgatagcggagtgtcaggcaccaataggctagctgactcaccgctatcgcaggcaagccagctcccacagttgattgcatttcacgtcaagcaggctgggcggcaccaaatgcgccttggcgcagcagcagcaccaccaatcccagcgctcccgccgccatcagccacggcaatgcatgcccgctgatccattggctgcccgcgcccgccaccagcggcccaatcaggcagccgatgccccatagctgcgccacgtgggcattcgcgcgtaccagcgcatcgtcgcggtaacgctcgccgatcaaaatcagcgacaaggtgaacaacccaccggcgctggcgccgaagatcacccacaccggccagatcagtggcgtgtgcaataacagcggaatcgccaggctcgacaccagcagcaacaccgcacagctcaggaacagcgtgcgacgcggcaggtaatcagccaatgcaccgatgggcaattgcagcaatgcgtcgccgaccaccaccgtgctgaccatggccaaggcaacctcggccgtaaaaccttgttgcaggcaatacaccggcagcagcgtcagaatcatcgcttcgaacgcagcgaataacgccaccgcccaggcaatcgccggcagactcaggcaaaagcgccatagatcactgaacgtcacgctgaaggattcggcggttggcgcaccggaacgaccgagcaacagcagcggcgcgaccatcagcaggcccacgcccacccagaaaccgaaatcatggtcggtgccgagcacgcccagcaacaacggccccgacagttggctcaaggcataactgcagccatacagcgccaccaagcggccgcgccactgctccaccaccaactggttgatccagctttcgccgaggataaacacgatggtcaggatcaccccgatcatcagccgcagcaccagccataccgggtagctgggcaagattgcgagcaaaccgatggagacggcacccgcccacaaacacaggcgcatcaggttggcggtgcccagccatgaggccatccggctggaaaccttggcgcccagcagcacgccgaaagccggcattgccgccatgacgccgatggcgaaactgccatagccccagccttccaggcgcagggacaccagcggcatgctgacgcccagggccaggccaacgctgagtaccgaggccagcacggcgaaataagtcgcccaacgcatttccacgctcctgtggataattttcagggtttcaaacgaactgtaggagcgagcttaggtgggagccgggcttgcccgcgatgcaagcacctcggtgtgtcagtcacacctcggtgatgctatcgcaggcaagccagctcccacaaaagcttgctcctacaggggatcagcggttttgcttacagcttgatccaggtcgatttcaactcggtgtacttgtcgaatgcgtgcagcgacttgtcgcgaccgttacccgactgtttgaaaccaccaaacggtgccgtcatgtcgccgccgtcgtattggttgacccacacgctaccggcgcgcaaagccttggccgtcaggtgtgccttggagatatcggcggtccatacggctgcggccaggccataaacggtgtcgttggcgatggcgatggcttcttcggcgctgtcgaaggtgatcaccgacagcacagggccaaagatctcttcctgggcgatcttcatggcgttggtcacgccgtcgaaaatcgtcggttcaacatacgtaccgcccgtttcttccagggtgcgcttgccgcccgcaaccagtttggcgccgtcggcatggccggcttcgatgtacgacagcacggtgttcatctgctgggtgtccaccaaggcgccgacgttggttgccgggtccagcgggttgcctggcttccagcccttgagggcctcgatcaccagcggcaggaatttatccttgatggaacgctcgacgagcaggcgcgaaccggcggtgcaaacttcgccctggttgaaagcgatggcgcccgcagcggattcggcggcagcttgcaggtccggggcatcggcaaacacgatgttcgggctcttgccgccggcttccagccatacacgcttcatgttcgactcgccggagcggatcaacagctgcttggcgatcttggtagagccggtgaacaccagcgtgtcgacgtccatgtgcagcgccagcgcgttgcccacggtgtggccgtagcccggcagcacgttgaacacgccttttggaataccggcttcaaccgccagggcggcgatgcggatggcggtcagcggggatttttcggacggcttgaggatcaccgagttaccggtggacagcgccggccccagcttccagcaggccatcatcagtgggaagttccacggtacgatcgcgccgacaacgccgaccggctcgcgggtcaccaggcccaactgatcatgtggcgtggctgcaacttcgtcgtaaattttgtcgattgcttcaccgctccagctcagcgcattggctgcgccaggcacgtcaatgccgagggaatcgctgatcggcttgcccatgtccagggtttcaagcagtgccagctcttcggcgttggccttgagcagcgcggcgaaacggatcatggcggacttgcgtttggccggcgccaggcgcgaccagacaccggaattgaatgtggcgcgggcattttcgacggcgcgctgggcgtcggcggcgtcacagctggcaaccgttgccagcaagcggccatcgaccgggctgatgcattcgaacgtgtcgccggaaacagcagaggtgtattcaccattgatataggcacggccttcgatcttcagatccttggcgcgttgctcccagtcggcacgggtcagggtggtcatgcgagtgtcctcctcttgttgaatacaagggccaggtgatgtcccccggcagcctcaaagaattcttgcccggccagcctgctgttcggctcaaggcagctgccaccctaaaccagcggctgggggtgtttcaatatatttgacacaagcccggtaaacgcccttgcgatgttcattttaataaacatagactttgggctctccaaccgcaggccagacgggacacgcacatgagcatccaggacatcgtcgacttcagccaagccagcaccgccccagaccgctaccgcccggctgccgaaaaaatcctcaagggcgaccccgagcaaaccatttacaaccactacaacagcccatgcggccagatgagcgccggtgtctgggaaggtgaagtcgggcagtggaaggtcaattacaccgagcacgagtactgcgagattgtgcaaggtgtgtcggtattgcgcgatgccgacggcaacgccaagaccttgcgtgccggcgaccgcttcgtcatcccggccgggttcagcggcacctgggaagtgcttgagccctgccgcaagatctacgtggtgttcgaacagaaagcctgatcagcgatcgtacccatgctccgcgtgggaatgcagcccaaggcgctccgcgcctgctcttgaacgcgtgacgccgagcgtcacaggaggcgttaccacgcagagcgtgggaacgatcatttcaggcaaaaaaaagcccgactcgtgagagacgggctttttttcacaaggaagaaaatcaattacttgattttgccttctttgtagatcacgtgcttgcgaacgcgcgggtcgaacattttcttttcgagcttgtccggggtagtacgcttgttcttgtcggtagtgtagaagtgaccagtaccggcgctagagatcattcgaatcaattcacgcatgatagagctccttagatcttgccagcggcacggatttcggccagcacgacagtgatgccacgcttgtcgatgatacgcatgcctttagcagatacacgcaggcgaacaaaacgtttctcttcttcaacccagaagcggtgatgctgcaggttcggcaggaaacgacgacgggttttgttatttgcgtgggaaatgttattcccagtcaccggacccttaccggtaacttgacagactctcgacatgcctcagccctctaaaaccacatgcccaacccggcatgggttggccgcttaatctctcagtcatttggcgccaggcgccgcgtttctttagggtcttaccggctacacctacagtgaaggaaccgggcccctagaaaagagcgctgctttataccagaaagaccccagtgcaacaacagcccgtgtatttttaccggcataaatctcggcgacagacgcctgaaccgttgccaggaggggccgctgtcacggccgaccgctcgtcgcacagaatgatttacagcgcccgcccgcacgatgaagtgcacggcgaaacgcgctgaggcgccatcaaaacagcatttgcgccaaaagcacaggcaaaaatggactggtcatttatcagtcagcccactacggtaggcttttttccagactgcactcgcagatgggccttcgatctgcaaaggaaaccgaatatgcgcctcgctgccctaccgctattgctagcccctctatttatcgcgcccgcggccctggctgccaccagcttgagcgtttgcaccgaagccagccccgaagggttcgacgtggtgcaatacaactcgctgaccaccaccaacgcctctgccgacgtattgatgaaccgcctggtggactacgacgccaccagcggcaagctggtgccgagcctcgcggacagctgggacgtttcgccggacggcctgacctacaccttcaagctgcacccggatgtgaaattccaccgcaccgaatacttcactccaagccgcaccctgacggccgaagacgtgcgtttcagcttcgaacgcatgctcgacccggccaacccatggcacaagatcgcccagagcggcttcccgcatgcgcagtcgctgcaattgccgacactggtgaagaagatcgatgcgctcgacccgctgaccgtacgcttcaccctcgaccacgccgactcgaccttcctcgccgccctgagcatgggctttgcctcgatctacccggctgagtacgctgacaaactgttgaaagccggcacgccggagaaactcaacagccaaccgatcggcaccgggccgttcgtttttgtgcgcttccagaaagatgccgtggttcgctacaaagccaacccggattacttcgccggcaaaccggctgtggataacttgctcttcgccattaccccggacgccaacgtgcgtctgcagaaactgcatcgcgacgaatgccagattgccctgtcacccaagccgctggacgtgggcgaagccgaaaaagacccggccttgaaggtggaaaaaaccgccgcgttcatgaccgcattcgtagccatcaacagccagcacccgccgctggacaagccggaagtgcgccaagcgatcaacttggccttcgacaagaacagctacctcagggccgtgtttgagggcaccgccgaggcagcgaatggcatttatccacccaatacctggagctatgccaaagacttgccaggttatccacaggacatcgccaaggccaagacgctgctcgaccgcgccgggctcaaggacggtttcaagaccactatttggacgcgccccaccggcagcctgctgaaccccaaccctaacctcggcgcacagctgttgcaggccgacctggccaagatcggcatccaggcggagattcgcgtgatcgagtggggcgagctgattcgccgcgccaaggccggtgaacacgacctgctgttcatgggctgggccggcgacaatggcgacccggataacttcctgaccccgcaattctcctgcgcggcggtgaaatccggcaccaacttcgcccgctactgcgaccccgcgctggacaaactgatcagcgccggcaagaccaccagtgagcaaggcgtgcgcagcaagctgtatcaacaggcccaggcgcagatccagcagcaggcactgtggctgccactggcgcacccaaccgcctttgccttggctcgcaagaatgtcgagggctatcaagtgagcccgttcgggcggcaggacttctccaaagtcagcgtcaagccctgacaaacggccccgccccactggggcggggctacatccacccgtattccgccatcgacagcgggtcgccatcgcccacgatgatgtgatccagcacccgcacatccaccacttccagcgccttttgcagcaacttggtcaattttcgatcagccgcactcggctccacgctcccggaaggatggttgtgacacaaaatcaaagcggccgcgttgtatgccagggcgcgcttgaccacttgccgggggtaaacgatggcggcgtcgatggtgccgtggaacaacgcctcaaagcccagaacgcgatgctttgagtcgagaaacaggcagccgaagatctcgtggggctcatgccgcaacaacgccttgaggtaatcgcgcacggccaaagggctctccagcacagagtcagcgcgcagacgctcggccaaatggcgccgggacatttccagcaccgcctgcaactgggcaaacttcgcagggcccaaccccaaatgctggctgaacaccgtctggctggcctccagcaacgggcgaaggccaccgaattgcgccaacaaataccgcgccaggtcgaccgcactgcggccagacacaccggtgcgcaggaagatcgccaacagctcggcatccgacaggctcgccgcgccccattccaacagcttttcccgtggacgctccgccacaggccaatcgcgaatactcatcccacctccgtgtgtatgcggtccgctgttgccagacggacgctgtgttatcgtaagccctcttttttgcgtgcgatttctcctggggagggggcatcgcaggcgtcactgaactggcatcactgaactggaaaggcaaaccaatgcagcgtctgtatcggaaacgcatcgttctcggcgtcggcggcggcattgccgcctacaagagcgcagagctggttcgcaggctcctggaccaaggcgccgaagtgcgcgtggtcatgacccgcggtggcagtgagttcatcaccccactgaccatgcaagccttgtccggccacccggttcacctcgacctgctggacccggcagccgaggctgccatgggccatatcgagctggccaagtgggctgacctggtgctgatcgccccggcaaccgccgacctgatcgcccgcctggcccaaggcatcgccgatgacctgctgaccactttggtactggccaccgacgccaccgtcgccattgccccagccatgaaccaggccatgtggcgcgacccggccacccaagccaacacccagctcctgcaaagccgtggactcaaggtgttcggcccggcgtccggcagccaggcctgcggcgacgtcggcatgggccgcatgctcgaagccaccgacttggcactgtgcgccgccgagtgcttccagcacctggccctgaccggcaagcacgtgctgatcaccgccggcccgactcaggaaaacatcgacccggtgcgctacatcaccaaccatagctcagggaaaatgggctttgccttggcggaagcagcggtcgaggcaggcgcacgcgtcaccttgatcaccggcccggtgcatttgccgacccctgatcgggtcacgcgcatcgacgtagtcagcgcccgagacatgttggcagcctgtgaggccgcgattccctgcgacctgtttatcgcctcggctgcagttgcggactaccgccctgaagtcgtcgccccgcaaaaactcaagaaagaccctacaagtggcgacggcctgctcctgcaaatggtgcgcaacccggacattctggcatccatcgccacgcgcgcagaccgcccgttcagcgtcggttttgccgccgagaccgaacacctgctggactacgccgcacgcaagttgaaagacaaaaacctcgacctgatcgttgccaatgatgtcgccaacccgagcatcggcttcaacagtgaggaaaatgccatcagcgtgatcgaccgcgagttgcacgccaccgttttcgcccagaccagcaaaggcaagattgcccgccaactgatctcatttatcgcccaacggctgaaccaggtttaatttacatgcacgctttgcaagccaagatcctcgacccacgcatcggcagcgaattcccactgccggcctacgccaccccaggctccgccgggctggacctgcgcgccatgctcaaagaggacactgtccttgagccgggccagacccttctgattccgaccggcctgtcgatctatgtcggcgacccgggcctggccgcattgatcctgccgcgctccggcctgggccataagcacggcatcgtgctgggcaacctggtcggcctgatcgactccgattaccagggcgagctgatggtgtcgtgctggaaccgtggccaaaccgccttcaacattgccgtcggcgagcgcatcgcccagctggtactggtgccggtggtgcaggcgcacttcgaactggtacaggaattcgacgagacccaacgcggtgctggcggtttcgggcattccggcagccactgactaagctgaatcaggccgggcacgcttgcccggccccatgccaccgcagagcttttcaggacggagaatgcgcggagttattcagcgagatttcactattgaaatcaatgcattacgcgaccacaaacacggagcaccgactccggtggcacttttgcaccacgaactctctgccgaaaaagccgtcatacccttcagtttgcgcccgccggtcagccacattcaggccagctttgcccctttcagatggagtttccccacgcgatgagtaccgcagcccgagtagccccgacattccccgacagcatttttcgcgcctacgacattcgtggcgtggtgcccaaaaccctgactgccgaaaccgcctactggatcggccgcgccatcggctcccagagcctggcccagggcgaacccaacgtctcggtcggccgtgatggccgcttgtccggccccgagctggtcgagcaactgatccagggcctggccgacagcggctgccacgtcagcgatgtcggcctggtgccgacgcctgcgctgtactacgccgccaacgtactggccggcaagtccggggtgatgctcaccggcagccacaacccttcggactacaacggcttcaagatcgttatcgccggcgacaccctggccaacgaacagatccaggccctgcacgaccgcctgaagaccaacgacctgaccagcggcaccggcagcgtcaccaaggtcgacattcttcagcgctactccgaccagatcaccggcgacgtcaaacttgcccgccgcctcaaagtggttgtggactgtggcaacggcgcggccggcgtaatcgccccgcaactgctcgaagcgctgaactgcgaagtgatcccgctgttctgcgacgtcgatggcaacttccccaaccaccatccggacccgggcaaacctgaaaacctggtagacctgatcgccaaggtcaaggaaaccggcgccgacgtgggcctggccttcgacggtgacggcgaccgcgttggcgtggtgacagacaccggcgagaacgtattcgccgaccgcctgctgatgctgtttgcccgtgacgtggtggcgcgcaacgccaacgccgaaattatcttcgacgtgaaatgcacccgccgcctgacgccgctgatcaaggaatacggcggtcgcccactaatgtggaagaccggtcactcgttgatcaaaaagaaaatgaaagaaaccggcgcgctgttggccggcgaaatgagcggccatgtgttcttcaaagagcgctggttcgggtttgacgacggcatttacagtgccgctcgtctgctggagatcctcagcaaggaaaaatcgacggcgcaggagctgtttcagaccttcccgaatgatatttctacgccagagatcaatatccatgtgaccgaggagagcaaattcagcatcattgacgcactgcacgatgcgcaatggggcgaaggcgccaacctgaccaccattgatggtgtgcgagtcgattacgccaaaggctggggcctggttcgcgcgtccaataccacaccggtgctggtcctgcgtttcgaggcggataccgaggctgagttgcagcgcatcaaggacgtgttccacgcccagttgaaacgtgttgcccctgatctccaattaccgttctgattttttaccggagccctgaatgaccctcgaacgcgaagccgctgccaatactgccaaggtcctgtccgaagcgttgccttacattcgacgctacgtcggcaagacgctggtgatcaagtacggcggcaatgccatggaaagcgacgagctgaaaaccggctttgcccgcgacatcgtgttgatgaaagccgtcgggatcaacccggtggtggtgcacggtggcggcccgcaaatcggcgacctgctcaagcgtttgtcaatcgagagtcacttcatcgatggcatgcgcgtcactgacgcgcagaccatggacgtggtggagatggtcctcggcggccaggtcaacaaagacatcgtcaacctgatcaaccgtcatggcggcagcgccatcggcctgaccggcaaggacgcggagctgatccgcgcgaaaaaactgaccgttacccgtcagacgccggagatgacccagccggaaatcatcgacatcggccaggtaggcgaagtgatcggcatcaacaccgacctgctgaacctactggtcaagggtgatttcatcccggtgatcgcgccaattggtgtgggtgccaatggtgagtcctacaacatcaacgctgacctggtagccggcaaggtggccgaggcactgaaagctgaaaagctgatgctgctgaccaatatcgccggcttgatggacaaggaaggcaaagtgttgaccggcctgaccacccagcaagtggacgagctgatcgccgacggcaccatctacggcggcatgctgcccaagatccgttgcgcactggaagcagtgcaaggcggcgtgggtagttcgctgatcctggatggtcgcgtgccgaatgcgatcctgttggaaatcttcaccgataccggtgtgggcacgctgatcagtaaccgcaagcgtccttaatcgctgtcaataaaaaggccccgctcaatccaattgagcgaggcctttttatttgaactcgatccaaatgtgggagctggcttgcctgcgatgctgacacctcggtaaatcagttgcaccgaggtgatgctatcgcaggcaagccagcctcccacattggtccacgtcccagatgaatttgcgtgtcagacgccgaactgctcgcggtacgcacgcaccgccggcaaatgctgcttgagctgcgggtcatcttccaggaactgcaacacctggttcaacgaaacaatgctcaccaccggaatgccgaaatcacgctccacttcctggatcgccgacaactcaccgttgccgcgctcctggcggttcagggcgatcagcacgccggcggccttggcgccgtcctgggaagcgatgatctgcatcacttcgcggatagcagtgccggcggtgatcacgtcatcgatgatcagcacatcgcctttgagcggagcacccaccaggctgccgccttcgccatgggccttggcctctttgcggttgaagcaccacggcaagtccagcccgtgatgttcagccagggccacggcggtagcggccgccaaagggatgcccttataggccgggccgaacagcacgtcgaaggaaatgccgctttcgacgatggctgccgcgtagaaacgacccagctgagccagggccgaacccgagttgaacaagccagcattgaagaagtacgggctggtgcgcccggacttcaaggtgaactcaccgaagcgtaaaacgccgcgatcgatggcaaaacgaatgaaatcgcgttgatacgcctgcatgaaaaaagcctcagataccacggatttagctaattaggtagacggcgtgtatcatacacgcacgcgatttttggggccatttatgcggatcatcagtgtgaacgtcaatggtattcaggctgcagtcgagcgtggtttgctcagttggctgcaagcacagaatgccgacgtcatctgcctgcaggacacccgcgcctccgcctttgaactggacgacccagccttccaactggatggctacttcctttatgcctgtgatgccgaagtccctgcccaaggtggcgtggctctgtactcacggttgcaacccaaggcggtcatcagcggcctcggcttcgagacagccgaccgctacgggcgctacctgcaagccgatttcgacaaggtcagcatcgcgaccttgctgctcccttcggggcagaacggcgatgaagacttgaaccagaagttcaagctaatggacgacttcgcccgttatctggataaacagcggcgtaaacgtcgcgagtacatttactgtggctcgctgtacgtggcgcaacagaagctggatatcaagaactggcgcgacagccagcaatccccgggcttcctggcgccggaacgggcctggatggacgagattgtcggcaacatgggttatgtcgatgccttgcgcgaagtcagccgtgaaggcgaccagtacagctggtggccggataacgaacaggctgagatgcttaacctgggctggcgtttcgactaccagctgctgacgccgggcctgcgccgctttgttcgcagcgcacgcctgccacgtcagccgcgcttctcgcagcatgcgccgctgatcgtggactacgactggacactgaccatctgaggtctttttccaggcacaaaaaaaccgacatcgctgtcggtttttttgtgggtgctcattatttgaccagccgccaggtaaagggatagcgataaacgatgcccttgttggccttgatcgaaccgatgatggtcaacaccaccgtcgcgattaccaaagcagtcatcaggaaaagaccaataatcgcgaaggccagcacgaagcacaccatccaggcaatggccacggtgatctggaagttcaaggcttccttgccctgatcatcaatgaacgggtccacttccctcttcatttgccacaggatcagtggcccgatgacactgccgaaggggaacacaaaccccagaaacgccgcgagatggcacaacattgcgccttgacgcacttcgtaggaaggcgtcggcacgggttgctggctgtcattcatggcgtttctccttgaggccgaatcagtcagccagtgcggcgttctgcagttcgaagatttcggtcatgcctttctgggccagggccagcatggcgttcaggtcggctggctggaatggcgcgccttcagcggtgccctgcacttcgatgaaaccaccggtgctggtcattaccacgttcaggtcggtctcggcagccgagtcttccaggtagtccaggtccaatacaggctcgccctggtacatgccgaccgacacggcagcaatcatctgcttgagtgggtcgccggctttcaggccgccgcgtttcttgatcactttcagcgcgtcaaccagggccaccatggcgccggtgatggaagcggtgcgggtgccgccgtcagcctggatcacgtcgcagtcgacgtacagggtcacgtcgcccagcttggacatgtccagcgctgcgcgcagcgaacgaccgatcaggcgctggatttccagggtacggccgccttgtttgccgcggctggcttcacgctggttacgctcgccggtggcgcgcggcagcatgccgtattcggcagtcaaccaaccctggccctggcccttgaggaaacgcggcacgccgttttcgacgctgacggtgcagatcaccttggtatcgccaaactcgaccagtacagatccctcggcgtgtttggtgtagttgcgggtgatgcggatcgagcggagctgatcggcagcgcgaccacttggacgtttcataggggatacctgtacggaggacgaaaaactgccgagcattatagagccgtgaaccgattcggggcacttctaaaaaattcggttacgaatgactggcctagcgcccattgtttgggcgcgctcgtctcactgcgctacaatcctgcgccttcgcagcctgtcggcttcaatttaaccatcagcccgtatttgcgggactgcatcgcgaggtacctccatggtgcacagcatgaccgccttcgcccgcgtcgaaaaagccggcgcccaaggcaccctgagctgggaactgcgctcggtcaacagccgctacctggagccgcacctgcgcttgccggaatccttccgcgacctcgaaggcgccgtgcgtgaagcactgcgccaaggcatttcccgcggcaagctggaatgcaccctgcgttttaccgaggaaaccaccggcaagccgctgcaggtcgaccgcgaccgcgccgcgcaactggtcgccgccgccgaaaccatcgccggcctgatcaaacaacctgccgcgctgaacccgctggaagtgctggcctggcccggcgtattggtggccgacgccaccgacccgcaagcgctgaatgccgaagccctggccctgttcacccagggtttgaaggagctcaaggccggccgcgaacgtgaaggtgccgaactggcacgcctgatcaatgaacgcctgacgtcgatcgaagccgacgtggtcaccctgcgtgagctggtgccgcagatgcttgctacccaacgtcaaaaggtcctcgatcgcttcaccgacatgaaggccgacctcgacccgacgcgcctggagcaggaaatggtcctgctggcgcagaagagcgacgtggccgaagagctcgaccgcctgagcacccacatcctcgaagtgcgccgcgtgctcaagtccgctggtgccgctggtcggcgcctggacttcctgatgcaggaactcaaccgcgaagccaatacactcggctccaaggcgtttgacccgcgcagcaccacggctgcggtcaacctcaaagtgttgatcgagcagatgcgcgaacaagtacagaatattgagtaaggcaactttcatgacccacagcaccggcaccctttacatcatttccgccccctcgggcgcgggcaaaagcagcctggtcaaggcgttgaccgacgctgacgagcagatccgcatctcggtttcgcacaccacccgcgccatgcgcccaggtgaagtggacggcgtgcactatcacttcgtcgagcgcaccgagttcgtgaagatgatcgaacacggcgacttcctggagcgcgccgaagtgttcggcaacctttacggcacctcgcaaagccacctgcagcagaccctggacgaaggccacgacctgatcctggaaatcgactggcagggcgccgagcaagtgcgtcaactgatgcccaaggcgcgctcgatcttcatcctgccgccttcgctggaagccttgcaccagcgcctgaccaatcgcggccaggacagcgacgaaatcatcgaaggccgcatgcgtgaagccgtcagcgagatgagccactacgtcgactacgactacctgatcatcaacgacgatttcgcccatgccctggacgatttgaaggcgattttccgcaccaatcagctccagcaaaagcgccaacagcagcgttttggcaaattactcgccgaactgcttggctgattggcccttcccaaaaccgctgcaagggctttacattggcacttgtagcagttttgcgagggcgcgggaaaaatcagcgcttccctaaacgctggtgattttttaaactgttcagtccgctcgcccaaccgggcagcgcgcatcttgcattcgctccgaggaataccatggcccgcgtaaccgttgaagactgcctagaacacgtggataaccgctttgagctggtcatgctctctaccaagcgtgcccgtcaactggccactggcggcaaagagcccctggtccagtgggaaaacgacaagcctaccgttgtggccctgcgtgaaatcgctgaaggcctgatgagctacgagttcatcgccaacgccgaaatcgttgaagacgaaccgctgtttgcagcgttcgaggacgagtccaacgaggccgtctaagcctatgcctggtcgacgtagcacggcgcggggtcacagccaacggcaggagttaacactttgccgagcatagacgccctcgccgatcgcttatcgacctacctcggcccagaccaggtcaacctggtccgccgagcgtatttctacgccgaacaagcccacgacggccaacgccgccgcagcggcgaggcgtacgtcacgcatcctcttgcggtggcaaacattcttgccgacatgcacatggaccatcagagcttgatggccgcgatgctgcatgacgtgatcgaagacaccggcattgccaaggaagcgctcagtgcgcaatttggcgaaaccgtggccgaactggtcgatggggtcagcaaactgacccagatgaacttcgagaccaaggccgaagcccaggcggaaaacttccagaagatggccatggccatggcccgagacattcgggtgatcctggtcaaactggccgaccggctgcacaacatgcgcacgctggaagtgctgtccggcgaaaaacgccgacgcatcgccaaggaaaccctggaaatctacgcgcccatcgccaaccggctgggcatgcacgccattcgtatcgaattcgaagacctcggcttcaaagcgatgcacccgatgcgttcggcgcgcatctaccaggcggtcaagcgtgcgcggggcaaccgcaaggaaatcgtcaacaagatcgaagagtcgctgagccattgcctggcgatcgacgagattgaaggcgaagtcagtggccggcaaaaacacatctatggcatctacaagaagatgcgcggcaagcgtcgcgccttcaacgagatcatggacgtgtacgcgttccgcatcatcgtcgacaaggtcgacacctgctaccgcgtgctgggcgctgtacataatttgtacaaacccctgccgggacgcttcaaggactacatcgcgattcccaaggccaacggctatcaatcgctgcataccacgctattcggtatgcacggggtgccgatcgagatccagattcgtactcgcgaaatggaagagatggccaacaacggcatcgccgcccattggctgtacaaatccagcggcgacgagcagccgaagggcacgcatgcccgcgcccgtcagtgggtcaaaggcgtgctggaaatgcagcaacgtgccggcaactccctggaatttatcgaaagcgtgaagatcgacctgtttccggacgaggtctacgtgttcacgcccaaaggccggatcatggagttgcccaagggctccacggcggtcgactttgcctacgcggtacacaccgacgtcggcaacagctgcattgcctgccggatcaaccgtcgtctcgcgccgctgtccgaaccgctgcaaagcggctccacggtcgagatcgtcagcgcacccggcgcacgccccaacccggcctggctcaacttcgtggtcaccggcaaggcgcgcacacatatccgccatgcgctcaaattgcaacgtcgctccgaatccatcagcctcggcgaacgcctgctgaacaaggtgctcaacgggttcgacagcgccctggagaaaatcccggccgagcgcgtgcaagcgatgcttcacgagtatcgccaggaaaccatcgaagacctgctggaggatatcggcctgggcaaccgcatggcttacgtggtcgcccgtcgcctgctcggcgaaggcgaacaattgccaagccccgaaggcccgctggcaattcgcggcaccgagggcctggtgctcagctacgccaagtgctgcacgccgatcccgggcgacccgattgttgggcacctgtctgccggcaaaggcatggttgtgcacctggacaactgccgcaatatcactgaaatccgtcataaccccgaaaaatgcatccagctctcctgggccaaggatgtgaccggcgaattcaacgtcgagctgcgcgtcgagctggaacaccagcgcggcctgatcgccctgctggccagcagcgtcaacgcggccgacggcaatatcgagaagatcagcatggatgagcgcgatggccgcatcagcgtggtccagctggtcgtcagcgtgcacgaccgcgtgcacctggctcgcgtgatcaagaaactgcgcgccctgaccggggtgattcgcatcacccgcatgcgtgcatagccgatctcttacaaggagtcactcatgaccaagactgttatcaccagcgacaaggcccctgccgccatcggtacttactcccaggcgatcaaggcgggcaacaccgtctacatgtccggccagatcccgctcgacccaaagaccatggaactggttgaaggctttgaagcacaaaccgtccaggtcttcgaaaacctcaagtcggttgccgaagcggccggcggttcgttcaaggacatcgtcaagctgaacatcttcctcaccgacctgagccacttcgccaaggtcaacgagatcatgggcaagtacttcgaacagccgtacccagcccgcgccgccatcggcgtggccgccctgccaaagggcgcacaggttgagatggacgcgattctggtcatcgagtaaaacacccggcgcagccttcacaggctgcgtcgacttcgtttcagaaggatttcgtaatgcgcaaagcgctagttgccttatcaacgcttgccctgttgctcggcggctgtgccagcaaccccgccgacctggacgtgagcggcacctggatcaaccaggccgccatcaatgcggcagccaagggcggccctttgcgtgaagccctgcaaacctatggcccgaacctcgaatgggaggtcaacaccaaggcttcgcaggcgcgctactacaatggttttgaagtcgccgaaggcaagctgctgagtgaaaagcccggcgcctggagcgtcgatttttacggcagctccgccaccgaactcaagcgtaaaggcaaacaactgctgcaagtggccaacgacaacgagcctgagcaactcttcgcccgcgccaaagacccagcccccgaaggcgcgccactgggcgccaacttcgagcgcgcactgtacgcagcctacatgggcggcgactggaaaatcaccgacggcaatggtgatggcgccacggtacagttccaggctgacggcaaggtcgccggtttgccaggggtcgatcggtactcgttgtgcctggcgggtgactgcgcctccatgagcggcggttacgacagcatctggctgcaactgaacggccagggcaacccttggattttcgcgcgcaagggcaagcagctggaaatcttccaggccgtcaataccgcacagaccgacgaggtgccctcgtttacgccggggccacggcagtggttgctggaaaagaagtgatacaaccccaaggagcccaacggctcctttttctttagtgtgcagcatgattttttaccttcaggctggcaaccccatgcataagttgcttctcctcagcctggccctgctgggcggctgcgcacagacaacgcaacccgccgacatcagcgggctgtggatcaaccaagccgctatcgatacggcagcccaaggccgaccgttgcttcgttccctgagcgccaacggcatgaacctggagtggaacatcgacacccagaccggcaaggcgcaattaaacaacgggttcgaagtaggcgacggccaattactgcaaacggcgcccggcatatggaccgtcgactacaacggccatggcaccgacgaattgagattgaatggcaaacagctgattcagcaggccagcaaaacctacccaagccaagtattcgagcgccccactcaacccgcagtggtgggcggccagtgggctgcgactttcaggcaggctctgtactcagcctatatggggggccagtggaagatcattgaaggccaaggcgcgggcaacgtcgtagcgttcagagcggatggcagcgtgtccgggctgggcgacaatagtcggtacgacctatgcctggcgggcgattgcacctctcaaggcgctggcaatgacatcatctatctgggcagtagtgatgccggcgacagctggattttcctgcgctcgggcaaacagctggagattcttgaagcaattaacctttccaagccagacgaaatccccctgctcacgccaggcccacgccagtggctgctggaaaagcaataagcggcctcacgtggatccgaatgtgggagctggcttgcctgcgatagcggtgtatcagtcacatcattgttggatgtgacaccgtcatcgcaggcaagccagctcccacattttttggccgcgtttcagcccttcagaatcgctgcatacccttcgcgataactcggatacgtcggcacccagcccagcgccttggctcgggcattgctgcattgcttgctgcccgcccgacgcacactggcgtcgtcggcccactcggtgacgcccagatagtcgcgcaaccaagccaccacttctgccaatggcgcgggcgcgtcgtccacgccgatgtagatcttgtccagcgagccaccctgctccacgtgccgcaacaaaaaggccaacaggcctgccgcgtcatccgcgtggatccggttgccatataaaggtggatcaaccgccacgcgatagccttggcgcacttgggtcaacagccattcgcggccggggccgtagatgccggtcaaccgcacgatactcgccgggatgccgctgttgagcgccacttgctcggcctccagcatgacctggccggaatagcccttcgcctgggtgtcggacgtttcgtcgacccactcaccgttctgctggccatacacgctgctgctggacacaaacagtaaatgcttgggcgcctgaccgtagtcgtccagccactccaacacatgctgcaacccttgcacatatgccgcgcgatagccggattcatcgtggtcggtggcagcggcgcaatacaccaggtaatccaccccgccgatcggccaagtgtccgggcagtcctttttgaacaggtcaccggcgatgccgatgacaccctcgggaagccgcgaaacgtcgcggcgcaggccatgaacctcccagcccgaggccagcaattggctagccagccgactacccacatcgccgcaaccggcaatcacaacagaaggcgcagacatcataaaactccgttcttaaaggcgcagattagccgccgaagatgaccagcggccagcaaaaggacaaattaagtaactgtattacttttgttaacaagaattacttgcaataataactgcccatttgtcctcgacccatcagggtctggcaggacgatcactcattttttctctcaggtccggccagcatgacacgtattacaaaccccgcttcgccaaccaagcctcacagcccatcccgcgcctggcgtgcgattgctgcgttgctgttcagcgtaatgctggcaccgaccgccgcattcgctgacgctactgccccagccgctccggctgccgccgagcacaatgcagcaacccccgctgcgcctgctgccgcgcccgtcgctaccgacccggcccaggctgcaacgccagcacctgccgacgactccggcgtggtgttggaagaggacaacagcctgggcatggcccatgacctgtccccgtggggcatgtaccagaatgctgacgtggtggtaaaagccgtgatgatcggcctggccatcgcctcgatcatcacctggaccatctggatcgccaagggcttcgaactgctgggcgccaagcgtcgcctgcgcactgaaatcgtccacctgaaaaaagccaccaccctcaaggaagccagcgacaccgcgaccaagaagggcactctggccaacctgctggtacacgacgcgctggaagaaatgcgcctgtcggtcaacgcccgcgaaaaagaaggcatcaaggaacgtgtcagcttccgcctggagcgcctggttgcggcctgcggccgtaacatgagcagcggcaccggcgtactcgccactatcggttccaccgcgcctttcgtcggtctgttcggcaccgtgtggggcatcatgaacagctttatcggcatcgccaaaacccagaccaccaacctcgccgtcgttgccccaggcatcgctgaagccctgctggcaaccgcactgggcctggttgccgcgatccctgcggtggtgatctacaacgtcttcgcccgttcgattgccggctacaaggcccaggtatcggacgcgtcggcagaagtcctgctgctggtcagccgcgacctcgatcacctgcctaccgagcgcagctcgcaaccgcacatggtgaaagtggggtaatcggccatgggcctgcatttgaatcaaggcgacgacgacctcgtcgagaaccacgaaatcaacgtcacgccatttatcgacgtgatgctggtgctgctgatcatcttcatggtggcggcaccgttggcgaccgtggacatcaaggtcgacctgcccgcgtccagcgccaagcctgcgccgcggccagagaaaccgatcttcctcagcgtcaaggcggaccaacgcctgttcctgggcgaagaagaagtcaaagctgaaaccctggggccggtgctcgatgccaagacccaaggcaagaaagacacgacgatcttcttccaggccgataaaggcgtggactacggcgacctgatgagcgtgatggatgccctgcgggcagccggctacctcaaggtcggcctggtcggacttgagacggcagccaagaaatgatcacgacgcgccacaaactgacgcgttatggcaccagcctcgccgtcgtgctgggcgtgcatgccgtcgcgatcatcatcgcgcttcaatggtccgcgccgcaccaggtgacgttgccaccggccgccatggtcatcgacctggcgccgctgccggcaccgccgcctccggcgccgccaaaggtggtcacgccgccgcagccgcctgccccggtggaagagctgcccctgccgaaactggccgaggcgcccaagccaacgatccaggtgcccaagccggtcaagcccaagcccaaacctcagccgccaaagcctgtggagaagaagcccgagccgcccaaggaaaaaccttccgaggacccaccgagcgaaaccccgcagaccaacgcaccagcggaaaaatccgcccaaccggtgcccggcccatcgccagcacaggttgcggccaaagcgtcctgggaaggcacgctgctggcgcacttgcagaagtacaagaagtacccgccaggcgcccaacagcgtggcaaggaaggcttgaaccgcctgcgctttgtggtcgatgctgaaggcaacgtgctgtcctacgagctggtgggccgctccggcaacgccgacctggaccgtgcaaccctggacatgattcgtcgtgcccagccactgcccaagccaccggccgacatgttgaaaggcggcagcgtcgaaatcgtcgcgccattcgtttacaacatcgagaagcgccgccgctaagcggcaaacgggagccggctcgtgtagcagctggcttgtgtggcagctggcttgtgtgggagctggcttgcctgcgatagcgtcaccgcggtctgatggatagaccgaggtgtccgtatcgcgggcaagcccgctcccacatttttgatttcattggctcaaaaaattctttttcagccaaatccgcaccactccccgctcaatccccaccaaagttctgataacgtgcgtctatcgattgcagccggtatgcttggctcgcaacctcatggacgcccgctatgactcttacagaattacgctacatcgtgaccctcgcccaagagcagcacttcggccacgcggccgagcgttgccacgtcagccagccgacgctgtcggtgggtgtgaaaaagcttgaagacgaactcggtgtgctgattttcgagcgcagcaagagcgccgtgcgcctcacgccggtgggcgaaggcattgtcgcccaggcccaaaaggtgctggaacaagcccaaagcattcgcgagctggcccaggccggcaagaaccagctgaccgcaccgctcaaagtcggcgccatctacaccgtcggcccgtacctgttcccgcacttgatcccgcaactgcaccgcgtcgcgccgcagatgccgctgtatatcgaagaaaacttcacccacgtgctgcgcgacaaactgcgcaacggtgagctggacgcgatcatcatcgccctgccgttcaacgaggcagacgtgctgaccctgccgctctacgacgagccgttctacgtgttgatgccggcctcccacccgtggacgcaaaaagacaccatcgacgccggcctgctcaacgacaagagcctgctgctgctcggcgaaggccactgcttccgcgatcaggtactcgaagcctgcccgacgctgaccaagggcaacgacggcgccaagcacaccaccgtggaatccagctccctggaaaccattcgccacatggtggcttccggcttgggtatttcgatcctgccgctgtcggccgtggacagccatcactacgcccccggcgtgatcgaagtgcgcccactcacgccaccggtgccgttccgcaccgtggccatcgcctggcgcgccagcttcccacgcccgaaagccattgagatcctggccgactcgatccgcctgtgttcggtggccaagccgcctgctgcgagctaagtaaacgtatgaccgagttgtcgcaggtgtcggtaaccgccctcaaaggtgtcggtgaggccatggccgagaagctggccaaggtcggcctggagaaccttcaggacgtgctgtttcacctgcccctgcgctatcaggaccgcacccgcgtagtgcccatcggccagttgcgccctgggcaagacgcggtggtcgaaggcaccgtcagtggcgctgacgtagtgatgggcaagcgccgcagcctggtcgtgcgcctgcaggacggcaccggcggcctgagcctgcgcttctatcatttcagcaacgcacaaaaggaaggcctcaagcgcggcactcgcgtgcgttgctacggtgaggcccggcctggcgcgtcgggcctggagatttaccacccggaataccgcgccattaccggcgacgagccgccgccggtggacactaccctcacgccgatctacccgctgaccgaaggcctgacccaacaacgcctgcgccaattgtgcatgcagaccctgacgatgctcggcccgaaaagcctgcccgactggctgccggtggaattggcccgcgactaccaactggcgccgctggacgatgcaatccgctacctgcatcacccgcccgccgacgccgatgtcgacgaactcgcgctgggtcatcactgggcgcagcatcgcctggccttcgaagaactgctgacgcatcaattgtcccagcagcgcctgcgcgaaagcatgcgctccctgcgcgcgccggcgatgcccaaggccacgcgcctgcctgcgcaatacctggccaacctcggcttcgcgccgaccggcgcccagcagcgggttggtaatgaaatcgcctacgacttgagccagcacgaaccgatgctgcgcctgatccagggcgacgtgggcgcgggcaagaccgtggtcgccgccctcgccgccttgcaagcgctggaagccggctaccaagtggcgctgatggcgcccaccgagattcttgccgaacagcacttcatcaccttcaagcgctggctcgaacccttgggcctggaagtgacgtggctggccggcaagctcaagggcaaggtccgcgcggcggcgctggaacaaatcgccggtggcgcaccgatggtggtcggcacccacgcgctgttccaggacgaagtgcagttcaagaacctcgcactcgtgatcatcgacgaacagcaccgtttcggcgtgcagcaacggttggccctgcgccagaaaggcgtgggcgggcggatgaatccgcaccagttgatcatgaccgccacgccgatcccgcgcaccttggcgatgagcgcctacgccgacctcgatacctcgatcctcgatgaactgccgcccggccgcaccccggtcaacaccgtgctggtcaccgacacccgccgcgtggaagtgatcgagcgggtgcgtggcgcctgcgccgaaggccgccaggcgtactgggtgtgcacgctgattgaagagtccgaagagctgacctgccaggccgccgaaaccacctttgaagacctcaccagtgccctgggtgagctcaaggtcggcttgatccacggccgcatgaagcccgcagaaaaagccgccgtcatggccgagttcaaggccggcaacctgcagctgctggtggccaccaccgtgatcgaagtcggcgtggacgtgccgaatgccagcctgatgattatcgaaaaccccgaacgcctgggcctcgcccaactgcaccaactgcgcggccgcgtcggccggggcagtgccgccagccactgcgtgctgctctaccacccgccgctgtcacagattggccgtcagcgcctgggcatcatgcgtgaaaccaacgacggttttgtcatcgccgaaaaggacctggagctgcgcggccccggcgaaatgctcggcactcgccagaccgggctgctgcagttcaaggttgccgacctgatgcgcgacgccgacctgttgcccgccgtgcgtgacgcggcgcaagcactgctcgaacgctggccggaacatgtcagcccgttgctggatcgctggctacggcatgggcagcaatacggccaagtgtgacgcctgactcacttagtcgaccaacagttgtatcaagctggttatacttcgttgactgtacgcaattggatcaggccatgtcagaagtagccctcgccacagccccactgaccgccccgccggtcattcgggctctgctcgcaaagctcgccatcccctacacggaagtcgccgaacaggctggcctgaatcccgcgcaaaaggtccaggcggtgctgctggaagatgccgttggcgcactcatggtgctgttcccgcagagccagttgctcgacctcaaccgcctcgccgaactgaccggccgccgcctcacagcggtgtcaccagaccgcgtcgagcgaatgctggccaagcacgacctgagcctgctgccgggcctgcccgcgctgaccagctcgccgtgcctgtacgaaggcagcctgctcagcgagccgagcctgctggtgcattcgggtgaagccgggctgctgctcgaaatcgccagcgacgacttcaagaccatgctcaccaaggccagcgccggtcacttcggcgagcccttgagcaacatccgccccaacctcgaccgcccgaatgatgaccgcgaggaaatcacccaggcgatgcaggccttcaccgcccgccgcatccagcaacgcctggaagcgaccatcgagattccgccgctggccgacaccgcgcagaagatcatcaagctgcgcgtcgaccccaacgccaccatcgatgacatcaccggcgtggtggaaaccgacccggccctggccgcccaggtggtgagttgggccgcgtcgccatactacgcctcgcccggcaagattcgttcagtggaagacgccatcgtgcgtgtgctgggctttgacctggtgatcaatttggcgctgggcctggccctgggtaaaaccctgagcttgcccaaagaccatccgcaccagtccacgccgtactggcaccagtcgatctacaccgccgctgtaatcgaaggcctgacccgcgccatgccgcgcgcccagcgcccggaagccggcctgacttacctggccggcctgctgcacaacttcggttacctgctgctggcccacgtgttcccgccgcacttctcgctgatctgccgccacctggaggtcaacccgcacctgtgccacagctatgtcgagcaacacttgctgggcatcagccgcgaacagatcggcgcctggctgatgcgctattgggacatgccggacgaactgtccaccgccctgcgcttccagcacgatccgacctacgacggccaatatgccgagtacccgaacctggtgtgcctggccgtgcgcctgctgcgcagccgtggcatcggctccgggccggatgaagcgatcccggacgcactgcttgagcgtttgggcctgagccgtgacaaggctgacgaagtggtcggcaaggtgttggatgccgaggtgctgttgcgtgagctggcctcgcagttcagccagggctaacggcttcgcctgataaaccgttatcgcaggcaagccagctcccacattcgaccgagttccacctttggaatgtagtcatatgtgggagctggcttgcctgcgatgaattcaactcggtacctctgaagaaacccttcaggccttcttcttcggattcaaatactgggtcagcccgctaagccgatgacccgccgggttgccgttgatctggatcgacctgtcctgaatcccgatggaaagggatgctttaactcacgcctttatttactgttaaaaagagatttttattattcagtatccgcataggggtcatctcaaataaatataactacctgctgactttcacaggtacatatttcccaagcatcagataaggtcaaccctccgattgaacgcttggagtgtataaaatggatttccaacaagttaaagatgcagcaaattacgtttctgagagtattcagggcaatccgtctcataaggctctgcgtcccgaaagccccgataccataccagaaaaactgaaatacttagacaatacaatttaccttactatatacgacacacaaggcaagacccatgaaggaactaaagttaaattagagcacaatggttccgagtgggtgctaactgtaaaactgcgatctagtgaagaaagaccatttacgagcagtgagatttcctcaattaccagacacacctaaaccaactaaatttcaactatccgatcaggcgctcacactcacgggcgcctaactttctgcggaggatttcagaaagtccgaccttgagaataaaattttaccttcgcaggccagcccgggacaatccgacacatttgctctttatagataacatcaccgggcttgccttccgaggcggacgctgcccctggaaccagatcacccgccagttcttaatcggctacaagagggtgaaaacaactacgacacatatacggcaacaaaacgcgtgagaccctcataccttcgaaacaacaagaagcatatagcgcggaaccctcggtagttatctacccacataaggaatgcaagtaaactttcctactaacacagttccggaatcgctaaaatgaactctatttccaacataggcgtaagtatttatccgcgaccaacagccaccgcaccgtctataaatgtaaacggcaccctcacccctagaagagacgaatattggtctgtattggtgataacgactccggatccgaaggcgccagttaacgctgaagggcgtgattaccatcctgcctccgacataaagatttacacagggcacgcggatgatacgatcgacataaaagttataaacaaccgaatcgtcgccgtcatcaatggcatctcggtcaagttggacatggatgcgtcttccctgggtaaactccatatagaaaccggcggcggcaatgataaagtaacgatagcccctgacgtaaaggtggctgtaaatgttgataccgggcccggtcaagacaccgttaatacgggaggtggcttcactgaggtacatctaggtgaaggaaacgataaaggcagtctgggccccggcgggggtgttttatacggtgaagacggtgacgacacgatagagggcgggcctggcaataactttcttctaggtggcgcggggaccaatactataaaaggcggtacaccaagcgattcatctcacacctggatgatcgccgagggcacaagggacactctcgaagttcgcgctgaccatacgtccatcgataccaagtcccaatttacatcaatacggttacaccgcgagttcgatgtccaactcaagatttttgaaagtgccggcaatactgaaaccattgatccccaggattcaaggggcaggcccgctgtctgggtgaattacacacgccggaacgaccccactaaggaccgtcgaatacgcgcaaacgcaccagactaaacacctccggcgcgacaaaccctcggggccttcacagccccgagattacaagagctacaacatccggaaatgaataaaccggaactcccgccctgcactcagacacacagagtgcgtatgacttcagtcactcatcgccaaaccctttcttcactgggtacttcccctgttccaacttggagccctcgtatgacgctcatttcgccttcaattcccgcacctgttcctacaccgtacatcccgcctgcacccaagcagaaacctgccgttaagatcgtccacggtcgtgattcaaaaggccctgtcgtcagcattagcgttacccatcaacaggccgacatcaggattaaaaaagaccctaataacaacgtagtcgcgtttattaacggcaaaccgtatccgttaaatatcccaaactccgacctgagtaccctcaacatcactacaggccgctaccgggatcatgtaaggattgatgacaacgttaaggtctatgcctacatagaaacaagatccggtgacgactttgtaaaaacgggaggcggcaaggctactgtggaagcaggccctggtgatgaccacgtacaactcggcacgggtggagggctcgtacgcggcggactcggcaacgataaaatgttcggaggcactggccacagcacgcttcatggcgacgacggagaaaactatttttccaccgacatccccaaatactcaccaaaagggactgcaatatactcatcaggaaccgaggacacgatacgtgctgcggctggcaacgtggatattacggtttacagtggcaagaccaatattgaagtagataaatctgtatcgcccaacgttcgtctttatggcggttctgggcgtagcaacatcaccgtcgatagcccgtctgaagagagtaatgtcaaaatactggggcaaaagaaaaacgctaattttatttataaaagaaatgcacttccttgatatcaggtgcccggggcacgcgatgccccgagcaccgagaacaactaacccaccttcttcttgcgcggcttcaaatacttggtcagcccctgaaaccagatcaccagcgccgggttgcccttgatctggatcgacttgtcctgaatccccgtcataaacgccagttgcttgttcttcgcctgcatcgtggcgaagccgtaggcggcatccttgaaggcgatagcaaatgcgggcgctgggtgaacacccgagcggctggtgatgcgctggtctttgacgatgaagtgacgggcaaccttgccgtcgagggtctgcaactggaacgccaggtctttgtcacccagctgttgctgaaaggcgggattggtgcggctggctttgcccatcatcaggcccagcacccacagcagaagacgaaatttcatgcacacggcctcggtgtaattattaagtggccgcagcagtgtaacgatttgcttaaagaacgccaccgatctcgcgctttagcaggagatcggctggcgtttaacgcttatagcaacatgttacttaaacgttagggcaaggcaccggcgcccagtcggcgaggtttggatcacggcaagtgccttcgatctgcgctttaccggcactggcgacctgcttgctttcagcttgcttggcctgcacggtctggatgctcttctcggtggtcaccgcttctttcggcacggttggcagcgatgccttcttcgctggttttacaggttttttgcctttggccggcaccactggcggcgtcgtgtcggcggtcgctaccgtcaccacgtcgttgcgctgcacacccacttgttgcaggtctttctcgtaagcctgggtgtagttgttcaggtcttcgctggctttgccgttgaccgcgacgatcaggtcattggactccttcaagcccgctacgatttccgccaggcgcttgcggccttcggtgtcgttgacggtcttggccttgcgatcattcaccagcttggtgaatgcgctctggtagcactgctgggacgccttggcgtacgcggtgctgcggtcgatgtcggcggcgcttttgttgaagtcggtggagtacgacgcaatgcgctggttgtcatcggtgatctgcttttgacgctcggtgtagtaacccgccgcgccgccagccagggcaccgcccgcagcaccgatggcggcgttacggccgcgcttgtcggagtcgccggtcagcgcgcccagcagtgcaccgccggcagcgccgagggccgcgccggtgacgaccgacttggtcatgtccgaatccgtcgcgcgcaggtgctgcaccggctcgtagcagttcgggtagtactcgaccttggtgctcgacgcgaccttggaggacggcgacgtggcgcaaccggtcaacacggtgctgaaaccggccgcgatcagcagcaggtgacgcttggaaaccgtcttacgggaaaaaagcataggtgtgttctcttttaagtttgacttgcccagcacggcccaccgccgcctgagtcccttccaagctcgctatacaaccagcgatcaagaccgctgaccgctcgctgcgagcaattccttcaagatcgttgccgggtcggcccgctgttgcttgcggtagttgccgacatggcgaacgaacagtgttgcgcgcgtcaccaggctcttgccgagcacaggcttgcgatccaactcttccttgatccgttgaaactgcgcctggatcactgcatcggtgtagcgcgtgccggtggccaggttgtcgatatagatcgccaccgcgccatccagcgcgctgcggccattggtgatggccatgtcaaacaactgcgcgctggccgcgtccttgttgtacagcgcttgctgacgacttttctgcaggttggccaggcggatgttgtagttggcgatggtctcggccaccaacgcggccgactgaatcaggttgcccgccgcttcttcgcgttgctgggcgatcagcgaaacgttgcgcttgagctcttcgttgaccaggcccagctcggcttgcaacttgggatcgacactggcggcgataatgctgtccaggcgcttggtcgggtcctgggcgtcgtcgatggcgtcagtcagcgaggccaggcggccttctttctgccactgcgcgaacaattccttgtagcgcgagcgcggcgccgacagcgcgccaatcgccacgcgaaaaccggtggtctcgttgctttgctcggtgccgtcggcggcaaacaacgggtactcgcggcgcatgccggtaaacagcgtgccctcgccttccaggtagttgccgcccttgaccacaaagccgccataggtgccctggcgacgcccggcgtgcaccagttggaacgactcctgaaccatttccgccgcgttgccgatcacgtcgaacatgccaatcgggttgggcagtttggtgccaatcggcatcagccgtgctgcctggccggtgccgccagcgacctggttgaacaccgcgtaatcacccagcgggccatcgctgtcactgccttcgacgcggcgcggaaacagccgcccttcgaggtcctgacggctcaccgcctggccaccgcgtgcggcgaactcccattccacttccgtcggcaagcgtacaaagcccaggccgccgtcttccgccgaagaaccgcgaccactcaccggcagcaagtcgcggtgatatttcatcaaccaggcgctgtacaccgccgagaagcgctcggcctcaaagcgcgacagtttcaccttgggcaaacgcgcggccatgccggtgggcgcatcgcacgccggcgccggctcgccactggccagcgactgcgcctgggacatcacttgggcgtactggcgtgcggtcacttcgtacttgccgatgaaatacagcatcggcttgagcggggttttggcgtcggtcttcggcatcaacggcgcgatgactttgttccagtctttgggcaaatccttgagggtgaactggccgttgataaagtcgcggcggtagccggaaataaacgactgctgataaccggcctcgccttcgctgaacgggtagccgaggctgatctcgcggtcatccagggtgccttgggccagcacgtaggcgtagcggaacaccatgttgccttcgcacggcagcggcaggctcacgtcatccggcaacggtttggggttatcgagtttgtcgctcgcctcatccgcccacgccagcgaagccaagctcagcgccacgcaggcgcccagtaacttatacatctctgattccttcagaagcctggatacgcgccactcgccaaccgccacaagccgccgccacggcgctgacgccgaggattgcaaccagggccaggccgtagtgacgcgccagcaggtggctggcgtattcacccggcacctgcacaaataatttattcaaacccgcctcggccacgccatacaacccggcactgagcacggcggcaacgcctgcgctgtacagcgcttgcagcaccacaaacagcaacagcccagcggtggaaaaccccaacaaccgcaacaccgacaactctcgacgcttgcgcgccacggccgccaacgccccggcaaagatcgccgcaaacgcgcccgccaaggccaacccggcgatgatccagaacacgatcgacaggttgcggctcaacgactgcacctgggcgatggtgttggcctgggtcgacaccaacaggttctgcccggcgaaaaacacccgcaacggctccacatcggcgaggctgcgggcgtacaggcgaaacgccgggtacacccgctgctctgtcgcgccgaccgcctcaccttcccaacccaacgccggcactgcacggccatcgcgataatcttccgccgcttccagcaagcccaaatcggcaaacaaaccgtcacgcgcaaacgcctcaagcggcagcaccgctacaacctgcaaccgcgtgcgctgggcctcgacgcgccccgccacttgccgcgcaaagtgggtctccagccaatcgcccggccgcgccgcgagtttttccgcagcggtgtggctcagcacgatctggtccaggccgcgaggcatcgccagccccacgagcaacggatcacccggcgcggtcggcagcatttccaaggtcagcgtgcctacttgcgccgtcgccgcaatctgccgtgtacgcggcacggcaaaagccacatcgctacgctgggcaagctgttcgataaacgccgcgttgaatcgaccaccgcccaacggaataatttcacgggtggccgggtcggtctccaagcgttcggtcaaactgctaaccagtccaaatttcagcccgaataacaccaacaacggcgcgatgacggccaccagcgccagcaccgaacaggccgacagccaggcgtcgttgcggtaatcctgccaggccagagacgccaccaggccgatacgcatcagcacacctccccgagcgtggcggtgacgccgccatcggcatcgcgccggcaactgatgcgccgcacctgcaagccactggcgcgggccaagggctcgtcatgggtagcgatcacacaggccgcgcgatgctcacgggcctgggccagcagcgcctgcatcacgcgctcagcattcagcgggtccagcgacgcggtcggttcatccgccaataccaattgcggcgcatgggccaaggcgcgggcgcagctcacgcgttggcgttggcctaccgacagcgcggccggtttcttggccaactgatcgctgatttccaactgctcggccaggcgcgccacgctgccgtcgtccttcaagcccaacaactgccgggacaaggcgatattgctgcgcacatcgagaaaccccaacaggccgccggtttgcagcacatagcccaggtttttgctgcgcaactcggccaaagtggattgccgatcagcacgccacagcccgccgatatcaacctgatcaaactcaaactggccaacctgatccggcgccagcaccagcgccagcacatcgagcaaggtacttttgccgcagccactgggcccgacaatcgccaattgctcacccgcgcgcagctgcagcgccggaatcaccaggctgtagcgttggctgccgacgccgcggcttttgtgcactgcgctcaggttcagcattacggcaacgtcgacaaaggcacgcggtacaacgcatcgcccggctcggcatcgccgaaacggacccagttggccacgtcattgtggaaggtttcgtagagacggattttcgaatccagctcgtcgataaagtcttcctgctcggccacgctcaacgacaaccacaaatcctgggtcatgttcagcgacttgctgcggtacggcaggccttccaggtattcgccgagaatgccgccatcggccaggttgccgcccttgcgcagggcttgcgggtcgcggctcatgtacgccgaggcgctggcgatttcctggaagaaatccttgggcgaggtctgggttttgcgtgcggcgtcgacgatcagcttcagcgactgctgcaggtcgttgagctgcaatttagtcagcatcacgcacacctggaacgccggcagcaccgggttagtcaggtcgcggtcggcggtccaggcgctgaccagctgcggcgcctggctggcggttttgcggccgaggaaatccatgtgcatggcgtaaccgacggcggcggacttgtcggccaaggtcggcgcggcactcaacagcggcaccgcttgcggcgtgttgctgcgcacctgatgcacgaggttggcgaacacgctgccgatctcatcgacacgctcacccagcttgcgcacgtcgccacccggcaccggcgtgtagaggtcgccgatctgcgggttggcgtcggcagtcagcacgcggtactgggtttctgcaccggcgtgggttttcttgccggcgtcggtgcgcaggtgcaaggcgtagatcttgatctgcttgcccaaggcggcctggcgcacttcggcttcgttcatttgtgtggcggcgaacggatcgttcttgcgcagcgcccccgcgtcagtgaccagcagaataatgcgcccgccgtagccggaccaatccatgccgtccaccgcctgcatcaccccggcaaacgcgtcttcgttgaacgagtggctggacacggtggaggctttgacctggcgtgccatgtcgaggaagcgttgcggatcgcggccttgatccagcgtgatcagcgtcttggcgacgtactccaggccgggggttttcttgatgctgttgcgaaaacccaccaggccgaaactgacgctgtccaactcgccgcgctcggcgatgcgggtctgcaactcgtgcaccacatcgcggacttggtcgatgtaaggctgcatcgacacagtcgtgtcgaccaccagcaccacggcagtgcggaaggcgtcggcgctggtgttggccgcgcgagcagtcggcttcgcagccgcgctgctgccgggatcgatagaggccacattcagcaactgcaccggctggccgttttcgtcgaagctctctttggagtcgaagatcggcagcaggtaaaactggttctgcggcacggcgctggccgtcggttccagcgccagcacttgctgattgtcttcgctgttcttctgcgccttggccagcacgcctttggcggccgcaggatcagccaacagcttttccacctcgctggattggcgcaggaacatcaccggcgcgcggcccgaacgctcggtgaacttgagcaccaaactctgcttccagtcgctgacctgggcggccggcagccagccatcgctgcgcccatcggtggcggcaccgacgcgcaaccaggggctgccatcgacgtctttgcgctggtacacgtagagcaccgaaaacgctggcagcgcttcgccggaggcaccgccggcgtcatgggacagcttggcgcccggcttgctgagcacgcgctggaacagagtcttcttgcccgccatcagcaaggggcgctggccgccgtccgcatcggccacagccgtttttacttcagggggcgcgggcgtttttggcaccaccgcagcgggcggtgccgccggcgtatcgctaccgctcagccaccaataactcgcaccaccaatggccagcgcgacagccaccgcgaccgcagccagggccaacaccggcccacgacgctgctccgatacggcgttgtgttgggttggcgtcaccaccggctggcgcaccggttgcggctggggcttatcggtcggaatctcgatagacaccggcgtcatgcccgccaggtcaaaactcagcggaatcggcaacggccgcaccagcgtagcttccggcgactccgccggcagctggtccagcgcgcgcagcaacgccgccgcatccgggaaacgttccgccgggtctttggccaacagcttgcgcagcacgtcctgataacggccgtggtgcaccggcaattcgggcaggggttcggtcaagtgcgcaagcgccgtggaaagcgcatcggtgccggtgtaaggcagcttgccgacgagaatttcatacagcaccacgcccaatgcgtagaggtcggcacggccatcaatctcctggccccgcgcctgttccgggctcatgtagctcggcgtgcccacggcaaatccggcttgcgtgaactgggtgcggtcatccagggatttggcaatgccgaagtccgacaacacggcggtgccgtcggcgcggaacagaatgttcgccggcttgacgtcacgatgcaccaagccttgggcatgcgcatagcccagggccgaagcgatctggcggatcagcgtcacgccctgctccggcgtcagcccggcggcgatgcgctctttgagcgtgccgttgggcaggtattccatggccatgtaatacagctcaccgacattgccgatgtcatggatggtcaccgtgtgcgggtgcgacaagcgcgccagggtcttgccctctcgcaggaagcgctcgcaaaaactcgggtcggccgccagcgcggcagccatcactttcaaggccaccttgcgctccagcgagcgctgggtcgccaggtacacgctggccatggcgccttcgccgatctcgccttcgatgtcataacccggaatcacgatgttcatggcgaaaccttcacgacaatggcggtgatgttgtccggcgcacctcggttgaggcccaggtgcaccaggctgcgcacgatttcgtccggcgcgtcatggcccagcacctcgcggatttcatggtcttcgacggttttgttcaggccatcgctgcacagcaggtagctgtcaccgggggcgatcagcagatcgaccaccgacagttccaactgggcttccacgcctatcgcgcgggtgacgatattggcgcgcgggtgcacacgggcatcggcctcgctgagcaggccgctgtcttgcaggtcctgcacgtagctgtggtcgcgggaaatgccttcgagcacgccgtcgcgcaggcggtacaggcggctgtcgccagcccacaaacacacgccacgcaggccgcgtgcggccaagaccacaaccgtactgcccatcatggtcacgccacggttggcggtttcttcgcgcacggccgcgttgatgcgcagcaggtcatagcgcaaggccgccgagtattcgtcgagggaacgccccaccggcacattgcgcaggctgtcgacgatcaaactgctgacgtagtcccccgccgcatgcccgcccatgccgtcggccaccacccacaggcggttttccggcaggtccagacacgcgtcttcattgacctggcggaccatgcccacatggcttttgctcgcggatttgaacgtcgaccccatctacatcacaccttcttgtccgagcaaaaactgcgcaaaatcgccggcggcaggcaagccctgacaccgcaataaaccaggggaaatcacctgcgagccacggccccaccacaggctcgcgccctcgcaggcctgctcggcaagcgcggtcatgcggctgtggggcacggtggcggccactcgttgcaggccggcaaagcggctgtccaccgcgcgttgctcactggccggaatgccgagtttgtcgacgccgtcgttgaagccttcaaaggtcgcgccggcatccagggtgctgagcagcagctcttcggcctgctcaaaccaagtgtcaggcccgccgaccagcgacgccgggttggtgtcgtgatcgagcaacgccaccaccgccagcgggaaataccgcccgacccggtcaatgctcggcatcaccacacccgccgccgcatccggcccgcacacacccggcgccagcacgaagcgccacaacgggctgaccaaatacacgttgagccagtcaccgccgaggctgttctggctggcaagcaaacctgccgccagccagctgtcccacgggccgataaaactctggggcaaggcgcggctgacaaagtcaccgcggctggccaacttgccgtagaaacccagcgtcgtcataaccgctccggcaggctgaagccactgagcacgcgactcttgaacgggttgaaagcactgttggcgcgcaactcgtaggcgatgctcgcgccgtcgacccgcaggcgcaggttgaagcggtccggcgagttgccggcggtgaggtccgactgttccagcaagcggaaccaggcccacgggccgtccagggtcacgccggaacggccactggccgacggcggcatgatcgaaatgcgcaccacaccgatgctgccggggttcggccattgcatggccaccgggcggcttgggccgtggtcgtagctgatttgctggccgtccaggtcgagcaggaactgggtgatggtcgggtccatcgacaccggtttaagctcgaaacgcacgatcggctgggtgccgcccgcgcggaagaacgcatcgcgaatcgccgccgcacgctggaaggtttgcaacacgcccggcgcaatcccgagcttctgcgcggcgcccggctgccagcgccaggtctgcgcggaggtgtcgacgtaaggctgcaggtacttgcggaagtagttgtccatcaccccgccgacgccgaagaactgaccaaagtcgtccagcgtggcgtcacgcgcgctgcccggcgccatcgggtaacgcccggccagggactgacggtacacgttgaccacttcgctgacccatgccgcgttgagttggttgcgcacgccgcccatcatgctgttggtggtggaattgaccaccgacttgaccaagccctgcaccagtggcggctggcgttcggcgttcaggctgacccgcgtggccgccgccgctgcctggttcttcgcctcgccgagcaaggcatcgccactggcgccgaccatggcgctgacctgcacatacagcgcgttcatgtccgccagcaggccatcgatggcagccggctcgccttcattcttgctgacgatgctgttgagttcggcgaagtgcgcagtcaccggatcgtctgccgcctgcggtgcgttggcggtcggttgctcctggccaagcaggctgccaaggcgctccttgagcttgtcgacgccgccttccaccggcacgcctttggcggccaattggcgttcttcggcttgcagatcggtttccttggatacggccaccagcagctttttcaacggcgacgtaggtccggaaatcacccgcagcacatccgccgcctgagccacgctggtgatcggcacgaagtcgatgtcggcaagcagcgcgtcccactggcgctggtaatcctggaagtacaggcgacgcacatcggcggcgaggctgaccacgttctgctggtcggcctgttcacggcccagcacccattgctcttcggcgagggtgccggtctggttcaggctgctgagcaggaatgcctggcgataacccttggcggtgaagaacccactcagcggctcgcctaacggcttgccacttttgcggctgaacaccagcgcagcgtcgcggccagcggcttcgttaatgcgaaagtccggcacgccttcaggcagcttctggcgtttgacccggtcatacacgcgctgagccaccggcagttgttgcagctgccgacgcaggtcgtcgatcagccgtgggtcgaggcgggcgttcggcgggtggcgttcgaacagcgcctgcaagtgcccgctcaacgcctggcgctgatcggccggcaggtcgcgcggcaggttgcggtcccagtccagggcgatccaggccttgatgaagtccgggtcgtaatgctcggcgtcggcgagcatcaagtaggccttgaggccttcgtacaggaagtcggaattgccgccgccgtgcagttgttcctcgatgcgcgtcaccaggcgtggcgcgaatacggcgatcaacagcttgcggtagacactggcggactcggcttcaagcatgtcgccttgatacaggcccaggccttcggaccagctcggcgaatcacccgcgaggttcttcaccgcattcagcaacggcagcacagccagtacttcgcgctgcgccgggctgaggttctgcacggtctggcccagcggcgcgaccttctgatcgacctgggcgatgtacgcttggttggcacggtaactcacccaccacaaaccgctgaccaccaccaccaacgccacggtcgccgccagcacgccgcgtgcgatccatttgcgccgacgctcgaccttcgggttcacacccaccagcccacgctcggcaaaggccacggcggtgaacagtttttcgatgaaataactgcgcccggtgccgccctggcgcgccaggtgttggcggtccaggttcatgctctgggccatggcgccgatcaggcgatcaatcgggctgccttcctgggtgccgctggtgaagtacacgccgcgcagcaacacgcgctcttcaaaagcgttgggtttgaatacgccttcgaggaagccttgcaggcaatccttcaaggcgccgaactgctgcgggaaaccgtagatcaggtcgcgccgggctgggtcgcgctcttgttgcaggcgctccaccaagcgttcgttgaggcgctgctccaagccagcgaactcgctttgcagcgtcgccaatgggctgtcgctgtttttgccgtcgtccagggcaaaggtcatgccccatacctgggcgcggtcttccttgctcaggttgtcgaagtactccatgaagcccggcaccaggtcgagctttgtcagcatcaggtagatcgggaaacgcacgcccagctgggtgtacagctcctggatacgcaggcgaatcgcagcggcatgggcggcgcgctcggcatccgtgccgagcagcagatccgacaggctaatggcgataaacgcgccatcgatcgggcggcgcgaacgctgctttttcagcaggtcaaggaagcccagccacgcggctttatccaccgtggagttgctgtcttgcgtggtgtagcggcccgcggtgtcgagcaaaacggcttggtcggtaaaccaccaatcgcagttgcgcgtgccgccgacgccgcgcaccgcaccggcgcccagctgcgcggccagggggaagtgcaggccggaattgaccagcgcggtggtcttgcccgaacccggcgggccgatgatcacgtaccacggcagctcgtagaggttgcgacgctcatcaccaccgagcttggcctttttcagcagtgccagggcttcgtccatgcgctggcgcagggtcgataactcttcggcagtggcgacgctgttggggtcgaccggggtttcggcggccaggctgcgcatcacttcggcagcctggcgccgggcctggataatgcgtaacacgcgatacgcaatccacaccgcaaacaccaggattatcagcgcccaacggcgcccttccggcaccaggaagtcgagcaacggcccgacaaaccagatgatcaggctcagggcaatcaggcccagcacggggatcacccagcgaatcataaaactgaaaaacgccttcactcgacgccctccgccaatacggtgatttcaacccgacgattgcgggcacggccttcggcagtggcgttggttgccacaggctcagtgtcgcttcggccttcggcgctgaagcgctccgcctggccggtcttggctgccagaatctccagcaccgacttggcgcgggcttcggacagcgcccagttggacgggaagcgcagcgtggcaatcgggcggttgtcactgtgcccggtgacgcgcacctggcccttgaccttgcggatggcgtcggcgatgcgcagcatcaacggctggtagtcatcgacgatgctggagctggcggacgcgaacagctcatcgccgcggatcgtcaccacggatcggtcgaccttgtcttccacggccacacggcctgccttgatgtcttccaccaggaaaccggccaagcgtggccgctcaatgactttcggctgcgccaccggccggtcgatggcctgcaccggaatctcgcccagggcatggatgttcttgaacaccggctcggcgtccgaggccagcttcatgcgcaagccgaacagcaacgccagcagcaacgccaggccgatggccacggcgatccacggcggcatgaattgcgccaggcgatcacgcgccacggtcacgccgcgccagtgcggcgatagctcgcgctcgtgttcgccacgcgcactgcgaatggcggcggcggtgcgttcacgcaaggcttccaactggctgcgaccgtcgttcatcacgcggtaacggccctcgaaacccaggcacatgcacaggtacaacagctccagcaggtacaaacgctcgcgcgggctttgcaggcagtggtcgagcaactggaagactttttcgccgccccaggcttcgttgtgcacggtaatcaacaggctctgtttgccccagtcgctggtgctgccccacggcgtactgagcaccgcttcatccagcgcggtgcacagcgcgtaacgcgccagcagcacttcattgcgcgccacgccagcggcttcggcgcgctcttcgaactggcgcaggtaagccagcaactgcgcgcgcaggctggccggtgccgggtgcgcgatggtgttgcgcaggcgcgtcaacagcgccaacagcgggccggcggcgctttccagcgggttgaggccttggcttttgccggtcaggatcggcgcggccggcatcgataaaggcgccggttctgcacgcgcaggttccggcgcacggccacccgggcgcggcatgaactgggtgcggtcatcatcattgggatgcatcgcggattatcctcggatcgcccagaaggccaggttcaagcccgggaactgcccggcgatgtggaaggcaaagccaccggaattgttcagctgttgccagtgctcgctgccacggtccagttcgtaataagtgctgccggcgtggtacgggatctggcgtggcgccactggcaacggcaacaggccaatgcccggcagttgcaggttgaccatgtcgcggatgtgttccaccgaaccgactttgctctgctggccgaagcgcgcgcgcaaggtttcgccgggcacatcggcgcgcaccacgaggatgaagctggcgctgtcgagcagggttttgtcggcgagcatcgccacgtggatgccgtaggctttctctacaatcgggatcggcgtggccttgctgtcgatcagcatcgacagcgcttcacgcaaggccgccatcaccggggcgaagctcaaggccaggtcgtcgtgctggtagtgcggatattcctgggggcgccgcgccgacgtcgagaaggtggaaaactcgccggccaggctcaccagttcactgaagaaacgctccgggtgcagcgggctcaactggctgaaatgctggagcagcggctgcgcgcggttgaccagttgcagcagcatgaagtcggcaatctccgacgcaccaccggcgcccgacgcgaccacgcggccggccagggcttcgccacgctggtgcagcaggccaagcagttcgctgcgaaaggcggtcagcggtttgctggcggccacgtcgagtaccggtggaatgtaagtgtcgtcgagcaccagcgcacggtcggcgcgtttttccttgatgcgcaccaggccaatggcggcgtaatcgctgatgccatcttgtgccgtcaacaggcgcagcgcgcgcgagcccacggccaccggtgcgcggttttcgaacggggcattatcatcacggacttcgcgcacctggctgacataacgtgcggcgccgaggtcttcgccgtcgtctaccgtgtcacgcgcgcctgcgcgcttgagcggcaaggccaggtagaccaggccgtcgcgcaggttgtcgtcgatattcagcgggctcggcgccaggtcatcctggggaatattgaacggcgtgccatccggcaacaggccacacgccgacacgatggccagcttgccctgggccagcaggccctggtcaatcaacagctcggaaaaaccccacgcgccggcagacaacgggcggttgcgggcgtcgatcaggttttccaggtaacggtcatgctgctggaagtgctgcgttccgatgaacatgccttccgaccagaccacgcgattgttccaggacatgggggctccgattgcttcttattgggcagggctggatgggggaaccacgacgtcagcgcgcaccgcgcgcacatcgaggctgatctggtattcggtgtattggcgcgccggtacggtgagcaccgtgcgccattgcgcgcggtccagctcgcggtagcccaccagcaagccgatttggcgcgtggacgggtcgaggtcgcgtttgatactcagttgctggccgggctggaccatcacttcgtcctggtcgagcaggtccaggccgagggtggattgcgcgcgatcagccagtgcgaagtagtcggagcggctgaaggtggcggcgtttttcagctcgaaaatgcgcacccgcaccggggcagcctggccgttggcgccggggttgagcccggcaatggcgtgaaagtgcagctcgacggcggcggtgtccgcctcggcttgcgcggcggcctcgggtttgacggcatccttggcacacgccgtcagcagcagcgcggtggcggctgcgagtaaaaacctgggaatcatcctgcgtcctcaatgacgtacttagctatccgttttatccattactgcgtcgtgctttaacgacgctgtcgtgcgctgtgttcttcgtaggcgcgactgaattcgcgaccaaacaagtcctggaagtcctcttgggcttcgcgggaaatattgctgtaaagctcggtgaactgctgccagtactgggcctggcgcgagccgttaaacaggctcgacagcccggcgggcttgcccatgcgctcttccagctgcgccggttcaaagcgcgtgagcaggtgtttgattgccgcttccacaccggccattaccgccaactgatgagcgcgcaggtcgtcgaaactgtcgcgcacggcgatgtccggcgccataaacgcttggtttccatgacgaagcaacagcagtaaggcttcgtcggcattcggtgcaaatttcaacgggttgttttcggcaggctggatcatcgtctgttgcatgcggaactcgcccttgaggctggcgcgggcgcgcaatacgtcgatcaggccttcgaccatcagccggtagctgcggccgatgctttccatctgcgcgcacgcgtcggctttgtcgaggcgcagttggtcgaggccagcgccgcgcaggaaggcttgcaagaggtcgggctgttggctgtcggccacggggggcacgggctcgaccaccggtggcggctggacgacgggcggcgcaggcggcggtggaacgggtgtcggaatgctgacaacgggcgctggtgtgtcgccaaacaggttccagtcttcaggaatgactgagcccggcaccaccggcttctcgactacgggcacggcgaccggggttggcgggcggaagtcgtgctgctcggagggcacgtggtctgccacggtcggtggtggcacggctgtcggcgtgaggaagtcgaacaggtcgggcagcgtgtccatcgacgaagcgccctgaaactgcggcgcgatcaccggtacaggcgctggcgtgttcgccacagcgcccatcagcgcctcaaaactgttcggcgaatcaccggtaaacggctgactatcaacggcttgcacgttgaagtcgatgcgcgcctggatttcgtaatcgccgatgcggatcagctcgccatcttgcaggagctcgctgttgcctcggcgcatacgaatgccggcgttgaccagttccacgccgttggtgctgttatcggttaaataataacggccatctttgtattgaataacacagtgttgcgaggaaaccaggcgctcgggatcaggcaatacccagtcattatccgaactgcggccgatagccatcgagccctgattcatggacttttcggggcactgcccaggggtaatcttgtgataactagtgatagtcaaacacagcgacatcttgcctccttgctgatacttcgcgcgcagtcgattcccgggacgacggtgcccgagagatccccaccaggtcgtgcaatcgaccttcacaacctgtttttgtcagcatgatcgctgatcttaacggggctccatgacaaaaatcctgtcccggtgcgccactcgactcaccagtcgcgcaggttgttaagcaccgcacatctgtcacagagggcgaatagcttaccttgacaacgcgtaactactacaccaaaaatgcacaacttcttgaacatcagtgatggcacattaatggcattctgactatatgaccaagaaaacatgcaaagttcattgcgcaactaatgcatgcattgcccggtatctaacgggcggatagggagatcaaatcaagtggatgtgccgttgctgctcgccgccgtttccgcgacttcgccgtgtggcgaagatatggaatatgacgcgcaatttctccaattggagcgtgacgccaaaggccaacccgagcgcagcatgggcgactcgatcttgcccgctgaaccgccggaatggcgcagcatccagcagcagagcctcgacctgttgcagcgcagcaaagacctgcgcatcacccatttcctgttgcaaagctccctcgccctgcaaggcgtggccgggctggccgacgttctgacgctgatcaacgcgctgctgcgcgaatactgggccgacctgcacccgcgcctggatgccgacgacgataacgaccccaccgtacgcatcaatgccctgtccggcctgaccagcgatgcgaccattcgcctgctgcgcgaaagtattcttacgcgctcgcgcacgttcgggccggtgagcctgcgcgccgcgctgaacgccagcggcttgatgagtttccccgatgaacaactcggcgcccagcaactcaacgccgcgttcctcgacagcgaccccgaacaactgcaagccacccgcgaggccttgagcgccgcgcgtgccgcctgcgaagccatcgaacaacaggtcagcgaccaggtcggctcggcccagggcgtggacctcagcctgttgaagcaaccgctcaagcaggcgctgcaagtcctcaaccaatgcgtaccgaacagcgataccagcagcgagcccgaggccgtcagtgacgacaatgccccctcggttgaatacgccgctgcccccgccgcaccacgcccgacgggcgacatcgccagccgcgatgacgtgctgcgcagcctcgacaagatccttgcgtactacacccggcacgagccttcgagcccgctgccggtgctgttgaaccgggcgaagaatctggtgcacgccgacttcgcggccatcgtgcgcaatctgattcccgacggcatgtcccaatttgaaaacctgcgcggcccggacgacgagtaagccgccggactgtgcagtaacaacaccgtcgctcaagcgaccaggagcagcaacgtggcgaagcaaagttctcagaaattcatcgcgcgcaaccgtgcgcctcgagtgcagatcgagtacgacgtcgagctttacggcgccgagaaaaaggtccagctgcccttcgtgatgggtgtgatggccgacctcgccggtaagcctgccgagcctctggcgcccgtggccgaccgcaagttccttgaagtggacgtcgacaacttcgactcgcgcctcaaggccatgcagccgcgcgtggccttccacgtaccgaacgagctgaccggcgaaggcaacctgagcctggacatcaccttcgaaagcatggacgacttcagcccggccgccgtggcccgcaaggtcgactcactgaaccagctgctcgaagctcgcacccagctggccaacctgctgacctacatggacggcaagaccggcgctgaagaaatcatcatgaaagcgatcaaggacccggcactgctgcaggcccttgcgagcgcgccgaagcctgctggggatcaataatcatgaccgacaataccgcccgcgaaggcgcacagaacctgggtgccacccaagaagccagcgagttcgcgaacctgctgctgcaagaattcaaacccaagaccgagcgtgcccgcgaagccgtggaaaccgccgtgcgcaccctggccgaacaggctttggcacaaaccgatctggtctcgaacgacgcaatcaagtcgattgaatcgatcatcgccgccatcgacgccaagctcaccgcccaggtcaaccagatcatccatcaccaggatttccaacagctggaaagcgcctggcgtggcctgcactacctggtcaacaacaccgagagcgatgagcagctgaagattcgcgtgctcaacatctccaagccggacctgcacaagaccctgaagaaattcaagggcaccgcgtgggaccagagcccgatcttcaagaagatgtacgaagaagaatacggccagttcggcggcgaaccgtacggctgcctggtcggcgattactacttcgaccagtcgccacccgacgtggagctgctgggcgagctgtcgaaagtctgcgccgccatgcactccccgttcatcgctgcggcctcgccgaccgtgatgggcatgggctcgtggcaggaactgtcgaacccgcgcgacctgaccaagatcttcaccaccccggaatacgccggctggcgttcgctgcgtgaatcggaagactcgcgctacatcggcctgaccatgccgcgtttcctggcgcgcctgccgtatggcgccaagaccgacccggtggaagccttcgccttcgaagaaaacaccgacggcgccgacagctccaagtacacctgggccaacgccgcttatgcgatggcagtgaacatcaaccgttcgttcaaacactacggctggtgctcgcgcatccgtggcgtggaatccggcggtgaagtggaaaacctgcctgcccacacgttcccgaccgatgacggcggcgtggacatgaagtgcccgaccgaaatcgccatcagcgaccgccgtgaagcggagctggcgaagaacggcttcatgccgctgctgcacaagaaaaacaccgacttcgccgcgttcatcggcgcccagtcgttgcagaaaccggccgaatacgacgacccggacgccaccgccaacgccaacctggccgctcgcctgccgtacctgttcgccacctgccgtttcgcgcattacttgaagtgcatcgtgcgcgacaagatcggttccttcaaagagaaggacgagatgcagcgctggttgcaggactggatcctcaactacgtcgacggcgacccggcgcactccaccgaaaccaccaaggcccagcacccgctggcggctgccgaagtgatcgtggaagacgtcgaaggcaacccgggttactacaactccaagttctacctgcgcccgcactatcagctcgaagggctgaccgtgtcgctgcgcctggtatcgaagctgccttcggcgaaaagcgcataacaccgtagctcgttcccacgctccgcgtgggaatgccgcccgggacgctccgcgtcccagtgacgcagagcgtcacaggatgcgttaccacgcagagcgtgggaacgatcagcgttaataaattctgtggctgagtccacacagggagaaaacatggctgttgatattttcatcaagatcggcgacatcaagggcgagtccatggacaaggcccacaaggacgaaatcgacgtgctgaactggagctggggcatggctcagtccggcaacatgcacgttggcggtggtggcggcgcgggcaaggtgaatatccaggacctgtcgctgaccaagtacgtcgacaaagcctcgccgaacctgatgatgcactgcgccagcggcaagcacatcgacaaggtcaagctgaccgtgcgcaaggccggtggcgaaagccaggtcgagtacatggtgatcaacctggaagaagtgctggtcacgtccctgagcaccggcggctcgggcaccgatgatcgcctgaccgaaaacgtcaccctgaactttgcccaagtgatggtcgactaccagccgcagaaagccgacggcaccaaagacggcggcgcgatcaagtttggctggaacatccgttccaacaccaagcgctgataaacccggtggccgtggctctccgccacggccccaggtatctgcccctcgcaaaaaccgtccctctcacaacccgtccgtggagctgctttggtggtaactgaaatcgcttcccgcgaccgtctgcaaccgtccctgttggaccggttgaccgacgacgacccaaccaaccccaaggaaagcgccgacaaacgcgtgctgtccctgacccaattgaaagcctcggttctgcgcgacctggcgtggctgctcaacaccacgtcgttgctggatgccgatgccacgctgcacaccccggccggcacgtcggtggtcaattacggcctgccggcactcgcgggcaacagtgtttccagtgtcgatatcaaggcgctggaagcgttgatctatcaggccatcgccacctttgagccacgcattttgcgccacaccttgcgcgtcaaagcccgtgtcggccacggcgagatgaaccataacgcgctgagtttcgagattgagggcgacctgtgggcgcagccggtgccgttgcgcctgttgctgcaaaccgacctcgacctggaatccggccacgtacgcgtggtaaatgccgaccagcggaggcgcccatgaacccgcgcctgctggagctgtacaaccaggaactgcaccacgtgcgcgaaagcgctgccgagttcgccaaggaatacccgaagatcgccagtcggctgaccctgtccggtatggactgcgccgacccgtacgtcgaacgcttgctcgagggttttgcctacctgactgcccgcgtgcagctcaagctcgacgccgagtacccgaccttcacccacaacctgctggaaatcgcctacccgcactacctggcaccaacgccgtcgatgaccgtggtgcaattgcagaccgatccggatgaaggctcactggccagcggttttgcgctgccgcgcgacactgtgttgcgcgccgccctgggccgcgaaacccaaacctgttgcgagtaccgcaccgcgcacccggtgacgctgtggccgttgcaggtcagtggcgccgagtacttcggcaaccccgccgccgtgctcgggcgcctggccgccagcgagccgaaagccaaggctggtttgcgcctgaccttgcgcaccggcgccgaattgccgttcaacagcctcgacctcgacagcctgccgctgtacctcagcggcgccgacgagcagccgttccgtctttacgaacaattgctcggcaatgcctgcgcggtgtttgcacgcaagcccggtggcgattgggtcgagcgcctgccgcaagacgcgttgcgctcccgtggttttgacgacgccgacgccgccatgccggtggtggcccgcgcgtttcagggctatcggctgttgcaggaatacttcgccctgccccatcgctttctgttcgtcgaattcgccgaactgagccgcgcagtcaaacgctgcgacggccaggaactggagctgatcgtgctgttcgaccgccatgagccgagcctggaaggcagcgtcggcgccgcacagttcatgccgttctgcaccccggcgatcaacctgttcccgaaacgcgtggaccgtatccatttatccgaccgcgtcaacgaacaccatgtaatcgccgaccgcacgcggccgatggatttcgagattcattcgctgaacggcatcaccggccatggcaccgggccggagcagccgtttctgccgttctacgcagtgcgtgatccgtcgcgctatggccgtgaccaggcttactacacgctgcgccgcgagccgcgcgtgttgtccagcgaccagcgccgcaacggcccgcgctctacctacgtgggcagcgaaacctttgtcagcctggtcgacagccagcaagcgccgtaccgccatgacctgcgccaactcggcgtgaccgcgctgtgcaccaatcgcgatctgccgttgttcatgagcataggcaacggcaagactgacttcaccctggccgacagcgcgccggtattgtcggtgcgctgcgtcgccggcccgagccgcccacgcgccagccatgcgcatgacgccaaggcttggcgcctgatcagccagttgtcgctcaattacctgtcgctgagcgaacagggccagggcgccggcgccttgcgcgaactgctgcgcctgtatggcgacagcaacgacgcggcgctgcaattgcagatcgaaggcctgcgcgaagtcagcagcaaagccgtgacccgacgcctgccgatgcccggcccgatcgtgtttggccgtggtttggaaattaccctggaattcgatgaaaacgcgtttcgtggcaccggcgtgtttctgctcggtgcggtgctggagcgcttcctggcacgttatgtgtcgattaacagctttaccgagacggtgatccgtaccaccgaacgcggcgagatcatgcgatggaaagccaagcccgggcggcgtccgaccctgtgaacacactggatgcgatgcatcaggagccctgggaatacgatttcttccaggcgttgcggcgtatcgagtgcgaatcgccggacctgccgcgcctgggccattccctgcgcctggcggatgacccgctgcgcctggggcaacaggcggattgcaccttcgcgccggcgaccttggcttcggtcgaccccggcggcgacggcaagcccgcgcgcctggaacagtttttcttcggcctcggcggccccaacggcccgttgccgctgcacatcaccgagtacgtgcgcgagcgtcagcgcaacaacgccgacagcaccagcaaacagtttttggatgtgttccaccatcggctgctcagcctgttttaccgggcctgggccgaggcgcggccgacggtcagccacgaccgcccggacgacgattactggtccgcacgcctggcggcgctgagtggccggggcatgccgagcctgctcaatcaggggttgattcccgacacggcgaagctgcattacagcggccacctgtcggcgcaaacccgctacccggacggcttgaaagccatcctcagcgagtacttcggcctgccggtggagatcgaagaatacgtcggccaatggctggagctgcccgagcgcagccgcgtaagcgtcagcgccaacaggctgggcgtggacttctgcctgggcagccatgtgtgggaccgccagcataaattccgcatccgcctcggcccgctcacgctcgatgactacatgggcatgttgcccggcagccagccgttcaacgagctggtggcgtgggtggccgagtacctgggccatgaattggactgggacctgaacctggttttgcaacaacccgaagtaccggcgctgcaactcaatggccagttccgcctgggcttcaacacctggctcggccaacctgcgcacgacgccaacgacctaatcctggcccggcactacgccgatcacgccaccacctcaaggaatccagagcatgggtgaaatcagtcgcgccgcactgttcggcaaactcaacagcgtggcctacaaggccatcgaagccgccaccgtgttctgcaaactgcggggcaacccgtacgtggaactggcccactggtttcaccagttgctgcaactgcaggactcggacctgcaccgcatcatccgccagttcaacgtcgagcccgcacgcctggcccgtgacctgaccgaagcgctggaccgcctgccgcgcggctcgacctcgatcaccgacctgtcctcccatgtggaagaagccgtggaacgcggttgggtgtatggcagcctgatgttcggcgagagccaggtgcgcaccggttatctggtgttgggcattttgaagaccccaagcctgcgccatgcattgctgggcttgtcgtccgagttcgacaaaatcaaagctgaagccctgagcgaacgctttgatgaatacgtcggtgattcgcccgagaatgccttgagtgccagcgatggtttcaacgcgggcgccgttccaggcgaagccagcggggcgatggcgccaagcgcgatgggcaagcaggaagcgctcaagcgctttacggtcgacctgaccgaacaggcgcgcagcggcaagctcgaccccatcgtgggccgtgatgaagagatccgccaactggtggatatcctgatgcgtcgacgccagaacaacccgatccttaccggtgaggccggtgtcggcaagaccgccgtggtcgaaggtttcgccctgcgcatcgtcgccggtgatgtgccgcctgcgctcaaggacgtggagctgcgcagcctcgatgtgggcctgctgcaagccggcgccagcatgaaaggcgagttcgaacagcgtctgcgccaggtcattgaagacgtgcaggcctcgcccaagccgatcatcctgtttatcgacgaggcccacacgctggtgggtgccggtggcgccgccgggacgggggatgcggccaacttgctgaagccggctttggcccgtggcaccttgcgcaccgtggccgccaccacgtgggccgagtacaaaaaacacatcgaaaaagacccggccctgacccgccgcttccaggtggtgcaagttgccgaaccgtcggaagacaaagcgctgctgatgatgcgcggcgtggcctcgaccatggaaaaacaccaccaggtgcagatccttgatgaagccctggaagcctcggtgaagctgtcgcaccgctacattccggcgcgccagctgccggataaatccgtgagtttgctggacaccgcctgcgcccgcgtcgccatcagcctgcacgcggtgccagccgaagtggacgacagccgccggcgtatcgaagcgctggaaaccgagctgcaaatcatcgcccgcgagcatgctatcggcatcgcgattggtgcccgccaaaccaacagcgaagccttgctgacggccgagcgtgagcgcctggcaaccttggaaagccgttgggccgaagaaaaaaccctcgtcgacgaactgttggctactcgcgcaacgttgcgtgaaaaagcaggcgtggtggacagcggcaacgatgaattgcgcgcacagcttgtggacctgcaacaacgcctcaccgccctgcaaggcgaaaccccgctgattctgccgaccgtggattaccaggccgtggcctcggtggtcgccgattggaccggcattccggtgggccgcatggcgcgcaacgaactggagacggtgctcaacctcgaccagcacctgaaaaaacgcatcatcggccaggaccacgccctgcagatgatcgccaagcgcatccagacttcccgcgccggcctcgataacccgagcaagccgattggtgtgttcatgctcgccggcacctcgggtgtgggcaagaccgaaaccgccctggccctggccgaagccatgtacggcggtgagcagaacgtgatcaccatcaacatgagcgagttccaggaagcccataccgtgtcgacgctcaagggcgcaccaccgggctatatcggctacggcgaaggcggcgtgctgaccgaagcggtacggcgcaaaccctacagcgtggtgctgctggacgaggtggaaaaagcccacccggacgtgcatgagatcttcttccaggtgttcgacaagggcgtgatggaagacggcgaaggccgggtgatcgacttcaagaacacgctgattctgctgactaccaacgccggcaccgagctgatttcccaggtctgcaaagacccggcgaatattcccgagccggaagaaatcgccaaggcgctgcgccagccgctgttggagattttcccaccggcattgcttggtcgcctggtgacgattccgtactacccgctcagcgacgagatgctcaaggcgatcactcgcctgcaactgaaccgtatcaaaaagcgcgtgaaaacgacgcataaagtcgccttcgactacgacgatgcggtggtcgatttaatcgtttcgcgctgcaccgaaaccgaaagcggtggccgcatgatcgacaccatcctgaccaacagcctgctgccggacatgagccgtgagttcctcacgcgcatgctcgaaggcaaggcgctggcgggtgtgcggatcagcagccgggataatgaattgcactacgacttcaacgattgacctgacgaaacgtgatcaaaactgtgggagctggcttttgtgggagctggcttgcctgcgatagcatcacctcggtgtacctgacaccccgaggtggctgcatcgcgggcaagcccggctcccacacagttcagcgcccacagctgaaccggtttgtgcagttattaagtcatttacgagacgcccgatgctattcaaccaagcctcacgcctggccaagatcaccagcccgctcgggccggatgtgctgttgctcaatgaaatgggcggtggcgaagagctgggcaggctgttcaactatgagctgcaactgacgtcgctggacgccaacatcgacctcaaccagttgctcggcaagcccatgagcgtcggcctgcaactggcggacggcggcgagcggcacttccacggtatcgtcgcgcgttgcagccagaacatcgaccagggccagttcgccagttatcaggtgaccttgcgcccgtggttctggctgctcagccgcacctccgattgccggattttccagaacctgagcatcccgcagatcatcaagcaggtgttccgcgacctggggttttccgacttcgaagacgccctgagccgcccgtaccgcgagtgggaatactgcgtgcagtaccgcgagaccagcttcgatttcgtcagccgcttgatggaacaggaaggcatttactacttcttccgccatgaacaggaccgccatgtgctggtgctggccgacgcctacggcgcccacaccacggtgccgggctatgcgtcaattccgtactaccccaaggacgagcagcagcgcgagcgcgaccatatgcacaactggcacctggcgcacgaagtacagccgggctcgctggagctcaacgactacgacttccagcgccccagcgccagcatcgatgtgcgttcagcgatgccacgcccgcacaccgctggcgactacccgctgtacgactaccccggcacctatgtgcaaagtgaagacggcgaacactacgcgcgcacgcgcatcgaagccttgcaaaccctgcatgagcaaatcgagttcagcggcaacgcccgtggcctgggctcgggccatttgttcagcctcaccggcttcagtcgccaggaccagaaccgcgaatacctgatcgtcggctgccgctattacatcacccaggaaagcctggagagcggcggcggttcgggttcggcgcagttcgaaagcagcctcacctgtatcgacgcccaacaaagcttccgcccgctggcgaacacacacaggccaatcgtcaaaggcccgcagaccgcattggtggtcggccccaaaggcgaagaaatctggaccgaccagtacggccgcgtcaaggtgcacttctactgggaccgccacgaccaatccaacgaaaacagctcgtgctggattcgtgtgtcgcaatcctgggccggtaagaattggggctcgatgcagataccacgcatcggccaggaagtgattgtgagcttccttgagggtgacccggaccggccaatcatcactggccgcgtctacaacgccgagcaaacagtgccttacgacctgccggaaaacgccacccagagcggtatgaaaagccgctcgagcaagggcggcacgccggccaacttcaatgaaatccgcatggaggacaagaaggggctggagcagttgtacatccatgccgagaggaatcaggacatcgtggtggaggtggatgaaagccactcggtggggcatgaccgcaacaagagcattgggcacaacgagacggtgacgattgggaataaccgtgtgcgcgtcgtacgcaacaacgacactgtgctggtgggcggagccaagtctgacagcgctgccacaacctataccgtcgaggcaggagacagtattcgcctggtatgcggcgacagcgtgattgagctgaaagctggcggagacatcaacctgacctgcacttcgttcaacctgttttcctcgggcagcagcaagatccagacaaaaggcaaactggatatcaacctgggcagtgacaagggcacctcacccggtaatcagggcaagcaagccacgatccacaacgccgtcgagtcaaaattccccggcaagcccggcgctggtcaataaagagattttttcagcatgaattacctgatcaacgaagcccaattcaccctgcctgatgctgaggtacaggacacttcgatcaatattcttaagttcgccaagttgggcaccacgctggtggtcagccgcagcccgctggccgacggcgagagcctgcaaagcaatttcgaaggccagttgaagaagctcgaacagcaagttaaagaccttcgctattcgccggcgcaagccgtcaaggtcggaccggcgcaggatatcgacgcttttgaggtgcagaaccggttcaacaaaggcagcgacaatatctaccagtatcagttggcaatgcagatccccggcacacgccgcctggttgccctgagttacgtcaagacccaacctctgggcccggccgaggcggcgcattgggcaacgctcaaaagcacgctcaacttcttcgccacaccctgagtcgagcctgagcaatgagtgaggatctttgggctgcccgtgaaggcgacgcactgctgcacacgtcggtgatggccgatattctcggcggtgtgctggaagtagcggcctatgcggcgattactaccgtgggctgcctggccgttgcaggggcggttttcctcgcgaccggtgcgactatcgctacaggtggcgtcgcattagttctggtcgttggggccgtcgtcgggatcaccgcgggcctcacgggggctgatctaaagatatccagttggtgcgaatccgccgccaactgggtcttcccgccggtgatcgatgcctttatcaccagcggttcagacgacgttttcatcaacgggaaaaaggctgcccgcgcggctggcaagatgaccgctgtggcggtagcccccagcgagccgccggagcccagctttctggacatggccggggagtttttttcgcagatgtggcgaccgaccgtcgcctcgcccgcccccggcaccgagccttgcctgctggatactgtcgcgtgtaacaagcatccgcccatgcctctgcagtttattgcggagggttccagctcggtattcatcaatggtcagcctgcggcgcgcagtggcgatcgcagtacgtgcgacgccaaaattggtaccgccaagggcctgatctcgccggatgtgcgcatcggtggcgagaccatcgtggtgcaggaaattcgcagcgggaaaacccccggtgtgggcctggcgattgccgtggtgatggcgttgcggggcaacgtgaaatgtttctggaccaagctgccgtgcctggtcggtggtttgttggtggggggcgccgtctcttacgcaaccagcaaggtcacctctgcgctcaagagcgccataaatagctcgcccaatcctgtgcacagtgccaccggggccaagatcctgggtggggacgaagagctggacttcatactgccgggcctgctcccgatagattggcagcgtttctacagcagtctggacacacgtcaggacagcctctttggcgccggttggagcgttgcgtatgaagtgtcgatcgagatagatgcagacgaaaacctgttctacatcgatgagcaagggcgccggctcgagatcggctacatccctttgtccggcggagcgttcgacccaggcgaaggccttgcggtcaggcgcagcagtgacggcgcggtactgattgagagcatcgacggcctgtatcggctattcgagcccgacccgctgaacagctcgcggatgcgcctgcatctgctgggtgatcgtaatgaagggcggatctttctcgactacgacactcaagggcggctgtatcgcctgcgtgacacccatgacttgatgcacgtcgagctgacctactcggccgagcacccacggcgcgtgagcctcatcgagcggcgttacctgcgccaggaacatttcgatgcgcgcagcgatgtactcgttagttatcgctacgacagcaatggcgacctggctgaagtgttggatgtgcaaggtacaaccctgcgacgctttgcttatgacaattgccggcgaatggtcgaacaccagttgccgagtggcttacggtgcttctaccagtgggaaccggtgtccggcccacagggtgaggagtggcgcgtgagtcgccactggacagacgcaggcgatgaatacagcttcgactacgatctcgacgccggcattacccgggtaaccgacggcctgatgcgcgtcagcacccggcattggaaccctcagtaccaggtcacccgctacgtcgacaacctgggccatacctggcaattcgaatggaacgaagatcgcctgctgctcggcgcgattgatccacaaaacggccagtggcgcttcaattacgatgagtccggcaacctgagcgcggtgatcgatccactgtccagaaccagcggcacacagtggttggcacattgggcattgccccaggtggaaaccgacccggcaggcaacagttggcattatcgctacgaccagcgtggcaactgtatcgaggaaatcgacccactgggcaacagcacacgctatgtctatgacgggttcggccagccggtgcgcatcatcgatgccaccgaaaaaaccaaaacgctgcattggaacgaatggagccaactggtcgaagcggtggattgctcgggttatcccacccgttatcaatacgacgctttcggcaatctggtggtgcagaccaatgcggaaggtgagtcggttcgctaccggtacggacccgaggggctattgctggagtgccagctcccggacggtcgcgtggagcagttccaacgcagtgccagcggttatctcacggcccatgtcgacccggccggtagcaccacgcgctatgcctatgacctgcgtggcctggtcaaacaacgctgggacgcgcacaaccgcacagtcatgttcgatcacgacgcgtatgggcgactacgcaaactgaccaatgagaacggcgaaagctatcgctttgagtgggatgcgtgcgaccgcatggttcagcagcaagacctcgaccagagtcggcgctgctacacctatgacccgctggatgatgtcgtcgccgtcgactacctgccgggaaccgaaggcgaaccggtagcgccgttgtcgcaccagtttcaacgagatccggttggacgtctggtcagcaaagtgacagcggacggttccaccgtttatgaacatgatctgaacgaccaactggtcggcgtcacgttcaccgcgcttgacggtcagcagcagcgactgggtttcagctacgacgcgctggggcaactgctgcaggagcaaagcacagcgggctccttgcagcatcactacgacgaattggggaacctgattcagacccagttgcccgacggtcgatggctgaaccgcctctactacggcagcggtcacctgcatcagttgaatctcgatgggaaggtcatcagcgactttgagcgtgatcgtctgcatcgcgaagtgcagcgcactcaaggtcaactcagaacgaacaccgcgtatgaccgcagtggcagggttcgctcgcgccagcgtcgcagtattgaccaaccgtggcagttgccgccgttggttgaaactgactacagctacgatcccagcgataacctgatcgggcgtcggcgtgttgaccgtgttcatgatcgtcaagagcagttcggttacgacagtaccgaacgtattctcgcaagccatcaggtgagccagagcgaaacctacgcctacgatgcagcggccaaccttttggacggcccacaacaaggcggcctggtacggcacaacaggctgctgacctatcaagacaaacgttataaatacgatgcttttggccgaatgatcgaaaaacgcagcgctgttcgtggcgtgcagcgttttgcctacgatgctgaaagccgattagttgaagtacgcaatgaaaatggcaacgtggtcaaaatggcctacgaccctctcggccgtcgcatcgagaagactgaacacgacagcgtcgggtacgcattgggcataacgcgcttcatttgggatggattgcggctcctgcaagaatacaaacacagccagactagcctctatatctatgaagacgaaagttacaaaccccttgcccgcgtagatggcagcggcccacagcaaaaagttcgccattatcacaatgacctcaacggtacgcccgagcagctaactgaaaccgatggacacaccatctggcaggcgagctatcgagtctggggtggtgccttggaggaagtgcgtgagccctcttacatcgaggatcaaaatctacggtttcaagggcagtatctggatcgggagattggcctgcactacaacacgctgcggttttatgacccggacgtgggcaggtttactactcgggatcctatcgggctcaagggaggtataaacctttataaatatgcaccgaacccgatgtcttgggtcgaccctctaggtctgagccgatgcgcccccggcactgcgtcaggcaaaggcgtaactattactaataaatggctcagaggtagccacggtaatgccggactgttcccagcttcgattgccaataaaatgagaggcaaaacgtttaatacattcaacgatttccgaaattcattttggaaagaggttgcgatggataaaaatttgtcgaagaaattcagtccttcgaatctcaaacgaatgcagaatgggaatgcacctatcgctcatggttcgcaatggaacggaaaaaacagatcatatatactccatcatcgagaaccaatacagcacggaggaggcgtatatgacatggataacttaatgatcgtaacgccgaagtttcacctggatgtgctggacagggattatcacttttgagggtttgaccatgtctcgcgacgagttaataaaacttatattaaaaattcagcgaaacgaaggcactgaagaagaggcagatgcggacatagaactattggtaaatagtgttttagatccagaagctgtcgactacattttccagcatgaatggaccgccgaattcattgccgacaaaattatttcttacgcccctatagtattatgatacacgaccattataaagccgatggccagttcggagaacatatgaaagagacagatttatttaaactgacggcaataagacaaattaaataaatccgtcccctttatttcaccgatcccaaattcatgggtggcaaacataaccaaaaactgactaggctcaccgactctgatcacaaacagcttcaccgtgacatgaatgatttcttggtcgagaaaacaaaaattatcaatgggagtcctgtacatatgcggtcccaacaaggtaacagcggagccaaaattcaagcaaacttcaccaggactgaaaggctccaagcgcttgctgacttctacaaaggaaaaggggcacaatacaaagatgctgttgtcgactttttcacacaacatccgggactaaagtagtgactaaattcgtgactatcgcctacgacttaagtgccattaataatcatgcctacttttttgaggaggcacctgaaaatatattttgcaagacctgtggttgctgtatcgatcccagctaccaaccagcagagctcaaaacaccgaacaaagccgatattggcgcaacttatgatcgccgcttcatcgcatcgctgcgtttcaaggaatacattgacagtttaaaactgaacgttgatttttcattggtcaatgaaaaaaaacaactctttctcatccgacctaaacacgttgtcgcctacagtgctcaacagcaggaaaacctctgcggtacctgtcatcagtactttgattgtgtggctcctctcccgcttttctatcaggaaactggcaaaccccttgagcacgggatgtttttcacaagtgttgacttcggtagcggcaaggaaaagagtccttccattattctgggcattgaaacggcacttgagattaaaagcgcgataaagtcattgaaattgagaggagcagacatcagtaaaattatttctcctcaaaattagttggtataaaagggacagatttatttagattaacggacagaaaaaatcaataaaaccgccccctttatcgttcagggcattggtaaggcacgccttgaaggagcagacatgagtgagttgactgattttcacgttttctggggcgcggcgatggctgtcgctgaaaagaaagccgcctcgatggaggctgacggcgcggaggatttcgcccggctgctttacgatgaatatgttgagcaaggtgcgccgaagaataaaaagaaatggctcggggaacgactggaaaaggagttcctgtgcttaaaggagagcccggtatgggtgggtgagccggcttggttgtaccatcagggtcagcctatggtgtttttacaccagttttcagtttcaccttcagcacagcacatcaaagaaaaaatctctcttggtgacaccgtttacgtgtttggcgcaaaacatcacctcaaaaggccggcaggggatacgtggactgatatatatcgcacggtcgttcaaacctttgaaggtgaaaccacagtggaagtactggcctagaccgtataaaaaagcgaggtcaggtatctcaggtccggcttcgcagccagacacctgaagccgatagcgttctgacaggcaatcaactctggaacaaaaaatgggcacccgacccagtcggcgtgcccatttttcatcccgcgctcacactcgcatgtgcgtagcgcgttctacatgacttacggattgacgctgtctttaagcgacttgcctggcttgaacgcaacggtgttgctcgccttgattttcactggctcaccggtttgcgggtttttgccggtgcgggcgccacggtggcgctgcaggaaggtgccgaagccaaccagggtgacgctgtccttgcggtgcagggcgccggtgatttcttcgagaacggcgttgagtacgcggttggcctgttctttggtgagatctgctttttcagcaatagcggctgcgagttctggtttacgcataagtgaagcctctttgacggttttttgttgttatgtccgtgctgctctcttgtggagcagcgcccaaggcgccgcaggctctactctgcggcagacgggagtgaggatggcatgccctcgcacgctccgccagtctcgcggcgacctttctggcggtaagaacgtgctgattccgacagaacgaccagtatttacgccagtaacggcgggagttccttgttcagggccagtttttccatcacggcgctgccggtcagcgcataacccagcaagcgaccgctggcgtcgcggcacaaggccttgatatcggcgccctgcccttcgacgctccatacgccttcggtgccgcgtggcggtggcgagaccaccagcggacagatcggggttttcacggtgatcggcatcggcccgtagctgaccgccgtggcgttgcccgccagggtctgggccagggcgcgggcacaactcatcaatggcatgacgtacagcaggttcaggccgtcgacctcggcgcaatcgcccagggcgtagatgttggcgtgggaggtcttgaggtggcggtccaccataatccctcggttgatctgcaggcctgcggcggcggcgaggtccacgcgcgggcgcaggccgatggccgagaccaccaggtcgcagtggatcacttcaccgtccgacaggtgcgcttccaggccgtcagccgtgcgctgcaggcggttgagcaccgggccgaggtggaagcgcgcgccgaggccttccagaccggcttgcaccgctgcggcggctgccgggtgcagcagggtcggcatgacttgctcgcacggcgccaccaggtcgatttcatagccgccaaggatcaggtcgttggcgaactcacaaccgatcaggccggcgccgagcaacagcacgcggcgcttgccggccgcagcggcacgaaagcgtgcgtaatcttcaaggtcgttgatcgggaaaatcagttcagccgcgtcgccttcgaccggaacacgcacagtctctgcgccccaggccaggatcaggtcgcgataagccaccgcttcttcgccgatccacaggcgcttatggcccgggtcgatgccgctgatgcgcgtgtgggtgcgcacttcggccttgagttgctcggccatggcgcccggttcggccatgctcaggccgtcagcgtccttgttcttgccaaagccggtggagagcatgggcttggagtaggagcgcccgtcatctgcggtgatcagcagcaatggggtctcgctgtcgagcttgcgaaactcccgggccacgttgtaaccggccaatcctgtgccgatgatcacgacaggtgcgttcattcctttctccttgtagtacgtttcttaaacttcgaattagccgatttcgatcatttcgaaatccattttgcccacgccgcagtccgggcacagccagtcttccggaacgtcctgccacagagtgcccggcgcgataccgtcatccggccagccgtctttttcgtcatagatcaggccgcagactacacattgccacttcttcattacttgcttcctcagggtccaggcatcttggccgacggtcgatagatcaacattgccgtgcggctcagggcgttttgtactgatcggggccggcagatgcaagcgtgatcgacgcatggggccggttcagcccggcaaaagtccggggcgccatggtaagctcgccgcctcttttgctgccgatactgactcaccgtgccgcactcaatcgactttcccgatgcttgccaatggctgacccagagccttctgagccccctgcccgcgcctttgaccctcaattggctgttcgacgaaggctcgctgacgcgccggctcacgtggctgtccaacgacggcttcagcgtgacgccgttgtacgaaggctggcaaccattgcgtgacgatgaatgcgccgcgctgggtctggacccggcaactgtcggttgggtgcgcgaagtgtatttgcgtgggcacggccagccgtgggtatttgcgcgcagcgtggcggcgcgcagtgccttgcagggcgacggcttgcacatggatgagctgggcagccgatcattgggcgagctgctgttctgcgaccgcgccttcacccgccaggccatcgaggtatgccactacccacggcaatggctgccgtctgcggaccaggccgacggtttgtgggggcgccgctcgcgctttgatcgcgggtcactgagcgtgctggtggcggaaatcttcctgccgagcctgtggcaagcggtgcatgaacacccggagaactgctgatgtatcaacgtctgctcaaatccctgaaccacctgaaccccagggcctgggatttcattcagctgacccgcatggacaagcccatcggcatctacctgctgttgtggccgacgctgtgggcgttgtggatcgctggcaaaggctcgccttcttttatcaacatcgtgattttcgtgctgggcgtggtgctgacccgcgccggcggctgcgtgatcaatgactgggccgatcgcaaagtcgatggccatgtgaagcgcaccgagcaacgcccgctggtgagcggcaagatcagctcgaaagaggcgctggtgttttttgcggtgctgatgggcatcagcttcctgctggtgctgctgaccaacgccaccaccatcctgctgtcgctcggcggtctggcgctggcggcgagctacccgttcatgaagcgctacacctattacccgcaggtggtgctgggcgcggcgttttcctggggcatgcccatggcgttcaccgccgagaccggccacctgcccgccacggcgtggctgctgtacatcgccaacttgctctggacggtgggctacgacacgtattacgccatgaccgaccgcgacgatgacttgaagatcggcgtgaaatccacggctattttgtttggcgatgcggaccgcgtgatcattctgaccctgcaaggtttgtcgctggtatgcctcctattggcggggcagcggtttgagctgggtggctggttccatctggggttgctggcggcagcgggctgttttgcctgggagttctggtacacccgggacaaggatcggatgaaatgcttcaaggcgtttttgcacaaccactgggcggggttggcgatttttgtcgggattgtggcggattatgcttttcggtaattcagtgctgacgccatcgcgggcaagcccgctcccacacttgactgtgtttacaaatcaaaatgtgggagcgggcttgcccgcgatggtttcagccgcaccgtgtggtcagggcttgattacatgccacgccccacccttaccatcaccggtcttgtcaccagccttgtggtcatccttgtaggtgtagaccggcttgcctttgtaagcccactgactggtctggtcgtcgcgggtaatgactgtccaatcacccatcgacttgtcagtagattcagccttcagcgggggccagttggtggcgcactggtctatgcacaccgacttgccgtcggaatccttgtcgaaggtgtaaagggtcagccctttgtggtccaccagcatcccgtctttggtcatcgccggttccgccgcaaacgccaggcccggcagcgtcaacgcggccgttaccagcagggctttccaggaaacattgcagttagtcatcggaaccttccttttgtggttgtcaggattcggacccaaagggtagttcagagtgccgttaattgcccaagcgactaaattactgtcacacgactgcaataattccgttatctaatgcggcgcaagacagttaaatgacaagaggattttgagcatggttggcaggagcattctgatcgttgacgacgaagcgcccattcgcgagatgatcgccgttgcgttggaaatggccggctatgactgcctggaggcggagaactcccagcaggcccatgccattatcgtcgaccgcaagccggacctgatcctgctggactggatgctgcccggcacctccggcatcgaactggcccgccgtctcaagcgtgatgagctgaccggggatatcccgatcatcatgctcaccgccaagggcgaagaggacaacaagatccagggcctggaagtcggcgctgatgactacatcaccaagccattttccccacgtgagctggtcgctcgtctgaaagccgtactgcgccgcgccgggccgactgatggcgaagccccgatcgaagtcgacggcctgattctggacccgatcagccaccgcgtgaccatcgacggcaagccggccgagatgggcccgactgaataccgcctgctgcaatttttcatgactcaccaggaacgcgcctacacccgcggccagttgctcgaccaagtgtggggcggcaacgtgtacgtggaagagcgcaccgtggatgtgcacatccgccgcctgcgcaaagccttgggcgatgcctacgagaatctggtacaaaccgtgcgcggcaccggctaccgcttttccaccaaaggctgagccagcccttccctttccttaacagctgacaaggacgcatgtttaagtgaaccagaactggcatggcaccctgatccgccacatgctgctgttgatcaccggctgcctggtggtgggtttggtcagcggccaatacggctggagcctggccgttggtatcggcctgtatttgggctggaccctcaaacagctgctgcgcctgcatgaatggctgcgccagcacaaacccgatgaagcgccacccgacggctacggcctgtggggcgaggtgttcgacagcatctaccacctgcaacgccgcgaccaacgcgtacgcgggcgcttgcaagcggtgatcgaccgcgtacaggaatccaccgccgcgctcaaagacgcggtgatcatgctcgacagcgatggcaacctggaatggtggaaccgcgccgccgagaccctgctgggcctcaaaacgccccaggacagcggccagccagtcaccaacctggtgcgccacccgcgcttcaaggagtacttcgaacaggagaactacgaagaagcgctggaaatcccctcgcccaccaacgaccgcgtgcgcattcagctgtacctgacgcgctacggcaacaacgagcacctgatgctggtgcgcgacgtgacccgcatccaccagctggaacagatgcgcaaagacttcgtcgccaacgtctcccacgagctgcgcacaccgttgacggtgatctgcggctacctggagacgctgctggacaatgtcgacgagatcaacccgcgttggagccgtgccctgcagcagatgcagcagcaaggttcgcgcatgcagaccctgctcaacgacctgctgttgctggccaaacttgaagccaccgattacccgtcggataaccatccggtggcggtgcagagcctgttgcagaccatcaagaacgacgcccaggcgctgtccggcgagcgcgggcaacagatcaccctggaagccgacccgctggtgctgctcaaaggcagcgaaggcgagttgcgcagcgcgttttccaacctggtgttcaacgcggtgaagtacacccaggacaagggcaatatccgcatccgctggtgggccgacgaacacggggcgcacctgagcgtgcaggactccggcatcggcatcgacgccaagcatctgccgcgcctgaccgagcgcttctaccgcgtcgactccagccgcaactccaacaccggcggcaccgggctgggcctggccatcgtcaagcatgtgctgttgcgccatcgcgcacggctggaaatcagcagcgtgctggggcatggcagcacgtttacctgccactttccgccagcgcaggtgacccgctcgcgggtgatcggcaatgatgaataaccctaaaacaacacaaacttaaatgtgggagctggcttgcctgcgatagcggtgggtcagctgaaaacaggtcaaccgaccgtccgctatcgcaggcaagccagctcccacattggatttgcatcgtctccaggaatgcattccaggccccacccggcagcgggcactaggcaagcgccccgtcagccgctacattggccgacttgcgcctgcctttcaggcccttctgtcaccccttattgaacacacggaacctgcaaaaccccatcatggacccttcccctggtatcaccctcgctacgctcttcgccgacttcggcatgattctttttgcactgatcctggtactgctcaacggtttcttcgttgcggcggaatttgccatggtcaaactgcgcgccacccgggttgaggccatcgcccacaagaacggctggcgtgggcagatcctgcgcaccgtgcacagccagctcgacgcctacctgtcggcctgtcagctgggtatcaccctcgcctccctgggcctgggttgggtcggtgagccggcgtttgcgcacatcctcgagccgttgctgggcgccgtgggcgtgcaatcgccggaagtgatcaagggcgtgtcgttctttgccgccttcttcgtgatttcctacctgcacatcgtggtcggtgaattggcgcctaaatcctgggccatccgcaaacccgagctgctgtcgctgtggacggcggtgccgctgtacctgttctactgggcgatgtacccggcgatctacctgctcaacgccagcgccaacgccatcttgcgtatcgccggccaaggcgagcctggcccgcaccatgagcaccattacagccgcgaagagctcaagctgatcctgcactccagccgtggccaggacccgagcgaccaaggcatgcgcgtactcgcctccgccgtggaaatgggcgagctggaagtggtcgactgggccaactcccgcgaagacctggtgaccctggacttcaacgccccgctcaaagaaatcctcgcgctgttccgccgccacaaattcagccgctacccggtgtatgacgcggtgcgtaacgagtttgtcggcctgctgcacatcaaggacctgctgctggaactggcggcgctggaccacatccccgaatcgttcaacctggccgagctgactcgcccgctggagcgcgtgtcgcggcacatgccgctgtcgcaactgctggagcagttccgcaaaggcggcgcgcacttcgccctggtggaagaagccgacggcaagatcatcggctacctgaccatggaagacgtgctggaagtgctggtcggcgatatccaggacgaacaccgcaaggccgaacgcggcatcctcgcctaccagccgggcaaactgctggtgcgtggcgacacgccgctgttcaaggtggagcgcctgctgggcgtcgacctggaccacatcgaagccgaaaccctggccgggctgatctacgacaccctcaaacgcgtgccggaagaggaagaagtgctggaagttgaaggcttgcgcatcatcatcaagaagatgaaagggccgaagatcgtgttggccaaggtgttgttgctggattgatcagaaaacgcgcgggagcgagcaacttgctcccgcgctgtcgattacgccggcagcggccagaagcagatatcgacctccaaatgcgctgcggcagacaagttgaccagtgcgtccagtgagaacttgtcgatcttgccattgagcatgtcattgagccgaggttgactgatactgagccgttcagcggccgctttttgcgacaactcccaactgcggatggtgttgcacagttccagcagcaactttgagcgcaggcgcatattggcagcttgctggggagtgtcctccaacgcatcccagacgcagctgtaacgttcggtgtgaattttggggtccgtcataggcttaacctaactcctgcaatctggcacgcgccagttcgatatcccgcccttcggttttctgtgtggtcttgtgcagcgcgtgcagcacatagacggcttccggccgattgaccacgtagaacactcgaaacgcgcctgatgcctcagcgatccgaatctcactgacgccccgcccaatggttttcatcggcttgcaatcaaaaggctgttcgccctgttgcaagagatccaactgaaaacctgccgccctgcgggtatcgagaggaaacgctttgagatccttgagcgagctccctaaaaacaccacatccttgtgccttggcattggcctctcctttcttggaaagaagaagcgtaattgacgattcagccagaggcggtggtgctttgtttcaaggcatagcaaaggctcgataacactgaagcgttatcgagagcctatatcgaaacagatataaatcaagccagctaacgggaatcagacggtcggttgattcccgcaattgaggcgatcacgcacccggcacaaagtgcttctgcgccgtgccgcgtgcgatcaggcgggagatgtagtcgagcttctgcgcgtcctggtcgatgaaccggaaggtcaattgcagccagtcgctgtcgggcttgggctcgtaggcgacgatggcgtgcaggtagccgttgaggcgcgcgacttcggcgttgtcgccttgctcaaggtccagcaccgcgctttccagcacttggggcaggacttcaccgcgacgcactaccagcagcgcctccttgatgctcagcgccttgatcacgcactgctgggtgccgctggacaggcgcagttggccctggccacgaccacccgccggcgaggcggccggtgctgcctgcacgggcgggctgttgagcaggcctttgcttggcgcggccgccactggtgccggtttgacggcttcaggcttgccgccggtcagggcgctcagggaatcgttgccgaacgccgagttcatcttggtcggtgcgctggcgatcagggcgtcgaggcggccaatcttgtgcagggcctgcttgaccttgttcagcaactgctcgttggtgaatggcttgctgacgtagccggaaaccccggcctggatcgcctggaccacgttttccttgtcgccgcggctggtcaccatcacgaacggcatggccttcagatgcggctgttcacggcaccaggtcagcagctccaggcctgacatttcgggcatttcccagtcacacagcaccaggtcgaaggtctcgcgcatcaggatggattgcgcctttttgccgttcaccgcatcttcaatcttgatcccggggaagtagttacgcaggcacttcttcaccaggtcgcggataaacgaggcgtcatccaccaccaacacactgactttactcatcgacccttcatcctataaaaacttcggcacgcaaaacgcctgactgatggcattttgccaaaactcgctggtcacagaaggactttattgctcctgctgcgcaaaaaattcagatgccgcaaacgaaaacgcccgaccaatggccgggcgttaatttctcgggcaacttacttatcgtcaggtacgcccggaacattagggatttgatcggctgtgccttcaacttcggctttcatgcgcttgaggcccatgtgccgtacgtcggtgccgcgcaccaggtagatgaccagctcggagatattgcgcgcgtggtcgccgatacgctccagcgaacgcagcacccagataatgttcaagacccgcgagatagagcgtgggtcttccatcatgtaggtggccagctcgcgcagcgcggttttgtattcgcggtcgatggtcttgtcgtactgcgccaccgacagcgccaactcagcgtcgaagcgggcaaaggcgtccagcgcatcgcgcaccatgttgcgcacctggtcgccgatgtggcgcacttccacataaccacgcggcgcttcgccttcttcgcacagctggatggcgcggcgggcgatcttggtggcttcgtcgccaatgcgctccaggtcgatcaccgacttggaaatgctgatgatcaaacgcaggtcggaggccgccggctggcgacgcgccagaatgcgcaggcattcttcgtcgatgttgcgttccatctggttgatctggtcgtcgatttcacgcacttgctgggccaggcccgagtcggcctcgatcagcgcggtgacggcgtcgttgacttgcttctccaccagcccgcccatcgccaggaggtggctgcgcacttcctcaagctcggcgttgaactgcgcggagatgtgatgggtaaggccttctttgctaatcatgttggcgtccttggaacgtccggtaaggtgcggagaaccgcagcattcagtgcaatcagaaccaccgcgttctagccgtaacgaccggtgatgtagtcttcggtctgcttcttcgccggattggtgaacagggtatcggtgtcgccgaattccaccagtttgcccatgtacatgaacgcggtgtagtcggaaacccgcgccgcctgttgcatgttgtgggtcacgatgacgatggtgaacttggacttgagctcgtagatcagctcttcgactttcagcgtcgagatcgggtcgagagccgagcacggttcgtcgagcagcagcacttccggctccacggcgatggtacgagcaatcaccagacgttgctgctggccgccggacaggccgagtgccgagtcatgcaggcggtctttgacctcatcccacagtgccgcgcctttgagggcccactcaacggcttcgtcgaggatgcgttttttgttgatgccctggatgcgcaggccgtagaccacgttttcgtagatggtcttggggaacgggttgggcttctggaacaccatgcccacacggcgacgcagctcggctacgtcttcgcccttgcggtagatattggtgccgtagaggttgatcgcaccttctacgcggcagccgtcaaccaggtcgttcatgcggttgaaggtacgcagcaatgtggacttaccgcagccggacgggccgatgaaggcggtcacgcgctgtttcgggatgttcatgctgacgtcgaacagcgcctgcttttcaccgtagtacaggctaaggcccggcacttcgatggccacggtttcctgggccaggctcaggctctgcttgtcgcgccccagggccgacatgttgatgccgtgggtgtgggtttcgtgctgcatgggatgctccctgtgctaccaattcgtttcattgaaccgcagttttagcggtttacttgatctcaatatcctgcgcggtctcctgtgggagctggcttgcctgcgatggcatcaatgcggttttcctgaaacaccgcgtcgtctgcatcgcaggcaagccagctcccacaggggtccacttagctgtccagcgccttgtatttctcgcgcaggtggttacgaatccataccgccgacaagttcagcgtggcgatcaccagcaccagcagcaaggcagtggcgtacaccaatggccgtgcagcttcgacgttggggctctggaagccgacgtcataaatatggaagcccaagtgcatgatcttctggtccaggtgcaagtacgggtagttgccatccagcggcaacgacggcgccagcttcaccacacctaccagcatcagcggcgccacttcaccggcagcgcgggccacagcgaggatcatgccggtcatcatcgccgggctggccatcggcagcacgatcttccacagcgtttccgccttggtcgcgccgagtgccagggaaccttcgcgcacagtgcgaggaatccgcgccaggccttcttcggtcgccacaatcaccaccggcaccgccagcagcgccagggtcagcgaggcccacagcaggcccggcgtaccgaacgtcggtgccggcagggcttcggcgaagaacaggcggtcaaccgagccacccagtacgtacacgaagaagcccaggccgaacacgccgtagacgatggccggtacgcccgccaggttgttcaccgcgatgcgaatgatgcgcgtcagggcgttctgcttggcgtattcacgcaggtacaccgccgccagcacaccgaacggcgtcacgatcatcgccatgatcagggtcatcatcacggtgccgaagatcgccgggaaaatcccgccttcggtgttggcttcacgcgggtcgtcgctgaggaattcccagaccttgctgaagtagaagccgatcttggtcatcgtgcccatggcgttcggctggtaggcgtgcaccactttgccgataccgatttcgacttctttgccgttggcatcgcgggcggtcagggcgtcacggttgaactgggcgtgcaagtcggccaggcgcgcttcgatgtcctggtaacgggcattcagttcagcgcggccactgtccatatcagcttgagcagtggcgtcgagcttgccttccaactccaacttgcgaccgtgcaggcggatacgctcaaggccggcgttgatcgcgccgatgtcggttttttccaggctcttgagctgggcagccagcttgttcacgcggtcgacgcgggcttgcagctccggccacgcggcttcgccttcggcgatgaccttgccgtcctgtttgacgttgaccagggtgccgtagaaattgccccactcacgccgttcgatggccatcaggtttgcaggcttggtctggtccttgagccactcgccgacgatccaggtgaagtcgttgccgttcaggtcgcggttgccgaccttgatcagctcgcgggtcatgaattccgggccctggtcgggcaccggcaagccggcgcttttcaggcgctcgcgcggtacttcttccttctgcaccacttcgccgatgacgatatggttttcctggcccggcacgttgtagttggcctggatcaggtcggccggccagaagtggcccagaccacgcacggcaatcacggccagcaaaccaatggtcatgatgaccgcgatggacaccgcgccaccgctgatccagacgccgggggcgccgctcttgaaccatccattcagggagttctgtttcacagacttctacctttcttaaagcgacgagtatttcttgcgcagacgctgacgaatcagctcggcgagggtgttcatgatgaaggtgaacagcagcagcaccagcgccgagaggaacagcacgcggtagtggctgccgccgacttccgactcgggcatttccactgcgacgttggctgccagggtgcgcaggccttcgaacaggttcatctccatcaccggggtgttaccggtggccatcaacacgatcatggtttcaccgaccgcacggcccatgccgatcatcagcgccgagaaaatccccgggctggcggtcaggatcaccacgcgggtcatggtctgccacggcgtggcgcccagggccagggagcccagggtcaggccgcgcggcacgctgaacacggcgtcttcggcgatggagtagatgttcgggatcaccgcgaaacccatggccaggccgactaccagagcgttgcgctggtcgtaggtgatgcccaggtcgtgggagatccacatgcgcatgtcgccgccgaagaaccaggtttccaggtacgggctcatgtacagcgagagccagcccacaaacaggatcaccgggatcaggatcgcgctttcccagccatcgggaacgcgtaggcgcagcgactcaggcaggcggctgaagacaaaaccggccaccaggatgccaatcggcagcagcatcagcaggctgaaaatccctggcaaatgcccttctacatacggcgccaggaacaggccggcgaagaaaccgaggatcaccgtcggcatcgcttccatcaactcgatcaccggcttgaccttgcggcgcaggctcggggccatgaagtaagcggtgtagatcgcggcggcaaccgccagcggtgcggccagcagcatggcgtagaacgcagccttcaatgtaccgaaggtcagcggcgccaggctcatcttgggttcgaagtcggtgttggcggcggtcgattgccagacgtatttaggctcgtcgtagttttcgtaccagaccttgctccacagcgcgctccacgaaacttccgggtgcgggttgtcgagcaacagcggttgcagcttgccaccggcttcgacgatcacacggttggcgcgtggcgacataccgaaaatgccagtgccatcaaccaccgggtccaccagcagcgtgcggtgcgcagtgctgtggaacacgccgaatttgccggaagcgtcgagcgcggtgaagcctttgcgacgctcttcagcagtgatttccacgatcggcgtggtgcccatctggaaggtgcggatctgtttcagacgctgctcgccgtccgggtcacgggccatgaaccattgggccaggccgcccttggagttgccgacgatcaacgagataccgcccaccagttgggtgctggcggtgatttcggcgttgccgtcttcgagcagtttgtagcgaccgttgaggctgttgtcgcgcaggctgaacacatcggcttgggcgcgaccgttgatcacgtacagccactgctggcgcggatcaacgaagatcgcttttaccggttcggtcatttgcggcagttcgatacgcttctgctcggtggtgacttcctcggtcatcatgttttcttcacggctgatcgacagcacgttcaggtgcgcgccactggagccggccaacaccagcgaggagtcggtggcgttgagcgctacatgctccagcgggcgcccggcgtcatcgagcacgatgggcgtttcgccgtacgggtattcaaccgcaggggtaatggttttcttgccgtccgggtaggacaccttataggtgtggcggaacaccagggactggccattcgacagaccgagcaccaccagcgggctgcccggttggtcttcaccgatggaggcaacgctggcaccggccggcagcggcaagtcgacacgcttgagctcggcaccggtgtccacattgaagaacagcgcctggcccttgtcggaaacccgcatggcgacctggttctgttcttcgagggagatcatcaacggcttgccggcgtcctggatccaggcgggcgtcagcgcgtcttccttggtcagcgaggcaccttggaacaacggcgcgacgacataggccaggaagaagaaaatcagggtaatggcgccgagtacggcgaggccgccgaccagcacgtaccaacgggtcaggcgatccttgagcgcgcgaatgcggcgcttgcgttgcagctcaggcgtattgaaatcaatgcgcttggggggagaagtcgtcgtcatggtggaattggccagatcattcatgcgcacaccctagcgatcctgtatgacagaaagatgacaatgcagtgacgcaagaaatccgccgcgtagcagggctggcagcggattaaaaaattaggggtgcagacagttaatgtgggagctggcttgcctgcgatggcatcagcacggtttcaactctaaaccgtgtcgccagcatcgcgggcaagcccgctcccacaaaaaacaacgtctgcaccgggtatcgcaggcttagttgccttctttcagacccaggtcagccagggccttggcggcgactttggctggcagtgggatgtagccgtctttgacgaccacttcctggccctgtttggacagaaccagcttcacgaactcagcttccagcggagccagaggcttgttcggggccttgttgacgtacacgtagaggaagcgcgacagcgggtatttgccgttcagggcgttttcttcgctgtcttcgatgaagtcagtgctgcctttcttggccagggccacggtcttcacgctggcggttttgtagccgatgcccgagtaaccgatgccgttcagcgaagagctgatcgactgcacgaccgaagccgagccaggttgttcgttcacgtttggtttgtagtcgcctttgcacagggcttcttctttgaagtagccgtaggtgccggataccgagttacgaccgaacagttgcaccggcttgttggccaggtcaccggtcacacccaggtcgccccaggttttaacgtcagctttagcaccgcacaggcgagtcgaggagaagatcgcgtcgacttgttccatggtcaggtgctggatcgggttgtccttgtgcacgaacaccgccagggcatccacggcaaccgggattgcggttggcttgtagccgtacttctgctcgaaggccgccagttcggtgtccttcattttgcggctcatcgggcccaggttggaggtgccttcagtcagcgcaggcggtgcagtggcggagccggcagcctgaatctggatgttgacgttcgggtattcctttttataggactcagcccacagggtcatcaggttagccagggtgtcggaaccaacgctggacaggttgcccgatacaccggtggtcttggcgtaagccggaattgccgggtcaacaccagcggctaccgcgttagcggtggcaacgccagcagcgacaaaagtcattgccgccatcaaacgtttcagtttcatgccttgctcctagcagatagggatagttggatcggggccaagtatcggtaggccgtgtgaacactctatgtctggaatatgacaattagatgaaaggccagtatttgtgaaaaacctgacaggaaggggaaagatcaataaatacggggcttgcgaggaggttgaggcgcttgaagcggtgtttcagaaatactctgtaatctatgaccattcctacatcgctgtgtaggactgaacgcagggacgcggagcgtccccggcggcgttcccacgcaaagcgtgggaacgatcacttagcgaccgcgcttccacagatacccacccaccaacgtccccattacgcacagcacggcgacgtagtaagcaggacccatcgggctttccttcatcagcagcgacaccgccagcggcgtcaaaccaccaaacacggcataggcgacgttatacgagaacgacaacccgctgaaacgcaccaccggcgggaaagccttcaccatcacgtacggcaccacaccgatcacacccacaaacagaccagtgagggtgtacagcggaaagagccagttggggtgatcaagcaggctgtgatacagcgtccacgacgtcgccagcagcaacaggcagccgatgaccaacacgcggcctgcgccaaaacgatcggccaaggcgccggaggcgatgcagcccaggctcagcgtgacaatcgccaagctgttggcctgcagcgctacggtcgggctgaagtggtagacggtttgcagcacggtcggggtcatcaggatgaccaccacgacaccggccgacagcagccaggtcagcagcatcgacagcacgatggcgccacggtggtcgcgcaataccgcgcgcaatggcagctcggcggccaaggttttgcgctgctgcatttcggcgaagatcggcgtttcatgcagccagcggcgcaggtacaccgagagcaagccgaacacgccgcccagcaggaacgggattcgccaggcgtaatccgacacctgctccgggctgtaaagggtgttgatggcggtggccaccagcgagccgagcaggatgccggcggtgaggccgctggtcagggtgccgcaggcatagccgatgtggcgtggcggcacgtgttcggagacaaacacccaggcgcccggtacttcgccgccaatcgccgcgccctgaatcacgcgcatcaacagcagcaggagcggcgcccacaggccgatctgcgcgtatgtcggcagcaagcccatgatcaaggtcggcacggccatcatgaagatgctcaaggtgaacatcttcttgcggcccagcaggtcaccgaagtgcgccatgatgatgccgcccaacgggcgtgccaggtagccggcggcgaagatgccgaaggtctgcatcatgcgcagccattccggcatgtcgacggggaagaacagtttcccgaccacggtggcgaaaaacacgaagatgatgaaatcgtagaactccagcgccccgcccaaggcagacagcgacagggttttgtagtcgttgcgggtcagcgggcgcgacggttgcgcactgcttgcgggcacggaggacatggcaaggcttctcttatagtaatgacggcaagcccgggacttgcggcgggtctggcaagatagcaaatcgcttgaaaaagcacagcgtccaccgaataacactttgcaggcgcgcgttattccccgtttcttccctttattagccatcagaagcacagttgcaggaaaaagccgcattacagccgtgatttgccgaccaaatgagcgccgggaggtcgtcgcggcgccagcgtctcgatatactcggcccgtgcaagcgccaaacccgctgtcttgaggggctgctgtgccaaaccgtcgttgggtgccatccagccgatttggcagagtttccctttagttcgccttacgagaaacgcatcgagcggtgtatgttggtgctgaaacgtttttccagaagacggctatccacttgaaatacccatgaagcgtcacgggtcagaggcaccctcggcatgatcgaactcgaacaagaagatcctatcccgcaaggcgatctcgccctgcaaattaccgcactcccgcgcgaaaccaacggttttggcgatattttcggcggctggctggtcgcgcagatggacctggccggcacggccatggcgagcaaagtcgcgggtgggcgtgtcgccaccgtggccatcgatcgcatggcgttcctggtgccggtcgcggtcggcgcacagctgtccttctatacccaggccctggaaatcggccgcagctcgattcagatgatggtcgaagtgtggagcgacgacccgctgtccagcgaatggcgcaaggtgaccgaggcggtctttgtgttcgtggccatcgatggcagcggccgtacgcgctcggttccatcgcgcgcgcgttaaacatcgccgggttttgacggtcaattgccccattgcctgccatttgagagcactgctatgcctacgccccacgttgaaagcatgaaaatcgacgagctggactgctggcgcttccgccacaacggcgcgcaaatgctggtggcccaacagggcgcgcacattttcagttaccagcgccagggcgagcagccggtgatctggcagaaccctgaggccttattcaagcagggcaaaggcattcggaccggcgtgccggtgtgctggccgtggtttggcgtgttcgaccgcaacccgcaaagcgtcaaggccatgcgccagagcgatcagcctgccggtgcccatggttttgtgcgcaccgcactgtgggaactggccgggaccgaacttgaaggcgatgcattgcgcgtcgacctggtactgccggtgccggcgggcggttttcccggctggccgcatcaggtcgacctgaagctgagcctgctgctggacgatcaactgcatatccgcctgaccagccataaccgtggcgaccataccgtgaccctgagccaggcgctgcacacttatttcgccgtgagcgatgtgcgcaacgtgcaggtcgaaggcctggatgggctgacgtatgtcgacacggccgatggctggaacaacaagcagcaagccgggctgctgcattttactgccgagaccgaccgtatttacctggatacgccgtcgcagctgagcattgtcgacaaagactggcagcgccgcctccagctcaccagccaaggctcgaactccacggtgatctggaacccgtggaccgaacgcgccaaggcgctcgacgacatggccgatgatggctggcagggaatgctgtgtatcgagacggcgaatgtgctggatgatgtggtggcactggcgcccggtgaaagccacaccttgggcgtaagcatcaccagtctcgccttgtaaacgacggtcaaactgtgggagctggcttgcctgcgatagcatcaccgcagtgtgtcagtaataccgaggcgcctgcatcgcaggcaagccagctcccacacaagccagctcccatattgctggggtagtggcttagagatcggattcttttacgacccgcactttccccgcatccagcgcgtacgccgcatccgccaaatcgttattaaccttctcgactttcaacgtgcccgtgacccacagcggcgtgtagatatcgtccagcttcagccccttgggataacgcaccagcaccaactggttcggcggcggtggcggcacgtggatgcaggcgcctgggtacggcaccaggaagaacagcgtactgcggcccttggcgtcggtttccagcggcaccgggtagccgccgatgcggatgttcttgccgttcatggcggccacggtcttggtcgaatacatcaccgccggcaagcctttgctttgcttcaggccacctttatcggtgaacgtgccttgggcttcgggggagttgtggtcgatctcgggcatggcttcgagggctttctggtccgacagcggcatcaggtcgagccagtcggtttccggcagttcgccggcgtgcgccaggccagagcccagcaagaggagagtcaacagaagacggcgcatggtgaggctcggcaagtacaggtggcgagcattctagccctctgcgcctgcgcagcgcagagggctttgtcgcttaattactttttacgcagcaggccgtagatcaccaacagcacgatggcgccgatcagcgcaccgatgaagcctgcgccctgacctgcctggtagatgcccagggcctgaccaccgtaggtggcgaccagggaacctgcgatacccagcaggatggtcatgatccagcccatgctgtcgtcgccaggcttgaggaaacgcgccagcaggccgacgatcaagccgataaaaatggttccgatgatacccatggcatttccctctgattgaatgtgagtcatgacaaagcctagtcaggctttgtcatcctgcaatcagagagacggcggcaacagatggttcccgccgacccttgggttattgctcggcgatcagcgcttcgaccttgaggatctgcgcttgcagcgtcgcacggtctttgcagcgcaggttggcgtgacccaccttgcgcccggccttgaaggccttgccgtagtgatgcaggtggcaatcatcaatcgcgatcacacgctcaaccggcggcaccacaccgatgaagttaagcatggcgctctcgccgaccttggccgtggagcccaacggcaagcccgccaccgcccgcaggtggttttcgaactggctgcactcggcgccttcggtggtccagtgcccggagttgtgcacacgcggcgcgatttcgttggccttgaggccaccgtcaacttcaaagaactcgaacgccatcacgccgacgtaatccagttgcttgagcacgcggctggaatagtcttcggccagggcctgcagcgggtggtcggtgctggccacggacagcttgaggatgccgctgtcgtgggtgttgtgcaccaacgggtagaagcgggtttcgccatcgcgggcacgcacggcgatcaacgacacttcaccggtgaacggcacgaagccttccagcagacaggcgacgctgcccagctcggcgaaggtgccgactacgtcagccgcggtgcgcaggactttctggcccttgccgtcgtaacccagggtgcgggttttcagcacagccggcaggccaatgctggcgacagcagcgtccagatccgcctgggactggatgtcggcgaaagccggcgtcgggatgcccaggtccttgaacatgctcttctcgaaccagcggtcgcgcgcgatgcgcaaggcttcggcgctcgggtacaccggcacgaactgcgacaggaaggccacggtttcggccgggacgctttcgaattcgaaggtcaccaggtcgacttcatcggccagttggcgcagatggtccgggtcgctgtagtcagcgcgcagatgctcacccagggctgccgcgcaagcgtccggcgccgggtccaggaaagcgaagttcatccccagcggggttcccgccagggccagcatgcggcccagctggccgccaccgattacaccgattttcatcaatcaacaacctcaggcgatacgtgggtctggattgtccagcacgctgtctgtctgctcagcacggaattttttcagcaccgcgtgaaactgcgggtgcttggcgcccaggatgctggcggacagcaaggcggcgttgatcgcgccggccttgccgattgccagggtggccaccgggataccggccggcatctgcacgatggacaacagcgaatccacgcccgagagcatcgacgactgcaccggtacgccaagcactggcaggtgagtcttggctgcacacatgcctggcaggtgcgccgcaccgccggcaccggcgatgatcacctcgatgccacgggattctgcttcatcggcatactggaacagcaaatccggagtgcggtgggcggagaccactttcacttcgtagggaatgccgagtttttccagcatatcggcggtgtggctaagggtggaccaatcggacttggagcccatgatcacgccaaccaatgcactcatcgtcgtgcctcttctctctgggcgcccgcaggcgcgtcaaaaaacaacaagccacgcgggaaatccggcgtggcttgttgtacgaaatttggccggttggaccggccgaaggccgcgcagtataccgtaataattgagataaacagcccctggaatgaccatctgtccagtggcgcaaaccagcggttttattgactttcaggtcagcgaaaacactgccgataaaccatggaaactggatcaatgtgggagctggcttgcctgcgatagcatcacctgaatatgcctgatgtaccaaggcgtttgcatcgcagcgctgcggcgatccgacaagccagctcccacactaaccgcgctccactggcgggctctgcgccgccccaccttccagcttgcgccacaacaaccgtacgttggccttacgcaccagggcgcagcggtacaggcgaatctccagcggcacatgccactgcgggccgccgcataccaccagctcaccccgcgccaactccgcccgcacgctcaaatgcggcacccaggcaatgcccaagccttccagggccatgctcttgaggctgtcggccatggctgtttcataaatggtggtgaaacgcagggcacgctgacgcagcagcaggttcactgagcgcccgagaaatgcaccggcgctgtaggccagcaacggcacgctgccctcaccttccaggccaaacagcggcttgccctcggcatcggctgcgcacacgggcagcatttcggtattgcccaggtgcagcgacgggaagatctccgggtccatctgcatcgccgcgtccgggtcgtagaacgccagcatcaggtcgcaaccgccttcgcgcaaagcgtgcacggcgtcaccgacgttggtggcgaccagccgcgtggcgatgttcaggccctcattgcgcagttgcgcgatccagcgtgggaagaagcccaatgccaacgagtgcgccgccgccacttgcataacctcgccctgcccgccttccaggtgatgcaaatggcgcaagacttcaccgagctgctcgaccaccgtgcgtgcagtcaccaggaacaactgccccgccgccgtcaactcaaccggcgtgcgcgagcgattgaccagcgtcaggccgagcgcggcttccaggctgcggatacgacgactgaatgccggctgggtgacaaagcgtcgctccgccgcctgggaaaaactgcgggttgccgccaaggcactgaagtcttccagccatttgctctctaggttcatcacttcctcccacgggtacgcaccattttggcacacacgcccgccatgataaccgggtcacacctacattatgccgtttgtgcataggccagtgtttaacagcattggcccaaaaactcctacaagcctagcattcgcagcgttccggccagttccgggtccatatcgagatgatttccgtcatgtcctccgctgcatcattccgcacagaaaaagacctgcttggcgtactcgaagtacctgctcaagcgtattacggcatccagaccctgcgagcggtgaataacttccgcctctcgggcgttccgatttcgcattacccgaaattggtggtcggcctggcaatggtcaagcaagcggccgctgacgccaaccgcgagttgggccagctcagcgaagccaagcacgctgccatcagcgaagcctgtgcccgtctgatccgcggcgatttccacgaagagttcgtggtggacatgattcaaggcggcgccggcacttcaaccaacatgaatgccaacgaagtcatcgccaacatcgcgttggaggccatgggccacaacaagggcgagtatcagtacctgcaccctaacaacgacgtgaacatggcgcagtcgaccaacgacgcctacccgaccgcgatccgcctgggtctgctgctgggccatgacgcgctgctggccagcctcgacagcctgattcaggcattcgccgccaaaggcgtcgaattcggccacgtgctgaaaatgggccgcacccaattgcaagacgctgtgccgatgaccctcggccaggaattccgcgcgttcgccaccaccctcggtgaagacctggcccgcctgaaaaccctggcgccagagctgctgaccgaagtgaacctgggcggcaccgccatcggcaccggcatcaacgccgacccgcgctaccaggccctggccgtacagcgtctggcgctgatcagcggccagccgctggtgccggcagctgacctgatcgaagccacctccgacatgggtgccttcgtgctgttctccggcatgctcaagcgtaccgcggtgaagctgtcgaagatctgcaacgacctgcgcctgctgtccagcggcccacgcaccggcatcaacgaaatcaacctgccggcacgccagccaggcagctcgatcatgcccggcaaggtcaacccggtgatcccggaagccgtgaaccaggttgcattccaggttatcggcaacgatttggccctgaccatggcagccgaaggcggccaactgcagctgaacgtgatggagccgctgatcgcgttcaagatcttcgactcgatccgcctgctgcaacgcgccatggacatgctgcgcgagcattgcatcgtcggcatcaccgccaacgaagcgcgttgccgcgaactggtggaacattccatcggcctggtgaccgcgctgaacccgtacatcggctatgaaaacgccacccgcattgcgcgtatcgcccttgaaagcggccgcggcgtgctggaactggtgcgcgaagaaggcttgctcgacgacgccatgctcgacgacatcctgcgccccgaaaacatgattgccccacgtttggtcccgttgaaggcctaacgtttgttgcaccgctcaccaggttgagggactagacacctctcaccttttgagggcctgaaggctcgttcttcaggcccttttttttgcctcaaggttgtgaaatgaagcccataaaaactccaatatcgccccacaaaccctccttgcctgcaacagcttggctgaaacctttaatcgccccgtgcagacggatcacgctcgcctaggtatagtgccgcccctcttcgcgtctgcggccgtcggtaacgaggcccggatacaacgcgaaagcgcatgaataacaacacccgcaaaaggattggggtcgaagcgtcgtgcactgcctggtgctagacgatgcgtcggaccgtcctgcgtttgccattagaaaaatcagcgaggaacactccatgctcgaagtcatcaacgacttcctctcagggaaagtactgatcgtgctcattgtcgggctcggcggttatttcacgatccgctcgcgtttcgttcaactgcgtcactttttccacatgttctcggtgttcaaagacagcctgaagagcagctccggccagctcagctcgttccaggcgctgatgctcagcctggccggccgcgtgggtgccggtaacatcgccggtgtcggcattgctgtgaccctgggtggccccggtgccgtgttctggatgtgggtcaccgcgttggtgggcatgtcttcgagctttatcgagtgctccctcggccagctgtacaagcgcaccgacgctgagggcacctaccgcggcggcccggcctactacattcagcacggcctgcagaagcgctggctgggtatggtcatggcgttcctgttgctggtgaccttcggtttcgccttcaacggcctgcaagcccacgcggtgacccactcgctgaacaacgcgttcggcctggacaccacctacaccggcctggcgctggcggtattgctgggcctggtatttatcggcgggatcaagcggatcgcctcgatcgcagacctgctggtgccggtcaagacgttggtctacatcgccgtgaccctctacgtgatcgtgctgcaattcgaccacgtgccggccatgctcgcgaccatcgtcaagagtgccttcggcctcgaccaagccttcggtggcctggtgggcagcgcgatcatcatgggcgtgaagcgcggcgtgttcgccaacgaagccggtttgggcagtgcgcctaacgtggcagccgtggcctcggtagaacacccgatcgcccaaggcgtggttcaggcgttcagcgtgttcctcgacaccttcgtgatctgcacctgcaccgcgttgctgatcctgctctccggtttctacaccccgggctttgaaggcgacggcattgccctgacccagaactccctggcagcggtagtaggcgactggggccggatgttcatctcggtggccctggcgttgttcgtgttcacctcgatcatgtacaactactacctcggcgagagcaacctgcgcttcatcgtgggcgacaaccgcaaggtgctgatgggctaccgcgcgctggtgctggtgctgattttctggggttccatcgagaacctgagcaccgtgttcgccttcgccgacatcaccatgaccctgctcgcgttcgtcaacctgttcgccctggcgttcctgttcaagatcgccatgcgcatcctgaacgactacgacaaccagcgcgcagcgggcatcaagacgccggtgttcgactccagccagttccctgacctggacctggatcgcaaggcttggcctgcgaacccagtgaagcctgagccaaccgctcaagccacggctgatctgaacgctcaagcgcaacgctaagcgtaggcagcctagatagatgacacgccgcccggccttgggcatgctctgggcccggcggcgtttttcgttcaggagattttatgcaacccgctaataacgtaatggtgctctacaccggcggcactatcggcatgcaggccagtgccaacggcctggcgcccgcttcgggtttcgaagcgcgcatgcgcgaacagcttgccaaccagccagcccccgcttggcgattccgggaaatggcgccgctgatcgacagcgccaacatgaccccggcctactggcaacgcctgcgcgtcgcggtgatcgaggcggtggatgaaggctgcgatgccgtgctgatcctgcacggcaccgacaccctggcctacagcgcggcggcgatgagcttccaactgctgggcctgcaggcgccggtgctgtttaccggttcgatgttgcctgccggcgtgcccgacagcgatgcctgggaaaacgtcagcggcgccctggcggcgttgggcgaaggcctggcaccgggcgtgcagttgttcttccacggcgcgctgatggcgccgacccgttgcgcgaaaattcgcagctttggccgccatccgttcgccgcactgcaacgcaacgccgacatggccaaggccgagacactgcctgccgccctggattaccgccaacccaaagccctggccaacgtcggcgtattgccgctggtgccgggcatcgccgccgggcaactggacgcgttgatcgacagcggcatccaggcgctgatcctcgaatgttttggcagtggcacgggccccagcgacaacccggcgtttctcgaaggcttgcagcgcgcgcgggataacggggtagtggtggtggcaatcacccaatgccatgaaggcggcgtagagctggatgtgtacgaagccggcagccgtttgcgcggcgtgggcgtgctgtccggtggcggcatgacccgcgaggcggcgttcggcaaactccacgccttgatcggggcaggccttgccactgacgaaatccgccgcctggtggagctggacctgggtacggaaccccgtcctagataagtaccccccttcctgacttgccggtttctagcatgggaaccccgagcgtatgcctcgggttgttcccatccatcggcaagacagggatgcaccatgaccactccaagctctaccccgcaggatgcaacatccgaagcgctcacgcttaaactgatcacccaattgtgcgtcggcccgtcgataaccgaggctgcctgcgaactgctgcgcgaagccttaaacgaacagtatccagacctgcatatcgaccctgacaccacattgctgggcaggccgagctgggcgctcgtcgacgacacgatcacgtccaaccctgcgcgctattggaacctcagcaccctcttggccaggcaggccatcctgaaagtgccgaccttgtgcatcgagggcgaacactttctcacccagctccccttggctgagcctgcggttcacctgccggtgcgtattgtgcaaatcgccaacaccatcaatatcctcgcgcccgtgttgttccaggcattcaaagaacaggtggtggatttctggaacagcagcaaaggtgacggcccgcaatggcacgaactggccaataccctgcgcaacgcctggaacgtgcaagaggtggacggctggaccgaagacgactgtaagttggcccgcagcctgtatcactcgcccgacccggcagatcgccagagcggcgacacactccagcgccaggcgtgcctgatcgacgtcgacctgctcagcgacggcaaggtcagccacacctaccaggtatttatcgccgtgctgctcgggcaatccgagggcaaaaccgtcatcctcagccactcgctcgcaggctataaaaagttcactacccaggaacagttgggtgagtacctgacgaccttgttgtaccgaccaccgccctatgaacgcttgcaatggcgcctgtatgaaccggccgggaattttttccagaacctggcctgcaccctggtcacgctgcaaatcgacgccctcacccgcctcacccctggcatgcccaccgcgccgagcgatacacccttgagcacattggcggagcaggccggactggtgacccccaaggggcctgatcttgtgtggtatcagcaagcattgcccgactggctcgaccaagcgtctaccgcggaccgggcgttttatgcacggcacctcaaggacctggccgcattgaacagccgcaacgcgggcaaaacctaccaggacgatatcccctcgatccggcagtacgcccaggacaggctcaagacgcagatcatcaaggaccatcccgacgccgcagagctggcgttggataccctgaccatcacggtgcaaaaacaggttgtctggggcacgttcccgttgccgggtcaggtcgaaagcagcaccttcagcctggccgacctggccctgcaaaacctgatcgcgctgcctgtcggcaaccagaccctgcagttgcaggcgcgcaaggccctgccggcgtggctgaccgtcgactacgtgaaaacgctcatcacgcacgtcgatatcggcaccacttacccggcgctcattcgcagcaagttgatcgacgacccggacgagtcgttgcggcgcagaaccttgtacacccaacacctgcgtatccagctgccgttgctggcgttgcagtgcaaggtgcgcaaagaggccgggatcgacgaacgcggctaccgctatgtggcagccgtgatgcaagccgaaatcagtgaccgttttgtcgacggccaagccattgtcatgaggcatctggctttcgtgcccaagcgccggcagtccaacggccaggacgtagtaagcaacatgtacgtcatcggcccgcaaaatgccgacgccggcccttgcctgttgtatcgcccgctgttcgacccggtgctgcttcagtacccgtcacaggcgaacctgctatatgccatcgcgcagtcccacgcattgcgtgattcggtggtcgcctggctgcccgacttggtgcgcggcgactacaccaactacgtatttcccagtgacctgccctcaccctggaccgtggccgactttctggtggaacctgacaaactctggacctacagcggccccatgagccttggccagcaagcgctcaacggcaacctgttttccacgttgtttgaagccaacgccaaggcgctggtcgagctggcagaccgccaatcggtctccaacgccgaaaaccgctgggccacgctcaagcaagccggctggctgatcttcaatgccgccctgccctttatgggccgtatcgccggcaccggggcctggatctggcagatcgtcgatcaagtccaaacatgggtcgaggcacatgagcacggcgagcaacaggcgcaatggtcggcgctcaccgatgtgctgctcaacctgggcatggctatcactttgcatgtcgccacgcgcgctcaccccggcacatccccttcaaagatcgagcctgaaagcccacgccttcccgcgaaaacggcggtgaccgtagagcaattgccgacgcgcaccacagactacgcgcccaccgggcacgacttgccactgaacaccagcggcgcgatcacccgcacatccggaaccctggcgaccctgctggacagtttcgccatcgaaaaacccactgaccttcccgcggtcatcaccgaggaaagcgtctaccaatacctgtacaagcgcgagcagcgttactacgcccaagtgggcgcacgctggtttgaagtgacgctggaaggcgacgagacgttcgtcatcgtcgatgccaggcaacccggtcgtaaggggccgcccctgattcacaacgccaggggcaactggtttatcgacacccggctgcgcttgcacggtggcggccgcaaaggcaaacagaaaagcgccctggagcaggcgacgctgaagtcatccgaactgcgcgcgaaactggcggccttcgaaaacgccaagaaaaatgtacaaagtgacctgcaacaggcccaccaggccatgaccgcaacgcccggtacgtcggcccaggccaagttcaaacgccaggcttacatgaacaaactcgacagccacagctcggactacgaagaggcccggcaacagctgatgaccttgaacgtcttcacccccgtcacggacttccagcaaaaagcgctgagctatttgaaggcgcaactggaacttaatgaggccggtatcagggagttgcaaaccacgttcaaccccgcactcaaaaccgtgctcgaacagctcgaatctcccgcgacctcaaccccggcgacccgtgccacagacgcgcagtcagtgactgacatgagcaacgccatgatcaagcgcctggattacgcacaatcgcgcttcaccgcgttacgcgaccttgcccgcgagggcttgcgcatgatccaactcaaccagcctcggctgcccggctataccagcgacgacctgcgggccttgcaggtgacgctggcgcgacatctatgcctggcgccgcaatccttcgcgagcgagcctgccgcctggaccctgatcagcgagattgtcgaccgtgcagacattgccgtgcagaccctgcgcgatacccttcaggagcgcagcgaatcacgcttggatgaacgcattgaaaccttgagcagtctggtcgaacagtttcagttcattgatgagcgcctgcaggatttccctcaggaccataccgaacactcgctcaccccacccattgagcgcctgcgtgcattgctccgtgagttcgctgatcgggccagcgctgaactggcgccgttgcacaatgagcaagaacgccgtcgcatccggcccacaccgccaccgtctccaccacggccggtgaagaagttcatccacacgcgcttcaacggtgtactgattggcgagccccgattgaccccagtggggctcgaaaccgagtttgtcgacatcaagtcaccgctgacccacaaagtcatcgccacctttcatcaaaaatcctcaggtgtctgggccgaacacataaagcctgccagtacgccgccctcaccggtggttcccaccgtcgccagcagcatgctcaacggccaaacgttattggaccaactgccggccttccagacgcgcgccgatgaacaaatcaacaaagcctcgcgtacccccatcggcatcgagtacatgcttcaccaacacgcccagctgctggagcaggccaacagagacatcgaagaagcgctgacccaagacaacgccacggaaagccggcaaccctctgcggtggcgctcggcaaacaactcaacgacgccgcgcaagcgctttacctgcagtccaaccagcaagtgcagaagatcatcaagcaacagccaccgatcatttccggtgttgagtggctcaagaatcacaaactcatcactttcaaaaaaaccgtcaagcgacgccgcctcaaaagtgagatcaaggactatctggacgagtacaccctcaccgatgtggccacgcaaacgccgctctggtatgcccacttccattactcaaccgcagacgcaccggccgatagatttctgtccgcgcgcttgaaaaccccgcaggagcacgcgcgcggcaaagcagcggacagtgtgcgcgggctcactgcacagcaacgggtggcgttctatcgcagtaccatcagcctgacgcaggccaagcgcttgtttttccgcccagagcgcgattgacgggcgtgcccggcagcggcacataacttgctccagcctgacaaacccaggctggagcgaccatgctgcattcacacctgaccaccctcaacgccgtctccctggtgctcagcaccttcaaggccgagggcttgccgtttgaggcgctgctggccggcagcggcatctgtgcggcagacctgaaccgcgccgacacgcgcatcaccaccaatcaggaaatgcgcgtgtgcgccaacgcggtggccctgcgccgggatgtcggcctggaactgggccgccagatgcacgtctcggcctacggcatgctcggttacgccctgctcaccagtgccaccttcggtgacgctttgcgcctggcgctgcggtatccggcgctattgggaacactcttcgaactgagccttgaggcggacggcgagcgcatctggttcaccgcgggcgactaccgggaaaatgcgagcctggaagtattcaacgtcgaactgtgcctggcatcgctgaaagtgatctgcgatgacctgctcggccagccgctgccactgctcgcggcgcgctttgaacatgacgcaccggattacctcgcgcgctacacggaacgcttcccctgcccgttgcagtttcaggctaccgccaatgccttcgccttcgacaagcgctggctcgaccagccgttgcccctggccgacgccattacgcaccaggccatggccgaacgctgccgcaaacagaacctggagttcaccgggcgccaggcctggctgggccggattcgccaactgctcaccagccaactcaatgccgcgcccggcctggacggcttggccgagcagatgaactgctcggcgcgcaccctgcgccgccacctgcatgacctgggcagtagctatcaggaactgctggacgagctgcgcttcgagcgtgccaagcaactgctgacacaagagcagtggccgatttaccagatagccgaggcgctggggttcagcgagaccgccagtttcaggcacgcgtttgtgcgctggagtggcgtggcaccgagccaatttcgcccgtgatgccccattgaggggcgaatttcggacagataatttggccgtatttatccccttttggccgctcctgccgttctcataaacacggcccgccgcaagactgcatccactgatacagcctgcggagaacaacaaatgctgacgatctactcggacgatcaccacctgcatcacggccgttgcgaactgatggacgggcaactgatgccctgcttcgaaatgccgtcgcgcgccgaccatgtgctgcaacgcgtcaaagaccgcgaactgggcccggtgcaggcgccgcaggactttggcctggcgccgctgcaacgcatccacagccacgactacctcgacttcttcaaaggtgcctgggagcgctggaccgagttcggccaggacggcgacctgctgccttacacctggcccgcccgaaccctgcgccgggtcatccccaccagcctgcacggccagttgggttactacagctttgacggtggcgcaccgattaccgccggcacttggcaagcagcgtatagcgcggcgcaagtggcgctcaccgcacagcaggccatcgcgcaaggtgccaacgccgcctttgccctgtgtcgcccgccggggcatcacgccgccagcgatttgatgggcgggtattgctacctcaacaacgcggccattgccgcccaggcgtttctcgaccaaggccgtaaaaaggtcgcgatcctcgatgtggattaccaccacggcaacggcacgcagtcgattttttatgcgcgcaacgacgtgctattcacctcgatccatggccacccggaagcagagttcccgttcttcctgggctacgccgatgagctgggagaaggcgcaggaacaggttttaacttcaattatccactgccggccggttccggctgggagcgttggaacgcagcactggagcaagcctgccgagagatcgagcgctacgacgccgaggtcattgtggtgtcgttgggcgtggacacgttcaaggacgaccctatttcacagttcaaactcgacagccccgactacttggcgatgggcgcgcgcatcgcccgcctgggcaagcccacgttgttcgtgatggaaggcggctacgccgtggaagaaatcggcatcaacgccgtcaacgtgctcgaaggttttgaggagtccgcccaatgaacatgctcaagtcactcctcctctgtgcagccgttctcggcggcgcggcccatgccgaagagaaaccactgaaggtctacaactggttcgactacatcacgcccaaggcgcttgaagacttcaaggcccagaacccgaagatcaaattggtgtacgacatcttcgacaccaacgaggccctggaagccaagctgctcaccggcaactccggctatgacgtggtggtgccctccaatgtgttcctggccaagcagatcgaagccggggtattccagccgctggaccgcagccagttgcccaactggaaccacctcgaccccaaactgatgaagctgatcgaagccaacgaccccggcaataaattcgccgtgccctacatgtacggcaccattctcatcggcttcaacccggccaaggtcaaggcggcgctgggcgataacgcgccggtggacagctgggacctgatcttcaaggaagagaacatcagcaagctcaagcaatgcggcgtggccctgctggattcaccctcggagattctgccgctggccttgcaacacctgggcctggatcccaacagcagcaaccccaaggattatgaaaaagccgaagcgttgctgatgaagatccgcccgtacatcacctatttccactcgtccaaatacatggccgatatcgccaacggtgacatctgcgtggccgtgggttattccggcagtttctcccaggccgccaatcgtgccaaagaggcaaaaaacggtgtgaccgtggacatgcgcctacccaaagaaggcgcgccgatctggttcgacatgctcgccattcccaaaggcgcgcaaaacccgcaggacgcctacaccttcatcaactacctgctgcaaccccaggtgattgcgccgatcagtgactttgtcggctaccccaacccgaacaaggacgccaccgaacaggtcgacccggcgattcgcaataaccccaacctgtacccgaccgaagccgccatgaacacgctctacaccctcaagccactggggcgtgatgccgagcgggcgcggacgcgagcgtggaccaagatcaagtcggggacttaacccggcaggcgccttcacgcatggccagcgccccatgcctggcgtagccgcgccagcgcctgggcgatggccgcttccggcacggcggcgaagcccagtaccaggccggcgcgctggtcggcgggggttgcagagccaggcagccaatagctgctcaagccgttcacctcaacgccggccgcgtgcgcctgcgccagcaactgttgctcgcgggccaggttctccacgcgcacggtcaggtgcaacccggccgccacactgggcagtgcgccaacgccaggcaagtcgtcaggccaacctgccaacagggcgttacgtcggctcaaggcggcgcggcgcatgcgtcggatgtggcgctggaaatgcccggccgccataaactcggccatcactgcctgggtgctgacttcggagtggcgcatgtccacggcgcggcgccgggtaaaggcgtccaccaagcccggtggcaataccaggtaacccaggcgcaacgccgggaacgccaccttgccgaaggtgccgacgtacagcactcgcccgctgcggtccagcgccgccaagggcgacaggggcgcgccgctgtagcggtattcgccgtcgtagtcgtcctcgatgatccagccgcctgtgcgctcggcccaggccagtaattccagacgccgcgccaggctcatcaccacaccgagcgggtactggtgagaaggcgtgacgtacgctacccggcaatcacccagggtattgagtacttggcaatcaatgccttcggcatccaccggcacgccatgcaagcgcccgccggccagggcaaacgcatggcccgccgcgcgatagccgggattctccaccgccactgcgtcgccgggctccaccagcaactgtgcacaaaggctgattgcctgttgcgcaccactggtgatcactatttgttcagccgtgcactgcatgccccgcgagctgcgcaggtaagcggcgatcaaaccgcgcaggcgcgcatcgcctgccgggtcgccgtaacacagctgctcgaggtccggcttgcgccagaatgccccattcagcttggcccacacctcaaagggaaacagatcaaacgccggcacacccacacgaaacgcccgtggcggccccgatggcggcagagacaggtggttgttttttacccgctccacgcccgcgctgtggataacttcactgtccagatcttccggcaatttctgccattttgtggataaggctggggataagcctgttgaaaaccctgtggatacttttgtggatagttttttcggtgtgggcaattgggctacataagtgccatcgccgacccggctctcgataaacccctccgcgtacagctgatcgtaggcgcgcaccacactgttacgggaaatcgacaacgccgccgccaaatcacgggtggcaggcaatcgcgtgccgctgaccagtcgcccatccagtacccgctggcgcagggcctcgtacagttggcgtgtcagcccctggcggcgatccagctcaataccagcaggattaaatgacagcggcggcgaaatcggcggcatattggacctatgaaattggtgccagatggctcttacaacgaaccattagcctgcctaggatgcaggcattcgccaaggaatatttccatgtacacacctcgcgcctttgccctcgacgatttgcccgaactgcagcaactgatccagcacactcgcctggcgcagttggtgacctttggtgagcaaggcctgcaagccagccacttgcccctgttgctcaaccccgacgaaggcccgaacggcacgctttacgggcacctggccaaagccaacccacagtggcacgacctgcaaaatggcagcgacgcgatggtgattttcgccggtgccgaggcctacgtcagcccggcgttttacccggcaaaagccgagcacggcaaagtggtgccgacctggaactacatcgcggtgcatgcctacggcaacgccgaggtatttaccgacgccgagcgcttgctcgccgtggtcacggcactcaccgaccgccacgaaggcaaccgtgcccagccgtggaaagtcagcgacgccccagccgactacattgacggcatgctcaaggccatcgtcggcttcgccttgcccattgagcgcctgatcggcaaacgcaaactcagccagaaccgcagccaagccgacatcaacggcgtgcgcgaaggcctggccgccagcattgatgtgcgcgaccagaccctcgcgcgctttattccccaaggagcttcagaatgagcccgatcgacatccgccccgtcaccgccgccgaccacgccgcctggctgccgctgtggcaggcgtacttggcgttctacaacaccgagttgccggacgccgtgagccagagcacctggcaacgcctgatcgacgccaatgagccgacccactcggcgctggcctggcaggacggcaaagccgtgggcatggtcaacttcatctaccaccgctccaactggagcatcgaaaactcctgctacttgcaggacctgctggtggacccggcccagcgcggcaccggcgtgggccgcaagctgatcgaattcgtctacaccaccgccaaggccgacggctgctgcaaggtgcattggttgacccacgagaccaacgccaccgcgattcaactctatgaacgtatcgccgaacgccctggtttcattcaatttcgcaaaggtctttaaggagcgcagcatgcctacctcactcgccgactggaaaggcgtcccggcgcccaccgttgaactgctcgaagggcgctttatccgcctggaaaaactcgacccggcgcgccatggcgacggcctgtggcaagccctcgaaggccccggcgccgacccgaagctctgggactatttgccctacggcccgtttgccgaacgcgccgcgtttgatgcctggctcaacaaccatgcccagcacagcgacccgtatttcttcagcgtgatcgaccgccaaagcggcgacgtgcagggcatcctcagcctgatgtccatcgtcccggcccaaggccgtatcgaaatcggccacgtcaccttcggcgcgccgatgcagcgctcaccgaaaagcaccgaggcggtgtacttgctcgccaaatacgcttttgaacagggctaccgccgcctggaatggaagtgcaacaacggcaacgcccgctccaagtacgcggcggagcgtttgggcttcagttttgaaggcgtgttccgccagcacatggtggtcaaggggcagaaccgcgataccgcgtggtactcaatcctggactcggaatggcctacggttggggcagggtttgaagcgtggctgtcggagtcgaaccagagtggttccggtcagctgaaaacactgaccgagtgccgaggctgactttcactgacaacacaaagcaaatgtgggagcgggcttgcccgcgaaagcggtgtatcagtcacagcatgtgttgactgagctaccgcattcgcgagcaagcccgctcccacattagattttcggcgattccaagctgtgtactcagccgcctttacccaccttccagcccaacgccttcaaggcatcgcacccatcctgcaacaacagatgcgccgccgaagcgacatgttgcaagtcagcgccttcggccaattcggtacttaaacaggtgacgctattgagcagatcgcgggcagcctgaatgcgctgagtggcggtttcgaacaactcacaggcttcgacgtcgtcattgatgaagaaaacggggttgcaggtgatattgctgtctagcggggtgtaggtaggcataacgaaacactcgtgattgaagttagaggtttcatttttttcgaccggctaagatcggccgccgacacatcggcaaccagcgcaatgtaaaccagcagctaaaaccggaagcacctaataagtgctctaacgccctgaaattgcctattcctacaaacttctgcgaaccttcaccacgcccattttcaacccaaacggcctgaacactgcattcagcgatttcagcgtctgattcccctcgccgtgttcaatatgcaccaaggtgcgcacagagattttgcacatcttggcaaactggctttgatgcaggcccgtgacttcggtgcgtaagcggcgtaccgcttcggcgatttccagcgtgccatcggccaaggcatcctgaatgctttcaatcagcagggttctttcgtcaacggtcaggctcatttcaacccccactctttcaggcgctgcggcagatttttcaaggcaatgcctggatggttcatcgtcacggcaggcagaccgctggcactgaggatgtctggcaatgcagataactgttgcgctgcagctctcaggccgtcgaatagttgctggctgtcgacaaagtcacccagcaaatcacacacaccccgccagtccacctcgcctgcccgttccagttcccttggccatttggtggtgcgcgtgatgccttcgtcgtccatcaccatcggcgccaaatcgtaaatgggggcaaggcgcaaggcgttcgcttcgcgaatgatcgaggtgttacgaccatggttgtctgagttaccgagaattttgttcaacagatcgcgcttcaggtactcagcgaccaatactggcacttcgttggattgacccgcctctcgccacaagccgaccagcagttccaccacctcgcgatgcgccatggcactgccgggctcagtgacacctgccagcgagtaaatcgactctacggcgtagcgctcgaccccctgcgcagtgacgcatcgatcaaaacgctgcatccacacactgggctttctcgcctcctccagggacagccctgactcagccaccgtatcaatacccaaggcctgcaaggctttgtagtagtggtattcgcttcgcagaatgtcctgatccatctgcgtgccgttattgcgcgcaaacttcacaaaccaatgctgcttgacctgttcgtcatcgagcaccgcatccgggaacaacaacccgtcctggttttccgtcagcaacagcttcggcgcctccccgccggcgcccgtggccccgccgatagccgcgccttgttcataggcatattcgaggaaacggttatctcgctggatgacttcataacgctcaaacccgatggcgggccgactgtccaaggcctcaatcgactctttgatccgcatatggccaatcggggcgggcgtacttcgcatcagtagaaaaaggtctgcaccgaggtcatccggtttttcccggccaatacgcgccatcaaaaaacgtttagcggcaccggccggtgcgatgtcgagcacaaaagcgggagcattctgggttctgccgccctcccattgcagaggaaaccggctgctcacggaggtggcgaagggagttgccaactcatttaggtgatccaccagatagcgctggtcataaccaaaactgcaccggctttcgaatcccagttgcggcttatcaaaagtcaggagcatggcgtcctgccacttcccttgggtgtagatttgcagcgtcaggctgaccatggcttctacctgcaatttaatgcgtctatccagctaaaaagcactaaccgattgcaatatagtgcagattcagtcaccacgcatccattcaaactgcaataaaatgcagaatatgaaaaatcctggaactgtttacgcaataaaatgcagatacagtacatgtcacacttccgacacattcctgcaatccccctccgctatacaggtcgactcgtttccataacaaggtcgtccgccatgccctcgtcgccccaacgcctcgccctcgccatcactttattggccagcggtctcgctgaagcggcgcctgcgcccaccaaaaccgtgcagatcgacacaccgaccaccaccgggcaaaccctgaccggcagtgattcgttgaccacctcggcgccgggcagcattaccacgcccggcgtggcggtgacgctcaaggacggcaccagcggcgcgggtgtggtgattactaacgcgggtaagctggtctccagcggcgggcgcggtatcgacagctcggggacgatcaccggggcgcgcaattacagcatctacaacctcgctggcggcgtgattcagggcgccaacgacgcgctgcgcatcaacagcaactttgccagcggcagcttgttgatcgacaacagcggcaccattcgctcggccaccggccaaggcttggacctggatgcaatccgcagcaacaacgtcaccaccacgatcatcaaccgcgccggtgggttgattcgcggcgacgccagcgacggcatgaagaccggcgccaacgccagcatcaccaactatggcgagatttcgactggcgacaccttctcgcgcgatgacaaattcgacggcgtcgatatcgactccgccaccggcgtgacggtgaccaactacggcctgatttcaggcgggcgccacggcatcaccaccgacctgggcgccacgctgaccaactacggcacggtgatcggccgcaacggttcgggctttggctctgacggcgacggcacggtgatcaaccacggcaccatcaccggcgccttctccgggctgcagccggatggcgacggcgatggcgtggacatcgacaaaatcgcgcatatcgaaaactacgggatcatccagggcgtcggcgccggtggcgtcgacaagaatggctttgccaatggcagtgaaggcatcgccttgggcggcggctatgtgtacaacgcccatggggcgctggtcagcggtgccaacaacgcgatcctggtggacgacggcagtgacggccctggcctcgcggccaccaccctggaaaaccacggcaccatccagggcctgaacggctttggggtgaagttcgtcggcaacttcgccgacaccgtcatcaacggcggcaccatcagcggcagcaacggcttggccctggacttgggcggcggcgatgacacgctggtgctgctgggcggcagccgctttgtcggcgtggtggacggcggcgccggctatgaccggctgagcatggatgatgccgccggcggcagtttcggtgacagccgcaatttcgaatggctggacgtgaagcaaggcacctggaccctcaccggcagcggtgatttcagcgatggcggcgagattttcagcggcgccaagctgatcaaccagggcggtatcgccggtaacctgaccgtcgatgccggaggcatctacgccggtggcggctcggtgggcagcctggtggtcaacggcaccctgcagacgaatacggccttgggcactgcgaccatcacgcgtgacctgaccatgggcagcggctcgaccctggcctatggcgtcaacgccgatggcagcagcgccccgattaaagtcggcggcaccgccaacctgaatggcgccaccctggcgatcaaccccggcgaaggcacgtacccgtggcaaagccattacaccgtgctgcaagccggcagcatcaacggcaccttcggcaaggtcaccagcgactatgcattcctgaccccgaccctggattacagccccacccaagtcggcctgacgtacacccgcaatgacattgccttcaaccagttcgccagcaccggcaacggcgtcagtgctgccaacagcctggcaggcctgggcacaaacaatccgctgtataacgctttgctcaacaccaccaacgccagcgcgggcgcggccatcgagcaactggccggcagcagcaccgccaacctcaccggcgccacgctgggtgccagcgcccaggtgggcagcagcatgctcgcggcgatgcatcaactcggtggcggcgcgggcttgctggtcgggcttgatcaacaagacacaccggcactcgccgccaccggcgtgccggcgcatgcgcgcaacctcaacgacccgaacgcccgtggccgtctgtggctgcaaggcatcggcagctacggcaagctcgacggcgagcacggcagcaatggcttgacccagcgcaccaaaggcagcgtgctgggcgccgattgggcactcgacagcgactggcgcgtgggcgtgctgggcggttactcgaagaccgacctggacaccaccggcgtcgacggcagcgtcgacagctggcacgcaggcgtgtacgccatgcgccagagcgggccactggccgtgcgcctgggtgcggcctacagcgggcaccagggcgagagcaaacgcacggtggccttcaacggtttcagcgaccgccccaaaggcgactatgacgccaacagccagcaagccttcgccgaactgggctacgccatgggcagtggccgcttgagtaccgagccgttcgccaacctgggctaccagcgctaccagcgtgacagctacaacgaaaaaggcggcgccgccgcgctgcatgtcgacggccagacccaagacaacttcagcagcaccttcggtttgcgcctggcgcacctgagccaactggacaacggcatcagcctcacgccacgcgtgagcgcaggctggaagcacacctacggcgatgtcgacagcaacacgcgccaggctttcctggcgggcggcacggccttcaacgtcgaaggcagcgcactggaccgcaacagcctgctactcgaagccgggctggatgtaggtttgtcggcccgccacaccctgggcctgggctacaccggtgaactgggcagtaacagccgcaatcacgcgctgacagggcaatggcagatgagtttttaatcgcgccgtactagagacaactcccgcaaaccaggggtcgatgacctgacagttatcaccccgccatctcgctaaattcccggcctcattcaccagaggttgggattacatgccctttacacatcacagacttgcacttgtcatggcccttgcgatgagcgccttcagtattgaatgcgcacaggcgcgaggtgatattcctatcacaccctttgtattcgacccccttcccgaacttaacgatgactggtcttacacgcccccagagcgcgctcccagccttgacggttacctcatccggcaggccaccacgcacaatgggcggcaggtcgcccacgtgcttgaacccgcgctgaatcgcctgctggaaaccggtgcattgaccgcaggcgaggccacggagctggaaaaattcggtgaaggcctggccgaccggcccggagggataggcgcagcactcgaacagttagccggcagccaaaatgccaacttggcgagtgctacctccgccgccgccggcaaagtcagccagcaactgctctcgaccctgcgcacactgccgaccgataacgacggccacttctgggtgcagggcctgggcgacaacggcaagctcgacaagcaaggcggcagcgacgggctgaaatatggcaccaaaggcctgatgctgggcgccgactggtcactggatcacgcctggcgtatcggcgtgatgggcgcaaaatccaccagccaatttgatacccaacgcttctcagccgaactcgacagctggcacctgggcagttacgccgtgcgccaggacggcccgctggccctgcgtataggggcggtttacagcagccatgccgggcagaacaagcgcggcgtgaacctgcttgagtacaccgagcagctcaagggcagttacaacgctcaaagccaaaccgtgttttccgagctgggttatcaattgggtagcgaggatgtgcaggtagaaccctttgccggcctcggctttcagcgctatcaccgcgacagcttcaaggaaacaggtggcgtggccgcgttgaacgtcggctcacaaacccaacaaaacctgagcagcaccgttggcctgcgcctggcctctgtgtatcggttcgacaaccgaatgagcctcacaccccatgtgagcacaagctggaaacacctctacggtgaggtcggcagccaagtccgccaatcctatcgcgcggcgccggggtacattgaaggcttcaccatcaccggcacctcgctggaccgtaatagtctcgacgtgcaaggcggtctggacctcgccttgtctactgagcataccgtcggcctgacctacagtgcccaagtcggcacgcatagccgcaaccagggcttggtgggccaatggcggatgagtttttaacccggccaaatggaaaaacgcaggcgaaaaaaaaggggggcacctgcccccccgaggattaagcggtagtgtcgaaggctgtatcagccttcgatttcaatcaggatttctcccgggttgacccggtcgcccttggccacatgaacagcggtgaccttgccggcaatggatgcctgcacttcggtttccatcttcatcgcttcggtaatcagcacggcctggccggccttgaccacgtcgccttctttgaccagcacgtcgacgatattgcccggcatcgccgtgctgacatgacccggctcggtggcgtgcttgcgcttgctgccgccgctgctgacaaactcgttgagcggttcgaacaccacttcttccggcatgccatcgatggacaggtagaagtgacgcttgccttcggccttgacgccgacaccggtgatgtcgacgcggtagctttcgccgtgcacgtcgatgacgaactcggtcggcacgccttcaccaccggcacgcgccacgccgcctgcttcggggatcggcaacagcacttccggcgccagggtgccggcgtcacgttcttcgaggaacttgcggccgatgtccgggaacatggcgtaagtcagcacgtcttcttcggacttggccagcgcgccgatttcaccgcgcagcttggtcatttccggcttgagcaagtcggccgggcgatggtcgatcacctcttcactgccgatggcctggcgacgcagtttctcgttcacggtgcccggcgccttgccgtagccgccttgcaggtagagcttcacttcgttggtgatggttttgtagcgctcgccggccagcacgttgaagaacgcctgggtgccgacgatttgcgaagtcggggtaaccagcggcgggaagccgaggtcttcacgcacccgtgggatctctgccagcacttcgcccatgcggttgagtgcgccctgctctttcaactggttggccaggttggaaatcatcccgcccggcacctggttgacttgtacgcgggtgtcgacggcggtgaattcgctttcgaactggtggtacttcttgcgcacggcgtagaagtacaggccgatttcctgcagcagttccaggctgaggccggtgtcgaattcgctgcctttaagggccgcgaccatcgactcggtgcctgggtggctggtgccccaggcgaagctggagatcgcggtgtcgatgtggtcggcaccgttttcgatggctttgagttggcacatggcggccaagccagcggtgtcatgcgagtgaataaagatcggcaggctttgctcggctttgagcgccttgaccaactcgcccgtggcgtacggcgtcagcaggccggccatgtctttgatggcgaccgagtcgcaacccatggcttccatttgcttggcctgggccacgaatgcctcgatggtgtgcaccgggctggtggtgtaggcgatggtgccctgggcatgtttgccggccgctttcaccgcttcgatggccacgcgcaggttacgcacgtcgttcatggcgtcgaagatgcggaacacgtcaatgccattcacggcagccttggcgacgaaggctttgaccacgtcgtcgctgtagtggcggtagcccagcaggttctggccgcgcagcagcatttgcaggcgcgtgttaggcaatgcggcgcgcagtttgcgcaggcgctcccacgggtcttctttgaggaagcgtacgcaggcgtcgaaggtcgcgccgccccagacttccagcgaccagtagccgactttgtcgagcttgtcgcagatcggcagcatgtcgtcggtgcgcatgcgggtcgccagcaacgattggtgggcgtcgcgcaggatggtgtcggttacgaatattttcttggacattgttgtattcctcacaggcctgcgtgggcggcgatggcggcggcgatggccagggccagctcttcgggtttgcgcttgatcgagtagttggtcagctcagggtggctttccacgaaactggtgttgaactggccgctgcgaaattccgggttgcgcagaatttcctggtagtaggcggcggtggttttcacgccttgcaggcgcatgtcgtccagggcacgcaggccacggtccatggcttcttcccaggtcaacgcccacaccaccagtttcaggcacatggagtcgtagaacggcggaatggtgtagccggtgtagatcgccgtgtcggtgcgcacaccggggccgccgggcgcgtagtaacgggtgatcttgccgaaactgggcaggaagttgtttttcgggtcttcggcgttgatccggaactgcaacgcgaaaccccggtgctgaatgtcttcctgtttcaccgacagcggcaggcccgacgcgatgcggatctgctcacgcacgatgtcgatgccggtgatttcttcggtgatggtgtgttccacctgcacccgggtgttcatttccatgaagtacacctcgccctcggcgagcaggaactccacggtgccggcgttctcgtagcccacggccttggccgcgcgcaccgacaggtcgccgatgtaggcgcgctgttcaggcgtcagctgcgggctgggcgcgatttcgatgagcttctggttacgccgctggatcgagcaatcacgctcgaacagatgcaccacattgccaaagctgtcaccgaggatctgcgcctcgatgtgcttgggattgacgatgcatttttccaggaacacttccgccgaaccgaaggccttggtggcttcggaaatcacacgggggaaggcttgttcgagttcttcgcggctgttgcagcggcggataccgcgaccgccaccaccggaggtggccttgagcatcaccgggtaaccaatgcggtcgccttcggtgagggcttcggcgatgtcggcgacgttgccttcggtgcccggcgtgaccggcacaccggccttgatcatgctgcggcgcgcttcggtcttgtcgcccatgcggcgaatcacttctgccgaggggccgatgaatttgatcccacgttcagcgcagatgtctgccagctcggcgttttccgagaggaaaccgtaaccggggtgcagcgcatcacagccggtttccacggccaggttcaccagcttgcgcgggttcaggtagccggccaggggctcggcgccaatgctatgggcttcgtcggcacgtttgacgtgcaacgcgtggcggtcggcgtccgagtacaccgcgaccgagcgaatgcccatctcggcgcaggcacgcacgattcgtacggcaatttcaccacggttggcgatcaggatcttttttatcacttggaaattcccttgagccgattgctgcgttctacgacccattggatctgggtcggcgcgtgaccaaatgtttcatgacagtcgcgagacacacactatgcgcaccggaggattaacaaaaatcaataattattgggttgtgtataagtaaagacttatagttggcgtcacggtggcgggagtaaggtcttaaataatgcgtaagtcattgatgcgtatgacattgcgtcagttgcagattttcaatgaagtctgtgatttgcgttcctacagccgcgccgccgaggaaatgtccctcacgcaaccagcggtcagcctacaaattcgtcagttggaagagcttatcggccagccgctgttcgattacgtcggcaaaaagctctacatgaccgaagcggccgaagccttgcaacgggccagtcgcgacattttcgggcgcctggaaaacctcgatatgcagctgtcggacatgcagggctcgctgcagggccagttgaagctggccatcgaatccagcgccaagtacttcgtgccgcacctgttcgccgcgttcaagcgccagcatcccgaagtgcagttgcacctgacagtggtcaaccgcgcccaggtgattcgaaggctttcggacaaccgcgatgacctggtgatcatgtcgatggtgccgcaggacatgggcctggaattcctgccgtttctgaacaatccgattgttgccgtggcgccacccgagcacccgctgagcctgcaggggccgctgcgcctgcaggacctggaaccctacacattgctgctgcgcgaaccgggttccggcacgcggctggcctgcgaggagtacttcaaggagaagcgcgtgcacttcacccagacggtggaagtggcctcggccgaggcgcagcgcgagtgtgtaagcgcggggttgggcgtggccttgctgacgcgccacgcggtcaacctggaactggccaccggcgggctcaaggagctgccggtggacgagctgccgctgtaccgcagttggtgcctggtgcaggccaaggccaagcgcctgtcaccggtggcccatgcgttcctgggctttatccgcagcgagcgggtgcagatcagcgcgttggctgagcgtttcgctgggcagccaagggtgcctgccagtggagttccgggtagtccgtgatgctctggagcaattggcgctcctcacagcgatcttcgattgcgcgacgaaacgccatgcggcgctggtcttcttgctgacgacgggttttgacgctgctgctgtcttcgtattgccgggccatgttgagtctcccaatgcgagtacggggagttcaggatgggcgcggggcatgacggtttggcggcgcgagggttacaggacgatgaatattccagcatcaacgcaaatccactgtgggagctggcttgcctgcgatatcggtctgtcagctgccatatccggcgactgatacacagctatcgcaggcaagccagctcccacattgtgaccgggtgcgaccttgaatcagtcgtcgagggctttgaccgattttggcgacaaccgcaggctgcgcaagctgcgcttcacgctcttgaggtggttgaccaggctcgggcctcgcgccatggccacgcccatcgccagcacatcgatgaccaccaggtgggcgatacgtgaggtcagcggcgtgtagatttcggtgtcttcgtgcacgtcaatcgccaggttgaccgtggacagttccgccaatggcgtctggcttgggcacagggtaatcagcgtcgcgccgctttcacgcaccaggttggcggtgatcagcaggtctttggagcggccggactgggaaatacaaatcgccacgtcagtcggcttcaacgtcaccgccgacatcgcctgcatgtgcgggtcgctgtaggccgctgcggtgagcagcaggcggaaaaacttgtgctgggcgtctgcggccacggcgcccgaagcaccgaaaccgtaaaactccacgcgctgggcctgggacatggcggtcacggccttttgcaactcgaccgggtcgagtttctcgcgcacttccatgagggtgtgcaaggtggtgtcgaagattttcaggctgtagtcggcgacggaatcgtcttcgtgaatcgcaaactggccgaagctcgcacccgcagccaggctctgggccagcttgagtttcaagtcctggaacccggagcaaccaatggcgcggcagaagcgcacgatggtcggctcactgatgcccacgctgtgggccaggtcggccatggaactgtgcatcacggccgcagggtcaagcagcacgtgatcggcaaccttgagttccgatttgcgtaacaggtggcgcgactgggcgatatgttgcaacaggttcaaagggcaggactcttgttattggcaggcgccagggatgtagcaagtttgtagttatactacaagaattgccgttttgcccgtccgatgcatcactaaatcgccctgatgccctttgaatcagcgggcggccgccatgtagccacacgggcggcctggctgtctttaaggaaagtctgcatttttgcgtaacaattctgccagcccttcggcctccatcggccggctgatcaggtagccctgcacctcatcgcagcgttcggcgcgcaggaaatccagctgctgctgatcttccacaccttcggccaccaccttgagcgccagcccatgggccatggcgataatggcccgggtaatggccgcgtcctcgcgaccctggcccaggccgcgaataaacgtctgatcgattttcacgtagtccacgggaatacgcttgaggtagctcagcgacgagtagcccgtgccaaagtcgtcgatggccagcttcacgcccaggtcgcgcagttgctggaaggtggcgatgatgtgctcgacgctgtcgagcaattggctttccgtcagttccagttcgaggtattgcgggtccaggccggtctcttcgagcacctggcgcaccaggctgaccaacttgccctggcgcagttgatgcaccgacaggttcaccgacacccgaatcggcgccagcccttggcgctgccattcgcacgcctgccagcaggcttggcgcagcacaaattcacccaacggcacgatcaaaccggtttcttcggccaggccgataaagtcgcccggcggcaccatgccccactgcggatgctcccagcgaatcagcgcctcggcggcgttcagcttgccggtggccaggcacagtttcggttggtagaacaccgccagctggcgctcgtcgatggctttgcgcaggtggttctccagctgcaaccgctcaagcgtgctggcttgcaggctgtcggtgtagaactggaaattattgccgcccaagtgcttggcgtgttgcatggccatgttcgattgactgaccagcgcggaaatttcccgcgcattgtccggcagcaggctgacacccattgaggcgctgaccaccagttcatgcccttccaccgtcaccggcacccgcagcttggcgagcagccgcgtggccacacgcgccaggctcgacaggttgccgtaggcgtcgaacagcacggcgaactcgtccccggacaagcgcgcaatcgtatcggcctcgggcaacgcgttgatcagccggcgcgacattttctgcaacagctggtcggccacttcatggcccaggctgtcattgagcaatttgaagcggtccaggttgatatgcagcagcgccaggctgcgtccgccctggcgcacgcgcgcatgggcttcgcgcaggcgttcgcggaacagtgaacggttggcaaggccggtcaattcgtcatagtgagtgaggtagcgcatgcgctcttcggattcacgccgtgccgacagatcagcgaagaagccgacgatatgactgacatttccccgagcatcacgcactacattcagttgcagccattgcgggtacagctcgccgttcttgcgcgtctccactaactcaccctgccaggtgccgtgggtcagcagcgcttggcggatcaccgggaaatggcggcgggcatcgcggctgctgggcaattcgacgacattgcggccgagcatgtcgtcgatttcaaagccggtgacgcggctgaaggcctggttgacggcgatcagcgcgtagttcggatcaagaattacgatgccttcactggcggcctcaaagacggtcgacgccaggcgctgttgttcttccagggccttgctggcgctgatatcgcggcgggtgccgagcatgcgtgtaacgcgaccgttgggcgtacgttccacggcgcggccacggtcttcgatccagacccaatggccgtcgccgtggcgcacgcggtattcaacctggtagtcctcgctgcggcctttgaggtgctccaccagcgcgcgcttgagcagcggcaagtcgtcggggtgcaggcgcggcttgaggtggctgagcatcgccgtgacgtattcgggctcgaggccgaacagttctttaagctgggtgtggtggacttcatcggtttgcaagttccagtcccacaaccccaattcactggcttgcagggccatggccaggcgcgcttcgcttttattcagggcctggctggcagcgtccagttcctggctgcgttgcgccacgcgatcctgcaggccgatctgggcttcgcgcagttcctgttcgatctggcggcgctgctcgacttcacggaccaactcctgattcagctgttcgctgcgctgttgcgcctgctgcagatgctcgatcagcgcctggttctgaaagcgccgcaacagcccgcgctggatcaggcggttgacctgccacgccaccaggctcaacgaggccagcaggatcaagccaagcacgccccagccttgttgctgcgcggtgccgttccaaaacagataaaggatggccggcaccaggcagggcacggcaaaggacagaaacgcgggcaagctcaccgcataggcgacgctggccgacagcgttgcggcgccgatcaggccgaacacccaggcttgctgcatgaagctgtccgccggcaccaaggcgatggcggcggtggccagggtcaggccgctgaccgccgaaccgagcatgaacatgcgccgccagatcggctgggcctggcggctgggcatggccgaatcaaaggccgccacttggatcacacgcagcgccaccagggccagcagccagaccagccagatgctgtccaacacatattgcttggggttccacaacaaccaggcgcagaccaggccgttaaccagcatcaataaggtcggcagcaatgaaccttgatacagcagacgcgtgcgttcgaccgccatctcggttgcgtaatatttacgaatgacttctgcgggcgccgccgaggggccgaacaggtcgggactgagggtcataggcagtgttcttataatggtgagcccgaaacgtggacggagcatacacaagcaagcgcttgggccaaactgctccacgtcataaaaaccgcgcgaaaatcagccgcaaacctcggggccagacagcttgagtgagacgctgcgcgggctgcgaggcatgaccaaccggtcatcactcgcaacagaatgtttccaaggcccgaagcgcagccactgttttgcggcgaccacccggcattgggatttgccccactctgccgcgcaccctagaatgcgccgatgcgcgatgatctctcccttttgctgaactccctcaacgatgcccaacgccaggccgtagcagcccccgttggccgtcagttggtcctggccggtgctggctccggtaaaacccgagtgctggtgcaccgtatcgcctggttgatccaggttgaaaacgcgtccccgcattccatcctgtcggtgaccttcaccaacaaggccgctgccgagatgcgccaccgcatcgagcagttgatgggcatcagcccggccggcatgtgggtgggcaccttccacggcctggcgcaccgcctgttgcgggcgcactggcaggaagcggggctgagccagacgttccagatcctcgacagcgatgaccagcaacgcctggtcaagcgggtgatccgcgaactgggcctggatgaacagcgctggcccgcccgccaggcgcaatggtttatcaacggccagaaagacgaaggcctgcgcccgcaacatatccaggccagtggcgatttgttcctggccaccatgcgcagcatctatgaagcctacgaggccgcgtgcgtgcgcgccggggtcatcgacttctccgagctgctgctgcgtgccctcgacctgtggcgggacaacccaggcttgctggcccattaccagaagcgcttccggcacatcctggtggacgagttccaggacaccaacgccgtgcaatacgcctggctgcgtttgctggccaagggcggcgacagcctgatggtggtgggcgacgacgaccagtcgatctacggctggcgtggcgcgaaaatcgagaacatttaccagtattccgacgacttcccggacgcgatcactattcgcctggagcagaactaccgctccaccgccggcatcctcaaggccgccaacgccttgatcgccaacaacaccgggcgcatgggcaaggagctgtggaccgacggcggcgaaggcgaagcgatcaacctgtacgccgcgttcaacgagcacgacgaagcgcgctacgtggtggaaaccatcgaaagcgcgctgaaaaccggcctggctcgcagcgatatcgcgattctgtaccgttccaacgctcaatcgcgggtgctggaagaagccttgctgcgcgagcgcattccgtaccgcatttatggcggccagcgcttcttcgagcgtgccgaaatcaagaacgccatggcttacctgcgcttgctggaaggccgtggcaacgacgcagcgctggagcgggtgatcaatattccggcgcgcggcatcggcgagaaaaccgtcgaggccatccgcgaccatgcgcgtcacgccgatgtgtcgatgtgggaagccatgcgcttgctgatcgccaataaaggcctgaccggtcgcgcggcgggtgcgctgggtgtgtttgtcgagctgatcgagaacctggcggccaagtgcgcggaaatgcccctgcacttgatgacccagaccgtgatcgaacagtccggcttgattgcctatcacgaagcggaaaaaggcgagaaaggccaggcccgggtagaaaaccttgaggaactggtcagcgccgcccgcgcgttcgaaaacaccgaagaagatgaagagctgacgccgctcgccgccttcctcggccacgcctcgctggaagccggcgatacccaggccgatgagcatgaagacagcatccagctgatgaccttgcacagcgccaagggcctggagtttccgtatgtgttcctggtgggcatggaagaaggcctgttcccgcacaagatgagcctggaagaacccggccgccttgaagaagaacgccgcctggcctacgtgggcatcactcgagccatgcagaacctggtgatgacctacgccgagacccgacgcctgtacggcagcgagacctacaacaaggtgtcgcgcttcgtacgtgaagtgccgaaggggctgatccaggaagtgcgcctgtccaacagcgtcagccgcccgttcggcggtggccagcagcagagcgccagcaacctgtttgccggctccgagattccggaaacccagttcagccttggccaacaggtccggcattcggtgttcggcgaaggcgtgatcctcaacttcgaaggtgccggtgcccaggcgcgggttcaggtgaatttcgccgaaggcagcaagtggctgatgatgggttacgcgaagctcgaagcaatctgatctgctctgatcgttcccacgctccgcgtgggaacgccgcccaggacgctctgcgtcccacctttcgatgctcacgcccttgtatttcacgcgtgcgggccaatatctgtaattagtcctacagacccttcggaatcggtcttacgcaaaagcccgaaacactctgccgctagccagtgtcacgacacctgtgcaacatggcgcgcgtgcaatccacaaatgggaattccctttatgaaacgttttcttagcatcgccatggcgctgtgcatcggcctgacgatgagcctcgacgccaacgccaagcgctttggtggcggcaaaagcatgggctcggcaccgactcaccagaccagccaaatggctccatccgccggtgccggcggtgcagcagctaccgcaggcgcagccggtgcggctggcgctgctgccaaggctggcggtgcttcgcgctggttgggccctctggccggtatcgccgccggtggcctgctcgcctccatgttcatgggcggtggcttccagggcatgcaaatcttcgacatcctgatcatggcggtcatcgccttcttgatcttccgctttatcgccgcccgtcgccgcaagcagcaggagcacatggctccagccggcgcgccgatgcagcgtgaagtgttcgagcaaaaaccagccatgggttcgatcttcgggggttcggctgcacctgccgccgctcgtccggtgatcaacgcaccggcctggttcaacgaagagcgtttcgtcgaagcggcccgcagccacttccagtccctgcagcagcactgggacgccaacgaaatggacaagatcgccgagttcgtgaccccgcaactgctggacttcctcaagcgcgaacgcgccgatctgggcgacggcttccagtcgacctacatcgacgacctgcgcgtacagctggaaggtgtggatgatcgcgccgacaagaccatcgccaccctgaccttcagcggcgtgtcgaaaacctcgcgtttcgaccagggcgaagtgttcagcgaaagctggaacatggagcgcgcccaaggcgacaaccagccttggctggtcgccggtatccgccagaacggctgataaccgcacgcttgagcacttggtaataaaaaccccggacatgttccggggttttctatttcgcggttgcacttatagcgagctactgtataaaacgccctattaaccgcgccaactagcaagaggatcccggccgtggaagaaatcatcgaacaattgcgtgaagccaacgaaccggtcccggttcctctggagctgcctgacgaagaccagatcgtcgaaatcgaggaacaactgttcatcgacattccgtttgtcttccgcgaattcctgctgaccgtcagcgacgtggtgtatggcagcctggagccggtgaccgtcaccgacccgcagtcccacacctacctgccggacgttgccgccaacgcctgggacgccggtgttgaccgcagcatgatcccgatctgccaggacggcgacgactactactgcgtcgaagaagacggcaccgtggtgttgtggtccggcgaagaagaactggtcaccgaagaaacctgggaatcggtgtggcactgggcgcgggacgtctggctggaaagctgattgcaagggcttttagtggcgagggagcttgctcccgctgggctgcgaagcggcccctatccaggcaacgcgttctttcggatggggcgatcttgagatcttcagggctgctgcgcagcccaacgcgagcaagctcgctcgccacaacaagctcgcctgccatagttgtccttaatgctccggcgtatctttatggttatccagggtctccagcaaggcgacctgcattcgcgtatgcacgcggatgaaccaccgccagagcacggccgctacggccgccgccaccacggcaatcaataccagcaacttgttggtcggcagaatactggccgacaaggctgccagtagcaggaagatcaccagcagcgaaagaatggggatcaactccgcaatcacgcgccgcacgcgctgggtatgccgcccggccatttccggcttcacgctcatctccgccagcaacatcgacagcgccttgagcttgcggtacgccgcaatgagaaacggcagcgacaacagcaacgccccgccccagatcaacgccttctgccagcttgggtcactgatccaaccttccagatacccgccgatgcgcgccgcaaagaagctgccggcaaagaagatcgccaccaccaaggccaggtttacgcccacttgcaggatgatcttgcgaatcatcgacgccagcattgcgccctcaccttgcggctgaatactgcgtagccactcgccatacatgccgaacacccggctcatgcgcttgggcatcactgccgcaatcttcaacgacaacgggtcagcgccacgaatcaggtacggcgtaagcaacgtggtgatcgccgacaccgccacggccaccgggtagaggaagtcgctggtcacctgcaaagtcatgcccaatgcggcgatgatgaaggaaaattcgccaatctgtgacagccccatgcccacgcgcagcgaggtgcggccatcgttgccggcaatgaatgcccccaggccgcaggacagcatcttgcccagcaccaccgccacggtaatcaccgcgatcggccaggcgtactgcagcaggatttgtgggtcgatcatcaagccaatcgccacaaagaagatcgcgctgaacatgtcgcgaacgggttcgatcaggcgctcgatcttaatcaactggcgggactcggccatgatcgcgccgatcaggaacgcgcccagcaccatgctgtattccagcttgaccaccagcaggcagaagccgaaacacaggcccaatacggtgatcagcagcatttcattgctttcgaacttggccacataggccagcaggcgcggcaccagcaaaatgccgatgaccagcgcgacgatcatgaacagcgagagcttgccaacggtggagaacacctcgccggagctgaccgtgccgctgacggcaatgctcgacagcaaggcgatgatgccgataccgaggatgtcctcgacgatcagcacgccgaagatcaattgggcaaagcgctggtttttcatcttcaggtcgttgagcgccttgacgatgatggtggtcgaggagatcgccaggattgcaccgaggaacagcgagtccatggtattccagtcgaaccaacggccgatttcgtagccgatccagatcatcaggatgatctccagaaaggcggcgataaacgctgttgcaccgaccttgaacagcttgcgcaggctgaattccaggcccaggcagaacatcaggaaaatcacccccagctcggcgagggttttgatcgtgtcttcgtcgtggatcaggccgaacggtggggtgtgggggccgatgatgaagccggcgacgatgtaccccagcaccaccggctgcttgaggcggtgaaacaggatggtgacaacccctgccaccaacatgatcacggccaagtcctggataaagctgatggcgtgcatggcgaggggctccttgtgggtactggcgcttttcccacttccactcgcccccttgaacggtcgcaataagcggaaggaaaagtcggccttgatcgtaagaaatgccctgagatgggcttttgaaggttaacaccgcgacttccggcagaaagccggtgcaatatatggaaacagatcggtgcaggcgtgacggcaagccgcccaccggcgtcccgttagggagagcgctgtaaagattccagcacccgcagaggtgccttcccaaccgatgcctacaacccgtgagtgtgctatggaacccggaaacgcccagctgtcgatgacggtattgatgacccctgacatggccaacttctcaggcaatgtgcatggcggcaccctgcttaagtacctcgacgaagtggcctacgcctgtgcgagccgttatgccggtcgctatgtggtgacgctgtcggtcgaccaggtgattttccgcgagccgatccatgtcggcgagctggtgaccttcctcgcttcggtcaactacaccggcaatacctcgatggaagtcggcatcaaagtggtgaccgaaaacatccgcgaacgctcggtgcgccataccaacagctgcttcttcaccatggtggccgtggacgaccagcgcaaacccgccgccgtaccgccgctgcagccgcagaacagcgaagacaagcgccggtttgtacaggcgcagcagcgtcggcagattcgccaggaactggaaaagcgctaccaggaaatcaaggcagacgggccgtaaaccccaagctgtaaacccaatcgaatgtgggagctggcttgcctgcgatagcggagtgtcaggcgacagagatgtcgactgtcaggccctcatcgcaggcaagccagctcccacattgggttttgtaggcttatagttcgatcggcgtggcttcaaaacgcacacgaggatgggcgatacgatcctgagcccgcaccagctccagctcgtaactggcgcaggcctgggtctccagcagcacttcatgcaccgccgccgccgtaaattcgaacgccgccaccaggctgtcgcccaacagcacccgcgccaggaacagccctgatgtcaggtcgcccacgcccaccggctgacgcgggaacgccagcagcgggcggcgcaggtgccagctgccttcagcggtgaccagcaacatctcaaagccatccggcagcttgccgggataatccaggtgcttgaccaaaaccgccttcggcccacgggccagcagcgccttggccatgcccaggcaatcgaacagcgactgcggcttgcgcccggcaaagctgtccagctccagttggttggggcagaggaaatccgccattgccgccgcctcatccagcaggaaatcgctgacttcctgcggcacgatgcagcccttttccgggtggcccatcaccgggtcgcacaggtacagcgccttggggttgatcgccttgatccgcgccacgccggtcagaatcgcacggccctggtcggcactgccgaggtagccggacagcaccgcatcgcagttgcccagctcaccaatcgcggcaatgccttccaccagcgccggaatttgctgcggcgccaacacttcgcccgcccactggccatactgagtgtggttggaaaactgcaccgtattcagcggccagacgttcaccccgacccgctgcatggggaacacagcggcgctgtttccggcgtggccaaaaaccacatgagactggatcgcaagcagatgaggtgtgcgtttcatgcaggagatttccgtaaagccgttgaaattctggccgcgcagtatgcgactaaacacagcctatacgacagaccggcgacacagttaagctgctctcactttgttggagttcatcgcatgctgaccctgggaaacatcttcgtgttgatgctgctggcgaccggtgccgcctgggtgtggcacaaccacggcctgcgcgagcgggcgctggagcgggtcaagcagcattgcgccaagcttgatatcgaactgctcgatggcgcggtggcgttgaagcgcatcgggttcgtgaaggatgccaatggccggcggcgcctggcgcgcatctataactttgagttcaccgtgaccggcgaagcccgccatccggggaccatcacccagtttggcgcccacagcgcgcaaatcgagctggcgccctacccgttcgagatcaagacgccgctgcccagcgctgaagtgatcgagctaagccagtggcgccaggaccacgcgagcaagaaccgtcactgacgacaggcggcgagtgcgctttgcaattcagtcacgtcctgtggctggctgaagatcaattcaatacgtgaatcacggcgccattcgctgggttgccaggcgagcgggctgttatccacagcgttggcgctgacccagcctgcggtactgtggataaccagcttggcgcggcgccattcaaggcgtgtcagccagctttgcaggcgcggtgtatcgaattgctggcttgggtgccagcgccagccgatgctccagccaccttcttgagcctggctgaggcagattggcacggccggatcggtccagattgccggcatctgcgccacgcctttgggcacatcgaagttatccacagcagcacggcctcgcgcattcaggccgggcaattggtcgagcggcagctgcgcctggcgcgtccagtagagcgggcagtcgggtaactgctgttcgatagcctggcgttgcgcggcatccagcgtctcatccttgttcaataccagcagcccggcgctggccagggtttcacgttgcgcctctggcaagggtttacccgctgccagcgcccgggcatcgagcaccagcacgcacggctgaaccgccagcacctcttgccacggcgcctgccgcagttgcttgagcaattgcgccgggtggcccaggccggagggctcgataaacagccggtccggcttggccttacgcaacaagcggcccaggcctacctggaagggtgcgccattcacacaacacaaacagccgccggccacctcgcccagggcaatgccgtcgtcgtcctgggtgagcaaggccgcgtccaggccgatctgcccgaactcgttgatcaacaccgcccaacgctcgttggccgggcgttgggcgagcaggtgtttgatcaggctggtcttgccggcgcccaaaggcccggcaatcacgtgggtgggaatgttctgcagcatcgggggcatcattcagaccgtgtagagcgctagatcctactcggttatgccagccaatccagcgtcaggatcaagcgccgctcatcgttcttgagcgcgggcgagcggtgaatcaggccgtgggcttcgttgccatgccatttggtgcccttgagcatggccacttcgccgcagaggatttgctcgatgcgctcgattggctcggcgtccggctggctgagcgtgcggcggtccatcacgccttcgcgcaaccactgactgccgatgccggcgtaggtggtaatcagccgaaccggcacgtggtcgacgtgaaaacgcgggcacatggccttgtccagcagccgcaggcgcacaccaatgcgccttgcaccgagtaaacaggcaaatgcgctgaccagccatgaaacatcggcgacaaagccgtcgtagccttcaagatcgcggcaactggatgccaaaccctgcaagttcggtgttgcgtcttcgtcgttgagttcaatcaccatggagtcggcgagcggctcgtcaagcgccaccagcaaggcaccaaattcggcgatgtgcagcggcagttggcgctgccaaaccgccaaattcacaccgtcctcaaggatgtcagccagcgccagaggggtttcaccacgtgtctggcgtatcacaggacgcaacgagataaccggggccagcatcaggctacctgctcgaaccaagggccaaacgggtcagccaactggcgccaaccttcgacgcccagggccatttcttcgtcggtgagcaagcaggcgtccagctcggcgcgcatctggctgaagtcgatattttgcccgataaacaccagttcctggcggcagtcacccgtgctcagctgccagttgcccatgatcgccgccacgctttcttcgtcctgcggccactggcttttcggcacaaaacgccaccagcgcccggcaaaaccatggcgcatcagcccgcccgcctgggaccaactgcccgcatcctgatgcttgctggccagccagaaaaagcctttggagcgcagcagtttgccgtttacccacgggcggtcgatgaagtcgaaaaaacgctgtggatgaaacgggcggcgcgcgcggtaagccgtggaagcgatgccgtactcttcggtttccggcacatgttctccgcgcagttcctgcaaccagcccggcgcctgggcggcgcgttcgaagtcgaagcgcccggtgttgaggatcttgttcagcggcacttcgcccatgaccatcgggatgatttcggcctgggcgttgaggcgttcgaggatcgccatcagttcctcgcgctcgcggctgctgatcaggtcgattttgctgatcaggatcacgtcagcgaactcgatctgctcgattaacagatcggtgatcgagcgttcgtcctcttcgcccagggtttcgccgcgtgaggccaggctttcggcggcctggtagtcgagcaggaagttcatgccgtcgaccacggtgaccatggtgtccaggcgcgcaatgtccgccaggctttgctcgttttcatcgcgaaaggtgaaggtttcggccacgggcaatggctcggaaatgccggtggattcaatcaacaggtaatcgaaccgaccttccttggcgagttttccgacttcttccagcaagtcttcacgcaaggtgcagcagatgcagccgttgctcatctccaccagtttttcttcggagcggttgagggtgacgtcgcgctgtacctcgctgccgtcgatgttgatttcgctcatgtcattgacgatcaccgccacccgcaggttttcgcggttgcgcagaacgtagttgagcagcgtacttttgccggcgccgagaaagccggacaacacggtaacggggagacgattgggcatcaggtattcctcatcaggggtggccggtcaaatcgcccgtttatggcgttcgcgcagctcttcacgttctttggcttcgatactcagggtcgcggtggggcgcagcagcaggcgtttcaggccaattgggtcaccggtttcacggcaccagccgtattcgccgcgggccagcaattccagggcgtcgtcgatcttgtccagcagcttcttttcacgctccagcaggcgcagttgccattggcgctgttcttcggcgctgccgacatcggcggggtcgctgttggtttcctgctcactcagcaccaggaactcggcttcaatgcggccctgcagttcatagcgctgggtcagcagcagcgcgcggaagaaaccctgctgggcttcattcatgtaatcggcgggcggttgggccaggaggtcttgttcagtcatggaaagcagttcacgggtcaggctgtgtttttatgttatagtataacaatgcaaataagccaatcccccttgctcgccacgacgaagggcgcaatgcttcaacacttccctaccccgagatgcgtgatgaaatacctggtgtgcgccctgttattggcagcggcaggaccggcctgcgcgcaaacgccgagcctgttggcgaactgcacgcgcagcgccaacctgctggcctgcgtggacccgttgggcaatgcctacagcgtcgcgacggtgggaagtaccacctacttgcgcggttttgaggtgatcggcaaacgctactgggcacagaccaacagccgttatgggcaattgacgttctttaccgggttggcgtccgatggtgaggcgtgggtcggctacacgcgccgcgtgggctggaccaccatcaaccggttttccagttccggtggcgccagcgccaagttcacgtgcagccgtgttaccggctgttaaacttggccgctcttctgctcttgaacccaggccatgtagctgttcatcggcgggttcttctcgaagtattttttcaggccgtcgaacaggccgtccgccaccgcctgctgatgacgcgccgtcaccagccgttgggcgtcctgggtattggagataaacccggtctcgaccaggatcgacggcacgtccggtgacttgagcaccgcaaaacccgcttgctctacacgcttctggtgcagcgtggtgatgctttgcaggctgcccagcaccgagctgcccagttgcaggctggaggcgatggtggcgttcatcgacatgtcgagaatcaccccggccagcatcgggtccttgtccttgagattgagcaaggtggtggcgcccagcaggtcggcgccgttttcgcgctgcgccatgaaacgcgcggtggcggacgtcgcgccgccttccgacagcgcgtacaccgaggcgcccgacgccgtgagccttggcgcggcatcggcgtgcaccgagataaacatgtcggccttgtgctgacgggcaatgtccacgcgcttgcgcagcggcacgaagaaatcgtcgttgcgcaccagtttcacgtcgaagcccttctcgcgcttcaagcgtttggccaacagttgggcgatagacaacaccacgtctttctcgcgctggcccttggagccaatcgcgcccgggtctttgccgccgtggccggggtcgaccaccacaatgatgtcgcgcttgggatgcgccttgtccaccggcgccaccaagggcggcggctcagcggcgatttgacgcggggcgcgggtggcgctgctcaggtcgagtaccaagcgatggccctggccatcctgcggcggcaacaagaagctgttgagctgcatcggcgcagtcaggtccagcacgatacgcgtatcacttttaccgaaatgcccggagcgaatcgaagtaatgccgctgttcttcaacgccaattgggaaaagtcacccgtgagcccggcgccgctcaagtcgatgatcaagcggtccggcgaggtcagggaaaaggtcttgtactgcaccgggccgctgagatcgaacaccagccgcagtttgtcgtcggagcgccacaggcgcgcattgcgaatttgtgtggcgaacgcccccaatggaaaggtgaacagtgggcttaccagcagcaggttgagtagctgacgtctgtgcatgacatataccgcaaatagaggagcgtccctgctcgacatgactgaagaaaggctggagcagaaaaatcatcgtcgactcaatagttataatataacatgtctttttatttccaacgatggacctgctcatgaatgcgctgactctgccggatatcgccgcgcaggcttcacgccaagccttgcccctcgactgggtaggcatgtgcggtatcgccttgccgatcctcatcgacggccaacgcctgaccgccaccgccgatgcgggcgtcagcctggacgacggcgaggcgcgtggcattcatatgtcacgcctgtacctggccctggaaatgctcgaccaacaggagctgacgcctgcgcttctgcgtactctacttgagcgctttcttgagagtcatgaaggtttatctaagaacgcctacttgcgaatccacactgatttgctgttaaaacgcccggcgttggtcagcccattggccggctggaaaggctacccggtgtgcatcgaagcacgcctggaaaatcagatgttccacgtggaactaaaaattgacgttacctattcctcaacctgcccctgctccgctgcgctcgccaggcaattgattcagcagcaatttctcgaagatttcgccaacacgccgttgcagcatgaagacgtgctgacttggctcggcagcgccaacggcatcgtcgccacgccccacagccaacgcagcagtgctcagctctccatccagctggatgccaaccagtccactttgccgatcaccaacctgatcgacgacgtcgaagccgccctcggcaccgccgtgcaaaccgctgtgaaacgtgcggacgaacaagccttcgccctggccaacgggcagaacctgatgttctgcgaagacgccgcccgccgcctcaacctcgccttgaaacgctcggatgccgtcaaagccttccacctgaaagtgatccacgccgaaagcctgcacgcgcacgatgccgtggctgaaagccgctggacgagagactctgcatgatcacctgtaacgctctgcgctggggcgcaccggggcaaccgctcaccccggcgctggatttgaccctggaaaaaggcagcctcaccggcatcatcggcgccaacggcaccggcaaaagcagcctgctcaaagtgatcgccggcttgcaaaagccgctggcgggcaaggtcagtgtggatgttccacgccgtggcggcctgtcattcctgccccagcaacaacacctcgacagacagtttccgatcagcctgcaagagttagtcgccgccggtttctggggcacccagctcacgccgccacaacgcagcgaacgcctgcaagccgtgctggaagattggtgcctcagcggcctggagcatcgcccgctgatggccttgtccggcggcgaactgcaacgcgctctgctcgcgcgcatgaacctggccgaagcgccggtgttgttgctcgacgagccccacgccgccctcgacgaagaaggccaggcgctgtgctggaaacacatccacgcctggcacgatcaaggccgcacgctgatcgtcgtttgccatgacctggcgtccgtgcgccaccacacccagaacgtggtgcagataaaaagcaccggctgcgtgttcgggcccagcaaagaactgatccgtccccaagcccacatgcaggtggcctgatgcacttcgccgcgcacttgtggatgcccttcctcgacttcgttttcatgcgccgcgcactcatcggcgggctggtgctcgcctgcagcaccgcgccgctgggtgtgttcctgatcctgcggcgcatgagcctgatcggtgacgctgtggctcacggcatcctgcccggtgctgcattgggcttctggttcgccgggctcagcctgccagcgctgaccatcggcggcctcggcgccggcctgagtatggccggtttatccgcatggatcacccgccgcaccggcctgcgcgaagacgccagcctcgccgccatctacccaatttcccttgccgccggcgtgctgatcctcggcatcgccggcaagcgcctggaccttttgcacctgctgttcggctcagcgctggccgtagacgaaaccaccctcaccggcatgctctgggtctccggcttcagcttgatcgccatggcgctgatctacaaaccgctgttgctggacaccctcgacccgctgttcctgcaaaccgtcagccgcctcggcccgctcgctcatgggttgttcctgacgctggtggtgctgaacctggtgatcggcttccaggctatcggcgcgttgatggtggtgggtttgatgatgttgccggcgattgcttcacggttctggagccggcgcctgccggtgttgattgcggtgtcggcggtgctgggatgcctgtcggtgtggttcggtttattgctgtcgttttactactcgctgcccagcggcccggccatcgtgctggtggctggcggcgggtatttgctttccgtggtcttcggtccggtgcacggcttgctgcgccgcccgccctctcttacatcccaatgaggtgtttcccgatgcgcgctctactcgtgctgttcagcctgctgctgccgttgtcgatggctcaggccgccgacaaactccaggtggttaccagcttcagtattctcgatgacatcacccaccagatcggtggcgatcacatccagatcagcaacatggtcggcccggacgccgacgcccacacctacgaacccaccccggacgacgccaaggcactgctcaaggccaaggtcatcatcaagaacggcttgggcttcgagccctggctggaccgcctggtgaccagcaccgaaaccaaggccacggtggtgaccgccagcaaaggcgtgatctcccacaccatggaagaagacggcgaaaccatcccagacccgcacgcctggcataacctggccaacgccgaaatctacgtcaacaacatcaccaaggcgctgattgccgccgacccggccaacaaagccgactaccaacgcaacagccaaacctacctgaaagaaatctaccgcttgctggccgaagccaaagccaagttcggcgcgctgccgccgggtaaccgtcgcatcgtcacgtcccatgacgccttcggttacctcggtcaggcctatggcattcagttcctggcgccacaaggcctgtcgactgagcgcgaaccgtctgccgccgaagtcgccgcgctgatcacccagatccgcaaagacaaggtcaaagccgtgttcatggaaaacatcaaggattcgcgcctgctcaagcagattgctgacgaaagcggcgcgcagatcggcggcaccttgtactccgacgccctcgccgccgaaggcccggccagcaccttcaccgggctgttcgaatacaacctcaacaccctgtgcgccgccctgagcaagccatgaccctgagcatgctcgacctggaaggggctgccctcggcagccgctttccactcgaacccgtgctcgacgccctgccgtggaacagcgatggcctgattgccgccatcgctcagcaacacggcagcggcgaggtgttgatgctggcctggatgaaccgccaggccctcaatgaaaccctggccaccggcgaagtctgctactggtcgcgctcgcgccaagagttgtggcgcaaaggtgaaagctccggccactggcagcagttggtcgaagcgcggctcgattgcgacggcgacgcagtgctgctgatcgtcgaccagcaaggcccggcctgccacaccggtcggcccacctgtttctacaacgccatcgatggcgcctacgttaatgtcattacggagcctgctgcatgatccgcaaaaacccttccggcgatttgccggtgattgccgaatcggcctacgtcgataaaaccgcgatcatctgcggcaaggtcatcatcggcgagaacgtattcgtcggcccctacgccgtgatccgcgccgacgaagtcgacgccaccggcgacatggacccgatcaccatcggcgccaactcgaacattcaggacggcgtggtcatccactccaaatccggcgcagcggttaacatcggcgagttcacttccatcgcccatcgttccatcgtccacggcccctgcaccgtcggcgaccgtgtgttcatcggcttcaacagcgtgctgttcaactgcgccgtcggcgatggctgcgtggtgcgccacaactcggtggtggatggccgcgacctgcccgccgccttttatgtgccctccaccacccgcatcgggccgaacaccgacctgtcgcaattcccgccggtcagtgtcagcgcctcggagttctccgaggacgtggcgcgcaccaacgtcgatttggtgcgtggctacaaagccttgcaaaacgagttctgaaccatgagccgcctgctgattcgcaatgcccgtctggtcaatgaaggccaggagttcgacgccgatgtactggtcgccaatggccgtatcgagaagatcgccgccagcctcgaaggctacaacgaaccggtggaaattgacgcacaaggtcagtggctgctgccgggcatgatcgatgaccaggtgcactttcgcgaacccggcgcgcccgacaaaggcagcttctacagcgaatcccgtgcggcagtagccggtggcatcaccagcttcatggacatgcccaacacccatcccgccaccttgaacctggaagccctggccgataaaaagcgccgcgccgcgttgcactcggtggccaactacggctttcactttggcgtgagcaacgacaatctcgacaccgtcgccgccctcgacccgcgcgaagtggccggggtgaaagtgttcatgggcgcctccaccggcaacatgctggtggacgacccacggattctggagcgactgtttgctgaagtgccgaccattctgctcgctcattgcgaacacacaccgagcatcctggccaacgaacagcgtctgcgtgagcgctttggcgacaacatccctgccgtcgcccacccgctgattcgcgatgccgaagcctgctatcgctcgtcgtcgtttgcagtggagctggccaagcgtcacggcacgcgcctgcatgtgctgcacctgaccagcgcccgcgagctggccttgtttgaagacaaacccctggccgaaaagcgcatcaccgccgaggtctgcctgcaccacttgctgttcgatgaccgcgactatcaccgcctcggccaccagatcaaatgcaacccggcgatcaagacccgcgccgaccgcgacgcgctgcgcctggccttgctgagtgagcgtctggatgtgattggcagtgatcatgcgccgcatacctgggcgcaaaaacagttgggctaccgcgaagcgccctccggcctgccgctggtgcagcacgcgttgccggcgttgttggagttggtgatcgacgggcatttgcccctgactacgctggtagcaaaaaccagtcaccgtgtcgctgacctgttcgccatcccggaccgcggctatctacgcgaaggctattgggccgacctggtgctgatcaagcccgagcccgaaggcaaacccgtcagcagccagccgattctcgcgcgctgcggctggacgcctttcgccgagcgcagctttcgccacagcgtcagcaccacgctggtgtccggccacctggcgtggcacaacggccaggtggtcgacagctgccaggggttgcccctgcactttttgcgttaagcgcggggtttgaccgtaccgcaatcgttgcccagccactgggcgtgcgtgtccaggctgcccttttgctggatgccggtggcattgaaggtgccgttcacggtggtggtgaattcctgctgactctggaacgtggcaacgccggtgccttgggctttcgggcagctgaaacggaatttccactggttgccggtcttgtcggttacttcctgtttgcagcccgactgcgggtcggtcaggggaatggaatccgacgcgacttgggcgggcgtcaggcaaacctgtacgcctttgccggccatggtgatgccttgtttttccagcatggcgcgctgttcgggtgtcatctgttgcttgagctgaccgaggatcagcgacaggtccggcaagtcctggttgtcgactttcatattgctggtggtcaattcccacaagcccggcgccagcatctgcgcctgagccgccacgggcagcgacaatccaacaaccatggccaaactgagcagacgagcattcatcgggtaactcctgggtaattgtgggcgttagacgccgcaaaggtgtcagtgttgcacggcaaataaaatagcgacattcactgcggttcatggtctgttaggcacttgattgcctggagttaagtcattcatggatttttttggcccgcacctgctcgcctacttcattgccacgttgcactttctcgggactctggccgcgatccacgcggtgctgacggtcaggacggcccaaggctcgattgcctgggcgttgtcgctgatgttcatgccgtacctgacgctgattccctacctgattttcggccgcagcaccttcgacgcgtacattcaggcgcggcgccaggccaatcaggaaatgcacaccgccatcaccgagctgaactggcgcccctgggtcgaagaagccctggccgcgcgcaactccagcgcctacggctcgctgcgcgccatgcccaagctggggcgcatgccgtgcctggccaacaatcaagtccgcctattgatcaatggcgacgccaccttcagcgcgatcttcgaggcgattcgcaacgccaaaacggcggtgctgttccagttcttcatcattcatgacgacgagctcggcaggcggttgcacgccttgctgaaagaaaaagctgccgaaggcgtagacattcacgtgctctacgaccgcatcggcagccacgccctgccccaccgctacgtgcaatcgctgcgcgacgccggggtcaaagtcaaagcgttcgccacccgcagcggctggcttaaccggttccaggtcaacttccgcaaccaccgcaagatcgtggtggtggacggcatcaccgggtttgtcggcgggcataacgtcggcgatgaatacctgggcaaaaaaccaccgctggcgccgtggcgtgatactcacgtacaagtcaccggcccggtggtggcgtgcttgcaggaatcgtttgccgaagattggttctgggccgcgcgcgaactgccgccgctgatcctgccggacgcttaccccgaagacggcgtgctctgccaattgctcgccagcggcccggccgacccgtacgaaacctgctcgctgtttttcgtcgaggccatccacgcggcgaccgagcgcgtgtggatcaccagcccatatttcgtgcctgatgaggcggtgttctccgccctgcgcctggcggttctgcgtggcgtagatgtacgcctgctgctgccgtcgcggcccgaccaccgcattgtgtatgccgcctccagcctctacgccatcgaagcggtgcgcgccggggtgcgggtgttccgctacaaaccgggcttcctgcaccagaaagtggtgctggtcgacagcgaaatcagcgccatcggcagtgcgaacatggacaaccgttcgttccggctgaattttgaagtgatgttgctgacggtggatgaggcgtttgccagcgaagtggagcagatgctgctggacgactttgcgttggcccatgaagtgagccaggaagaaagccgcgagacgcgccgcctgcaacagttgggcatgcgggttgcgcggcttatttcacccatcctctaacaaacaacacagaagcaaatgtgggagctggcttgcctgcgatggcggtgtgtcagtgacccataaggtcctgatacaccgccatcgcaggcaagccagctcccacagtttttgatccccagtgtgttttgaagatcagcggtaaatatcttcccgcgtccacggcagttcatggctgccatcggcatgcggtttcaccgccaatatctggtgcaggttgatccagccccgcgcaaacgcatacgcgcagccagccaggtacagccgccagatgcgcaacgcttgctccggcaccatcttcgccgccgcttccaggttgtcttccaggcgttcgctccaatggtccagggtgcgcgcgtagtgcaggcgcaggctctcgacgtcgaccacttccagcccgacttcactgatttccgcggtcatcatcgccaggtgcggcagctcgccattggggaacacataccgctcgataaaatccccggcgccacggcccacagggcggccgtcggtgtgcttggcggtaatgccgtggttcatcaccaggccgccttcacgcaccgcgccaaacaaggttttgcagtactgcgccaggttggcgtggccgacgtgttcgaacatgcccacgctcaccactttgtcgaaacggccgtcttgaggcaggtcgcggtagtcgagtagttgcaggtccacctggccttccaggccctcggctttgacccgttcgcgggccaacgccagttgctctttgctcagggtgataccaaacaccttgaccccaaactcacgcgcggcaaaacgcgccagcccgccccaaccacagcctacgtcgagcagatactcgcccggttgcaagcgcaacttgcggcacaggtggcggaatttgtcttgttgagcctggtcgatggattcgctgccggtttcgaaataaccgcaggagtacgccatgtcctgatccagccatagctggtagaactcgttggacaggtcgtaatggtaggaaatggcggctgcgtcagtagccttgtcgtggatcgagcgcaccggacgactcccctcgtcgtcatcgatcagggcgtgactcagctcgtcacacacccggatcacttcggtgatggagccttccagctccaatttgccctcgacgaaggcttcgcccaatgagtcgagcgttggatgggtcagcttggagacgaccgtggggtccttcaccacgatggtcacactgggctcggggcccaagttgaattcatggccgtcccagagtcgaagacgcagcggtagcttgagattctgtaaggccggtggaagttgcgcgagcatgagtagtccccccttgtttcagacgtctggagtgagggtagaccatccgaagacaaagtaggaggctatcgatttgatagcgctgatctatggggctcgaaactcgagcaaaccgtcttggatccactgtttcagccacgtaaccgcttgcagcggtgcaccctctccagtagtgactgccaactctgcacacagttctgaaaagttccagccggtggtcaccatgcctgccagcgcgcaggcttcatcaggctccaggctgcggtaatggcagacattctggtgacgccacaccaggcaaatctgcgccagttccagtgcgtggctatcgggaaagtccgactcatccttgctcgcgcgccagatcgccacactattgaaatggcacagcacctgctgcaccgacggcgccaggctcacctgcaaccccggccagtcttcaggcgccagttgcgccatgtcattgaggctcaaaggctcaccctgcggcgcatcgaaggcgagggtaaacgcccactccaatcgcgccagctcggccagcggcgcgctctgctccgccaccagatgctcaacgagaaatgccggaaaccgctcgcccaaccaacgcagactgtaatgggccgacggatagcgccgcacgtaggcgtctgtcagtaacgcgaattcgtcgtcacccaaccaataccagatggcgctgaagtcatggcgcaacacttcctgcagccgcgagacataggcgttgtgataaatcgccaggcccgtgtccacgtccagggtcggcccgcccagcaaggtggcggcaaagccactgttggccaccgagctttcggacaaaagatgctgttcaaaggccagctgccagtcgatcaggcgcataacgccctcctggccaacgcgctggcgcccagctcacgggccttgctcaactcggtgagcagctcttcgaacggcgggaaatggtcatcacgttccaacagcgtcgacaccggccccagcaactccagcgtctgttgataaagcgcccacaccgggtcgcacaccgggtggtcatgggtgtcgaccacgtagtcgccgtaatccatatgcccggccaagtgcagttggcggatgctttcgggcggcaggctgcggataaacgtccaggcgtcgaacccgtggttacgcgaactgacatacacgttgttaacgtccagtaacagttggcacccggtgaggtgggccaaggcgttgagaaactcccactcggtgaattcgtcggccttggagcgcacatagctggagacgttttccagcaccagcgggcgctgcaatacgtcctgcacttggcgtacgcggccggccacgtggtaaaggctttcttcggtgtagggcagcggcagcaagtcgtgcaactggtgtgcgctgccgcggctccagcacaggtgatcggaaatccacgcgggctgaatgcgctcggcgagctgtttgatgtgtttcaggtaatcggtatcgagggcatgcggccccccgatggacagggacacgccgtgcatcaccaagggatagcgctcggctatcgcgtccaggtaatacaaggctttaccgccctggaccagataattctcggagatcacttcgaaccaatccacggccggcgattgttcaaggatctgctggtagtactcactgcgtaaacccaggccgtaacccagactttgaacggacgcggacatgactcactccagggcaaagtgtccgcagcggtggggggcgtccgctgcgggtgcactcggttgccggttattcgccgacggtgccgccagccttcatgcaggcatcagccgaaggctgggcaacgaagccctggcctttgcaagaacccagacctttgcacgcgtggtccttggttttgcaatcgttctggcctttgcaggcgttgatgccgtagcagtgcacggcggccgtgtcagcggcttgagcctgagtgacaacaccagcaaacatggtagcggcggccattgcgagagcggcaccagcagcagcggatttgaagttcattttgtagtcctcatgatcggtagggtgtcggtccaaacggattgttcagtctcgacataccactagagtgaggtcccttatcggcgttacagctgtgtgcaaatatttctgaaaattattcttcgagcttcaaaagcggctcctgaaagcgcagcaaacgcccggcgttgcccagtaccagcaaggtgctgaggttatgcaacaccgccgcaatcatcgcgccagccgcgcccagccagccaaatgcggcgaacaccacgatggccagcgtccagcccaaaccgatgatcacgttgacctgcaacgtgtgtcggcactggcggctcaagcgcacacaggtgcccaggcggcgcaggtcgctgccgatcaacaccacatccgccgacgccagcgcgatgtccgccccgcccgcgcccatcgccacgccgaccacgcccgccttgagcgccagcgagtcgttgatgccatcgcctaccaccatcggccggaaaccgctgccgatttcccccagcacgcggttgagtttgtcttccggtaaagcctgggcttcgacatcgctgatgcccacgtccaatgccaggctatccgcaacgctctgacggtcgccggtcagcagcagttggcgacccaggcccagctcgcgtagctcttggagtgcctggcgtgcctccggcttgacggtgtcggcgagcaacagccaggcgaggaattgcccgttcaatgccagcccggcaatcggaccatcgtggttcggcacctcagtggtcacgatgcccaattgctcgaacaactccgggcgccccaaggccgcttcgccctgctcggtccgcgctacaacacccaagccctggcgttcgcgaatatccgtgagcaccagcatctgttcctgcgtcgccaagcccgccaacgcgcggctgaccgggtggctgctggctgagccaaggctggccgccaggttcagcaacacctgccgatccggcgctgtggtctcgatggattgcaaacgcagcgtgccaaacgtcagcgtaccggtcttgtcgaccactaaagaagtcaggtcggccagttcctcaagaaacgccgagctgcgaatcaagatcccgtgccgcgccgccaccgcaatcccggcaatcgccgtggccggtgccgacagcaccaacgcacacgggcacgccgccaccagcacggccaacatcgcctgggcgtcattggtcacaaaccaggtcaccgccgccagcagcagcaccaacaccatatagctgccggcataacgctccagcagccgcgtgatcggcggcttggaacgctcggcgttctgcatcagcgcaatgactttgcccaaggtcgattcatgacccgtgcgcgtcacttcaaggcgcagcaagccatccaggttgatcgcgccaccaaacacctgcacaccgacgctggcctccaacggcaccgactcgccagtgatcggcgccgtgtccaggctcgcctggcccgacagcacaacgccatcggcgggcacgcggtcaccggcgcgcacttcgacgatatcgccggtgttcagcgtgccgttatccacttccacaatgctgccgtcagcctgcaccaaccgcgcatggctgcgggtgagtttgcccaaagcatgaatcgcttcctgggagccaatcacgctgcgctcttccagcacgtggccgaaaatcatgatgatcggcagcaacgcggcggtcagcagatcgcccgtggcccacgcgccgatcatcgctagggcgatcaattggtcggtgatgccatgcaggctcgggtaacgcaggctgtaccaggccgagcgcatcaccggcacggcgaccagcaaggacgcgacgccgagcagcagttggctcacgccgttctggtccggcgccagccagcgccacaccaggcccaataccagtaagcccagggccaacatggccaaggtcaattgccgcgcagcactgcgctgttcggcggaagtcagcataggcgcgctcattgttcggctccctggatgatcaaacgggagtcgtctttaggatcgaccgtggtcacggagccggcctggccaagaattttcggcagccgctcgcggtacagacgcagcaacaaacctgggtctttaacctgggccaggctggcgaccgtggcggtttgcgcctgggcattggccaggcgttcactggcctgggcgtgggcgacttgcaccagccggtcagcctcttggttggcggtctgggtgagtttttctgcgtcggtacgcgcattcgccacggctttatcggcttgctgactggcggtcagcacggcattgaacgcattcactgccgggcccggcaggctcgattgcacgtcgacacgggtcacttcgatgcctagccccaaaccggtggaggccaattccgtcaggcgcttgttgatgccttgcaccaagtcgccacgcaaccgctcacgacgctcggcggcgccgttgtcgctgccgatcagttcagggcgtgccaccagaatcgtgtccaggtcgcgcgcggccgtcagcgccaccgcgctgcgcgtcaccaagcgatccagcgccggcagtacgtgttcgccttgcaacacaaacgcgtagggttcggtgaccttgtaaaacacccgcacatccagctgcaccacgccggcatcgccggtcagcaggtaaccggaacccgccagggcatcgctcaagggcgtggcaaaactggccacgcggtcggcctgggtcgccgtatcggagcgcaacaggttctccactcggcgctctatcactcgatcggcggccggcaacaacatcacctgctcgaacggctgcggccacgccaataacagcccggcgttctgaatgcggtcgagggcgccgaagtgcagcaccacggcgcggttctgcgggtcgatctggcgcacgttggaaaatgcccaggccaacgccgccaacacggtcaccgcgtacagcgccaggaaggtcaggcgcccggcctgaatccacgggctgtccgggctgtcacgctcggtcatggctgaacatccttcggcccgtccaccagcgcgcgaaacggcgcggcgtcggtgcgcaggatgattttggtgcccggcgtcaccaccgtgcccaaggtgtccagcgagcgcagcaagttgtacagctgcggattaccggcgtaggcgcggccataaatctgcgccgcttcaacccgcgactgcgcttcgatatcggcggctttcaccgtggcgtcggcctgcacgatgcgcgcatcgcgttcggcggccgagcgaatctgcgccgcttcacgcttgcccacggcggtgcgttcggtggcgatggtttcgcgctcggcgcgcatgcggtcgacggtggccgtgagggttaccgatggcaaggtcaggcgctccacaccgacttgcgccacgcgcacgccataagtggtgagcaactgttgatcaatctgttgacgcaactgcgcctcgaaatcggcgatgcgcacttggctggcgtcggtgttgatcaggctcgacaggtcaaagctggccgcggtggtttccagcgccgagccaacgaaggtgcgaatctgtcgcgccgcttcatccggctggttctgcaccgcacgcataaagcgctgcacattgtcggcatcgccctgcacctgccacgccacataggcctgcacgataatgcgcaggccgtcgcgggtgcccacatcctgcaaaccgctggaggtggtgcgcaaacgcaggtccaccgggatcgccgcttcgaacggcgccggccagcgccagcccaggccgggctccaacagcacccgcgatgggttgccgaaccgcgtaatcaccgtggcttcgcccgaacgcacctgcaccaggctagcagccgccacggcaaacagcaccagcaacaccgcccaggccatgcgccgccaaggaaatgggccagcggcttgttcatcaccgtgatggtgatgatggtggccgtgagggtggtgatgaccgtgatcgtgagaatgagcgctcaacagacagactccttattgaacggctttacgcggcgccatcgggtcggccggcaaagtaaaagaacgcagatcaatcgtcggcgcgccatcggcgcccaggcggtgatccagaataagcagcttggcgtgggccaggccttggctgagttggccgaggtactgttccagcacgaaggcctggcctgcagcggcgtaggctttttgttcggcgctgaaacgcaggtcggccgcttgggccccggcctgcacttcacgcgcagtggccaaggcctggtcgcgggcggtgctggcttgcagcaaggcctggttggtctgttcgctggccgcgccgcgctcgcgggagatcagcgcctgagccccaatctgcgccgcctgcacgccgtggtaagcgttggcggcaccggccggtgggtgaatcgcttccaccaccgtggccagaatttccacgccgctgtcgagtttttgcaggtccgcctgcaccgagcggccgatttcgtcggccagctgggtgcgttgctcgccgagcaattcatccagcgtgcgcgaggcaaagtcgtgaaccagaatgcggctggcggtgctgcggatcagggtcggcacatcggcgctgttataggtggcggcgagcgcggccttatccgtcaggccgatgcggtagacaaagcgcacgtccatattgacgatctggaagctctgtttgtcgccactgctgctggcaatcacctgggccttgtcattcacatggcttgcgtcccacaagcggttggcaatcgtcggcgccgggccttcagcagaagccagctccggtgcggcagcttcgctgacgctggtggccagttcatgcaccacaccgttttccacgtttatgacgcggcccaacggccagggcaacccggcatgcaagccagggccgaacacttccaccggtttgccgaagcgctcataaatcccacgaccttgcaggggcacttcgtgcacgccggtcagcgcccagccgacagccagcaccaccagcagcaccggcaggaacgcccgacgcatgtaggtaaaggcccagatctggcgcaggtcgatgccaaagcggttgtgcaactcgtgctgcaacgccagcaacggctggggcggccagcgcaacagcccggcgataaagctctgcgccatcaaacgcggttcaaggcgtggctggcgagggctgaacagcgaaaggagggcccgcagcaaaaactccactgcgaccagccccggcagcaggccgatcaacacggccaaacgcaatggccacaccgactccgcaccggcaaacagcaggcaaatcgcgctgaccaccaggcaggcaatcgccacccggctcaactgcgccagctgcgaggcttccggccattgggccgccgtttcctgcgccaagcggcgttcgaacaccagtaaaccaaaggccaacgccaacccaagcgcagcgccgatactcgccgattgccccaccggcgcggcgggcaacgccaggttccagaactcgatgatgctgaccaacgccagcaacgaccagccactcagccacagcaccggcgcgccaacctgcgcaagcaggccgctaccgaaacgcccgagcaggcgcgtgtacccgccggtgtcttcaaccggcagttcgatcacttcagccgtcggcgcttccagcgcctgggcgcgccaatcggcgacccaccacgccgattgcaacccggccaccagcaccagcaaggccgacgcgcagttgatcaacaccaccggccagatcgacagcggcgcaaacagggcaacaaacaacgccagcacccaaccgcaaacggccagggcggtcaggctgatgcccgcctggcgtaatcgacgggcatgaaacagcccctgctgaaaacgcggcaggccttccaccgaagcgccgtcagcttctagatccacttgcatccgctcaacgcccgcttgtacataattcgttacgatataacacgcagcgtgaaatttttgttcgaaaacaacacaaaaccccttgtgggagcgggcttgctcgcgaatgcggtgggtcagtcagcgatgtttaacttgatacaccgctatcgcgggcaagcccgctcccacatttatccttcattgcattcgggagcgtgactaaacccccagaaacacgagccatcactggtgcaggcacggattaatcggcacactccaacacagtttttcgcgggtccacggacaaggaagcgtcatcccccatgatttcgatctatcagctcaagccgcgttttcaaaacctgctgcgcccccttgtgcagcgcctctacgacaacggcactaccgccaaccagatcaccgtgctggccggcgtggtttccctgctggtcggcctgctgatcgcctgctttgcccaacacctgtggctgtttgcgctgatcccgttgtggatgatcctgcgcatggccctcaacgccatcgacggcatgctcgcccgggaattcggccagcagtcgcgactgggcgcctacctcaatgaactgtgcgatgtgatcgccgacagcgcgctgatcctgccatttgcgctgattcccggtgtgagcctggcgccggtgctgctggtggcattgctggcggtgttcagcgaatacgccggtgtgctcgggccgatggtgggtgcatcgcgacgctatgacgggccgatgggcaagagtgatcgcgcctttgtactcggcgtgttggccaccggcgtggcgctgggctggctcggcgcaggctgggtcgacacggtgatgtggctggtcgccgccctgctcgcctacaccttggtcaaccgtgtgcgccaaggtcttaaagaaacgacttccccttctgcataaggaatttgcgatgcgcgaacagcaagagcacaccttcagtacccatgatggcgtcgagcttttctaccggcactggccggccaccgccccgcttggcgatgagccgcgcaaggcgatcctgctgttccatcgcggccacgagcattcggggcgcattgcccatttggtcgatgaactcgacctgccgcagttcgacttcttcgcctgggacgcccgtggccacggccagtcgcccggcgcgcgcggcgacagccccagcttcgccaccagcgcccgcgacgtgcaaaccttccgcgaccacatcggcgacacctacggcatcgaagaacaaaactgcgcggtgattgcccagagcgtcggcgcggtgatcgcagccacgtgggtgcacgattacgcaccgaaaatccgcgcgctggtgctcgcctcgccggcgttcaaggtcaagctctacgtgccgttcgcgcggccgggcctggcgctgatgcgcaggtttcgcggcaactttttcgtcaacagttacgtcaaggccaagttcctcagccatgaccctgagcgcgtggcgtcctacgacagcgacccgctgatcaccaaggcgatttcggtgaatgtgctgcttggcctgtacgaagccgccgaccgcgtcgtcgctgatgcccaggcgatccaggtgccgacgcaactgctgatctccggctccgacttcgtggtgcaccgcaaaccccagcagcaattcttcgaccgcctcggcagcctgaaaaaagaactgcacatcctgcccggcttcttccacgacaccctcggcgaacgcgaccgcgccgtggccgtgagcagcgccaaacgctttatcctgcagaacttcgcccagcctttggaccgcgcctcgctgctggacgccgacaaactgggcgccacctgcgccgagtccgagtccctggccgcgccgctgccgcgcaactcgttgcgtgacctgtactggcgcatgacccgcgccagcatgggcctgggcaagaacctctcggacggggtgaaactgggcttcgacaccggcttcgactccggcagcaccctcgattacgtgtaccgcaacaagcccaccggcaagggcgggttggggcggatgatcgacaccaactacctcaactccatcggctggcgcggcattcgtcagcgcaagctgaatgtcgaagaactgctgcgcctggccatggccaagttgcgcagtgatgatcgcgaagtgcgcattgtcgacatcgcggcgggccacggccgctacattctcgaagccttgcagggtgtgtcgccgctgccgcaatcgatcctgttgcgcgactacagcgacatcaacgtacgcgacggtggcgcactgattcgcgaaaaaggcctgggggatatcgcccagttcgtcaaaggtgatgcgtttgatcgcgcggacctggcggcgctggagcccaagccgaccttggcggtggtgtccgggttgtatgagctgtttgccgataacggcatggttggcggttctctagccggtctcgccgaagccgtggagccaggcggttacctggtttacaccggccagccgtggcacccgcagctggagctgatcgcccgcgcactgaccagccatcgccagggccaggcctgggtgatgcgccggcgcagccaggcggaaatggatcaactcgtcgaggccgcaggctttcgcaagatcactcagcgtgtggacgaatggggcattttcactgtgtctctggcacagaagatctgagcatgcgcgaacccggcctattgaaaccagcggtcctgtggctgctgctgttggcgccgctgtttttcagcacctacggctttgccacgtgggtcaccagccagcgcagcgacgtgggcacgctggtgttcggctgggaaacccatatgccgttctgggcctggaccatcgtgccctactggtccatcgacctgctttacggcttctcactgctgctgcccaacagccgacaagaactgaaacaacacgccctgcgcctgctgacggctcaagtgattgccgtgagctgcttcctgatctggccgctgcgcttcaccttcgagcggccggagctggacggcgtgttcggctggctgtttgccgtgttggcgggcttcgacaagccgttcaaccaggcgccgtcgctgcacatcgcgctgctggtaatcctgtgggtcatgtaccagcgccacacccaaggcttttggcgctgggtggtgcacgggtggttcgcgctgatcggtatttcggtgctgaccacttatcaacatcactttattgacttacccacaggcgcgctcgccggctggctgtgcgtatggctgtggccgctggaacacccaagcccgctgttgaatgtgcggcttacgcgggaccgaaaacgctggcgtctgggcgtgcgttacggcctgggcgccgtggccttggtgattctcgcgctggcgctaggcggctggtggttgtggttgctgtggccggcggtttccctggggttgatcaaggccaattacttcgtgctgggcgcgccgggctttcagaaacgcgccgatggcacgctgacgcccgccgcgcgctggctgtatgcgccctacttggcggcggcgtggctcaactcacgcctgtggacacgcaagcatccacagccggacctgattgtggataacgtttggcttgggcgaattcccacgacggatgagcaaggttcattcaaggctatcgtcgatctctgcgccgagttgccgattaatccacagggccgtgggtatgcatgcgttccggtgctggacctgatcgcgccgacacccgccgaatgcctgcacgccgcgcaggcgattgaacgcttgcgcgcaaacggacctttactggtgtgttgcgccctcggctactcgcgcagcgccaccgccgtcgccgcctggctgctgcacagcgggcgcgcggctacggtcgatgcggcactggctattattcgtacagcgcgggcccatgtggtcctgcatcctgctcaccgtgaagcattggagggcttagcccatgcccgctgatatggaactccaagtggtcgccggcctgctgcgtcgcggccgctcgctggatcagttatccactggcctgacgctgctcggcgtgttattcggcctggctcaactgctgatggcaagcatttcgccgatctgcctgctgctcagcctgtggatgattatcctcgggctgctgcaaaagtactgggcgctgcgcgtcgccttcgatgccgacctgttcgccctgctcgcccgcgacaccgaccgcaccccagaccttgaccaggccctgcaaagccttggcctgcagtcggccaaacgggctggccggccctggaccgaacgtcgtcgcggcgccctcaaactgctgcgcaagcaagcctggctgttgggtgcgcaagtgctgctgaccctggccgtgatcctcgccagcccttggctacctttcgccggataaggaatccccatgttcgaacccgtggttgccaccctgatcacttcaatggcccgcaccgtcaccggcgcccgcagcctgtggctgggttgtgcgccggtgccggtgcaacgcatctatttcgccaaccacagcagccacggcgatttcgtgctggtgtgggcgtcgctgccgcagaacctgcgcaagttcacgcgcccggtggccggcagcgattactggaataaaagtgcgctgcgtcgctacatcatcaaccgcgtgttcaacggcgtactgattgatcgcgaacgcaaagaccctgtggataacccattgcagcccatgctcgcggcgctggaaggtggcgactcgctgatcatcttccccgaaggcacgcgcaatctcgaagacggcctgctgccgttcaaaagcggcctgtatcacctggcaaaaagttacccacaggctgaactgatcccggtgtggattgccaacctcaaccgggtcatgcccaagggccgcgtactgccgctgcctttgttgtgcaccaccagcttcggcgcgccgctgcaattggaagacggcgaagacaaagccgccttcctcgcccgcacccgcgacgccctgctcgccctcgccccggagcatgtctgacatggatagccaaaccctgatgttgttcggcggcattggcgccatcctggtgcttgcctcgctgatcggcctgatcctcaagctgcgcacccgtggcacgccgaatgcggtgatcgacaacctcaacgcgcgtatcaacgcctggtgggtgatggtggtggtgatcggcatcgccttctggctcggcaccggcgcggtgatcctgctgttctacgcggtgtcgttctacgccctgcgcgagttcctgaccctcacgccgacccgccgcagcgactacccggcgctggtggccgcgttctacctggcgctgccgctgcaatacctgctgatctattccgactggtacgggctgttctcgatctttatcccggtgtacgtgttcctgctgctgccgatcctcgcctcgctgggcggcgacagcacgcacttcctggagcgtgcatcgaaggtgcaatggggcctgatgatcgcggtgttctgcgtgtccttcgtaccggccttgctgaccctcgacatccccggctacgaaggccgcaacctgttgctgatcgcctatctggtgatcgtggtgcagctgtcggacgtgctgcagtacgtgtgcggcaagctgctcggcaaacacaagatcgcgcccaacctgtcgccgtcaaaaaccgtcgaaggctttgttggcggcattctgctgtcatccctgatcggcgcggcgctgtggtggaccacgccgtttaacccgtggcagtcgttcttgatcgcgttgctgatcaacctgctcgggttcgctggcggcattgtgatgtcggccatcaagcgggaccggggcgtgaaggactggggccacatgatcgaaggccacggcgggatgctggatcggctggattcagtgtgttttgccgcgccgattttcttccaccttgttcgctactggtggacctgagaaataccacctaacgctcaacgcggatcaactgtgggagctggcttgcctgcgatagcggcgggtcagcaacccatctgttgactgatacaccgccatcgcaggcaagccagctcccacagttattttgcgctgtacgatcgttcccacgctccgcgtgggaatgcatcctgtgacgctccgcgtcacggctctcagagtggacgcagagcgtcctcggcggcattcccacgcggagcgtgggaacgatcagccagctcccacagtggtttggcggggttttgaagtgctcagcccggcaagtgccccagcggcaaggcgcctggggttttcacggtctggatcgcgaagttgctgcggatgtccctcacgcccggcagctttaacaggctgccggtgacaaaccgctcatacccacgcaaatccggcaccactacctgcaacaaaaaatccgactcgcccgagaccaaaaatgccgagatcacctcgggcagtgcggtcaccgcttcgcgaaaggcattcgcctcggtgtcgttatgccgctcaaccttcacgccgacgaacaccatcatgcccaagcccacttcatcgcggtccagcgtcgcctggtagccgcgaatcaccccggcttcttccagcaggcgcacgcggcgcaaacacggtgaggcagacaggccgatctcatccgccagttgcacattgctcaggcgaccgtcgcgttgcagggcttcaagaatcttgcggtcaaaggcatcaagttttagatttggcataagtgaagggtcactggcttggtttgtggcagagaatgccaagactagacgattttctggctgactacgcaagcacctgccctgcccttgcatcctagaattggccaaccaatctagggggttgaacatgacggaactctggttatttctggtggccctttcggtcgcgtatctactgccggggccggacatgatcctgttgctgcaaaccggcgcgcgccaaggcaaggcgttggcgctgaccacggccatcggcttggggctcgcgcgggcctgccatgtggcgctggcaggcatgggcctggcaacgttgttcaaggtggcgccgtggacgttcgatgtggtgcgcctgggtggcgcggcctatctgttatggctgggcgtgcagtgtctgcgcgcgaatatgttgccttcgcttgaggcaaaccacggcgccccgccagcacatgcctggcgcgcagcctttcaacgcggcctgctgacgaatctgctcaaccccaaggccttgttattttgctcggtgctgctgccgcaattcatcaacccgcatgccggcccggtggcggcgcagtttgcgttgctgggggtgattctggtgggtgtgggctttgccttcgactgttgctacgccctggccggcgcacgcatcggccactggttggcgcgcaatcgctcggcgcagcgtctgcagcaatggttattcggcagtcttttgatcggttttgcggtacgcctcacctttgtgcaacacgcctgagcctgtgcggtgtatccacgtcatcttttgtatcaaagacgcgtgtaagatacgccgcacttagccagggatgctcaccatgttcgattcgttgaaagcgatcagtcgccgttttctcggcctgttaaccactgtggtgagtgccctgttcggccaatggcaaccgcccttctggctgcgcgccatcggccatggcctggggaacctgggccgcaaggctcgcgcttacccgcgccaggccggtgccggggtgctgggtctggtgttgctggccgctgccggcttctacggctggcactggtattcaaacctgccgcagccgcacaccgtcggttattcgctgcacaaaccaaacctgacggattacacccagcaaccgctggttgtggataacttgcaggtacgctttgccgaatccgtggcgccgttggcggcgattggcaaaccggtgaccgaaggcattaccctcaaacccaccgtggcaggcgcctggcgctggtccgatgaccgcactttattatttgtgccggaaaaagactggccggtagacgcccactacacgctggacctggcgaagaaaaatctcctggccgacggcgtgctgctcagccaatacagcagccagttttccacccaaccgttccgcgccaccctggcgcaaaacgagctgtaccaagacccgtccaacccgacgctgaagcaactggtcgcgaccttccatttttcccacccggtggatgaagacaacctacgcaagcgcgtgtccgtaaccctcggcaaaggcctggcctaccgcgacgcgcagttgcccaaccgcccggaaatcaccttcgacgacaccaagctcaacgcttacgtacgctccgccgccctggccacgccgctggaaagcacgccggtcagcgccaagcttgatgaaggcatcaaggcccgcgacggcggcaatgccagcaccgcaccgctggtggcggaagtcaccgtgcccggtcgttatcgcctgacgttcaccagcgccgaagtcagttttgtcgataacgagcgcggtgagccggagcccgtgctgatgttcagcagctccagcgccgtagccgatgacaccatcgccggtaaggtccaggcctggctgctgccggaaaaagcccaggacgacacccgcccctacaccagcaacgacatcgacgacgcgatgctcgcccgcagcaccaaggtcaacctgacccacgtgcccagcgtcgagccgctgaacaccttgcacgctttcaagttcaaggccccggctggccgcgcgctgtatgtgcgcgtgcccgccaacctggaagccatcggcggctacctggcgaagaatcctacggcgtccttgatcagcatgccggcgtatccgcgcacgctgcagtttctgtctgacggcgcactgctcagcctcaatggcgaaaaacgcctgggcttcatggcccgtggtgtgcccggcgcccacgtggaaatcgcccgcctgctgcccaaccagctgcaacacctggtggaccagagcagcggcagctttgcccggccaaacttcggcaatgaatacttcgaccgcatggtggagcgtcagtcgctggatattccgctgtcgtccaatgacccggcaaaaaccgtgtacgacaacgttgacctgagccactacctcaccgccaatggcgggcgtcgcggcattttcgtgctcaagctgagcccgcaggatgacccggccccgcgtacgttcgaatatgaccgcagcagcaccagcgatttgcgttttatcgtggtcaccgacctcggcatcatcgccaagcgctccagcgacggcagccatgatgtgtacgtgcaatccatcggcaacggttcgccggaggccgatgcgcaagtcgacatcatcggccgcaacgggctgccggtcagcagtggccgcaccgatgccgaaggtcacgcgcatttcgccaagctggatgaactgcgccgtgagaaaacgccgctgatgtatgtggtcactcgcggtaacgaccaatccttcctgccgattgcgcgtcagtcccagcagctggatttgtcgcgcttcgacgtaggcggtttggaagaagacggcgcgattgatcgcctcagcgcgtacctgtttaccgaccgcggcctgtatcgcccgggcgaaaccgcgcacttgggcatgatcgtgcgcagcggcaactggaaaggcgccttgcaaggcctgccggtggagctgcaaatcaccgacccgcgtggtctggaagtgattcgccagccgctgaaactgtccaccagcggttttgaaacctttgatttccccagcagtgaagtcgcccctgcgggcgattacaccgcgaccttgcagctgattggccagaaaaacacccgcactgacctcggcagtgtcagcttcaaggtccgcgacttcgagccggaccgcatgaaggtcagcctgagcctgcatgacacgcctgtgttgggctggattccaccggaccaggtggtggccaaagttaccgccatgcacctgttcggcgccccggctgccggtcgtcgcgttaccgccaaaatgtccctgagcccgacgctcgcggccttcgaccgttacccggattaccgcttccgcctcaacgactcattggaagacgccagcaccgaagacctcgcggaaaccaccgtcgacgacaacggccaggccgtgctcgacctcaacctgcaacgcttcgccaacagcacttatcgcctgcaggtgatgacccaggtgttcgaggccgaaggtggccgtaacgtggcggcgcaaagtgcgctgctggtgtcgtccgcgccctatctggtcggtgtgaaaagtcaggactcgctgtcgtacgtcgccaaggacgccccgcgccaagtgcaatggctggccgtcgcgccggacctgacgccactggcggtggacggcctgaccagtgaggtggtcgagcaccgttatgtgtcggtgctggtgaaacagtccaacggcacctacaagtacgagtcgcgcatcaagaacatcagccagccggccgcgccgctgacgatgaccaaggacggcgccaagcaggccctgaacaccggcacgccgggcgattacaccctgcaactcaaagacgccaacggcaacctgctcaaccagatcgactacagcgtggccgggcgtggcaacacctcgcgctcgctggagcgtaatgccgagctgcaattgcgcctggataaacgcagctatgccaccggtgacgagattgcgatcagcattcgcgcgccgtacaccggcgccggcttgatcaccatcgagcgtgacaaggtctacacccagcaatggttcaaggccgacagcaccaacagcgtgcaacatatccgcgtgcctgcaggccttgagggcaatgcctacgtcaacgtgcagtttgtgcgcgacatgggctcgtccgaggtttatatgagcccgctgtcctacggcgtggtgccgttcagcatcaacctggatgcgcggcgcatggcgctgaaggtggaaggcccggcgaagatcgaaccggggcaaaccctggacatcaaggtcaccgccgaccgcccaggccgcgcggtggtctacgcggtggacgaaggcattctgcaagtggcgcgttaccagacgccggacccgttgggcttcttcttccagaagcgcgcattggaagtcggcaccagtcagattcttgacctgatcctgccggaattcagccgcctgctcagtggggcagcgcccggtggcgatacggaaggcgccctggccaaccacctcaacccgttcaagcgtaaacatcagccgcccgtggcctggtggtccgggttagtggacctgccagccggtgaaaccgtgctgcattaccaggtgccggacagcttcaacggcaaactgcacctgtttgcggtggcggtggatgccgacagcgtcggtgtgagcgaggccaacaccgacgtgcgtgggccgatagtgatcacgccgaacgtgccggcctttgtcgcgccgggggacgtgttcaatgtgagtgccggggtgttcagcaacctcgatgcggcggcggacgtgaagtttgagctgcaaacaagcgacagtctcaacgtgcagggcgacaaaggcagcaccttgtcactgcaaccgcgcaaagaaggcaccgccgaattcaagatcaaggtcggcgaaaccctcggctcggtggacctgcgctttatcgccgtgctgccggacggcaagcgcattcaggtggcggaaaccacctcgatccgcccattgagtgagcaccgtgtggccttgagcctgggccgtttcgacagcgccagcaaagagctcaagccgacccgcgagctgttcagccaactgcgcgacgtgcagttgggcgtggcggcctcgccgctggtgtgggccaacggcctcaagcattacctggatgactacggctatgcgtgcaccgagcaattggtgtccaaggccatgccggcgttgatctggggcggcaccgcacccgaagcagagcaagccttcagcagtgcggtgcgcatgttgcgccagcgtcagaaccaggccggtggtttcggtttgtgggccgccaacccggacgtggcgccgtacgccagcctgtacgccaccgacttcctgatcgaagccaaggaacgcgggctgccggtgccggaagatgtgctggtgcgcgccaatgcgtatctgacagacctggccaacggcccgagcgaaggcctgtcggaattgcgcaaccgtgcctacgccagttacctgctgagccgtcaggggattctggtaagtggcgccttgagcgacattcgcgagcgctacgaaagctatttcaaagacacctggcagaacgacctgggcgccgcttacctggccgccagctacaagctgctcaaacaggaccgccaagccgatacgctgttccgcaaaatcccgtggcgctcccttttggataagtgggacagcgacggcctgtattacgacccgctggtgcacgacgccgaacacttgcacctgctggcgcgccacttccccgagttgctggacgatgtgccgactgccttgctggataagctcggcaagcgtcttaacgagcaacgctacaactcgctgtcggccgcgctgctgctgcgcgccctggacaactatggccagcgcgcacagagcgacatgaccctcaaggccaccgcgtggctgggcgacaagcagcagcaattgctggagatggccggtcagccgccgcgcgccgccgtgccgggcgccacgcaaaagctggtgctggaaaaaaccgacggcccggccgcgttctacatgctcagcgaagccggtttcgacaagggcgccaagctcaagccgatcaacaatggcctggaaatcatccacgaatacctcgacctcaaaggcgagccggtgagcaaagtggcggtgggcgatgagttcctggtgcgcctgcgcctgcgcgccaccgaccgcgaccaagtgcagcaagtggccgtggtcgacctgctgcccggtggcgtcgagcctgtgtataacttgccgccagagccggaagccgccagcgccgatgaaagcgaaggcgacgattcggagtacgtggaaaccgccgacggtgacgaggccgatgcctggcaggcgccgatcggcgaaaccgagctgagtaactggcagccggactacgtggatgtgcgtgatgatcgcgtggtgttgtacggcaccgcattgcgcgatgtaggcacttttgtctaccgcgtgcgcgctaccaacgccggcaccttcaacacgccgccggcctacgccgaaggtatgtacgaaaccaccctgcaagggcgcggcaaagtaggccagcttgaaattaccaagccttaaacgcctgacgccgctgctggcagcggcggtggtgttggcggggctgcggctgtggccgcatgccccgctggaacaggccgtgacctcgtcgcgggtggtgttggccgacgacggcgcgctgctgcgcatgacgctcgcggatgacggccaatatcgtttatggctgccgcttgcgcgcatgtcgccgtcactggtcgaagccttgctgctcaaggaagaccgcaatttctattggcacccggggatcaatcccccggcgctgctgcgcgcggccatggccacctacagcggcggccagcgccagggcggttcgaccttgagcatgcagctggcgcggcgcttgtggaatttgaacactcgccaggtgccaggcaagttgcagcagatggccttggcgctgtggctggaagcgcgttacagcaagcacgacatccttgaggcctacctgaacctggcgcccatgggcggcaatatcgaaggcgccgaggcggccagccggatttactttggcaagtcggcggcgcagttgtcgttgtctgaagcgctggcgctggcggtgattccccagcagccggggctacgcgcgcgcttcgggccatcgctgcaaaatgcgcggctgcgcttgatggccgattggcgcgagacttatccacaggacccgcgaaacgacagtttgctcgacttgccactggaagcgcgcaaccgccagcagatcccctttttggcgccgcacttgagtgaacaactgctggcgtcccagcccggcaacgagttgaacagcacgctcaacctgcccttgcagcaattgctcgaacgcctgattaccggctttatcgccgagcggcgcagcaccggtgtggaaaacgccacggcgatcctgatcgacagccgcgaccagagcgtcaaggcgttggtgggctcggcggattacttatccacaagcatccacggacaggtcaacggcgtaacggctcggcgctcgccggggtcgaccctcaagccgtttctgtatgggctggcgctggatcagggtgttatccacccgatgagcatcctcaaggatttgccgagtaacttcggctacttccaaccggaaaatttcgacggcagttttatcgggccactgacggcgcgggatgctttgatccgtagtcgcaacatcccggcggtgtggctggccagccaggtgaagtcgccttcgctgtacggcttgctgcaacgcgccggcatccagggcttgcgcggcgagagccattacggcctggccttggctctgggcggtggcgagatgacgcccgaagaactggcgcggctgtatgtgatgctggccggcgatgggcacctgcggccgttacggtatttgcaggaacagccgcaaaccaccggcccgcaactgctcacgccgcaagccacgtttatggtgcgcgatatgctgcgccgcaacccacggccggatggcttgccgggccgccattggcgcaccgcgtggaaaaccggcacctcgtgggggtttcacgatgcgtggagcgcgggtctggtcgggccgtacgtgctggtggtgtgggtgggcaacttcgatggccgacccaaccctgcgtttatcggcgccaagaccgccgcaccgctgttctttcgcatcgccgacgccctgccgctggcgctgcccactgtggtgataaaaccggacaagccgcctgccgggctggtgcgcatcgacgtgtgcgccgcttccggcgagttgcccaaccgttggtgcccgcaaacccgcaagacctggtacgtgcccggtgtgtcgccgattcgtgtgtccaacctgcaccgcccggtgctgatcgacacccgcaccggcaaggccgcgtgcccgccgtttgacccgcagtacacccgtgaagaagtcttcgagttctggcccagtgatgtgcagcgcctttatcgcgcagctggcctgccccggcgtacgccgcccaacgtgatgaaaaactgccagcccaaccgcatcagcgaccagagcgaggcaccgcaaattcgctcgccgttgacccaggtcagctatcaattgcgcctgtcgcagccccaggaaagtatcccgctgaatgccaacgcggccagtgatgcagcgacgctgtattggttcgccgaccagaccttgatcggccaaggcccgccgcaaaccacgctgaattggcgaccgggcaagtcgggggaataccggctgcgagtcagcgatgatcaggggcgcagtgcgagccgggggttgaaggtggagtttgcgccgtgatcacagggtacttggctgggtaggcgcagatcacctgtgggagcgggcttgcccgcgaagacgttgacccagcaaacagcgatgttgactgacccaccgctttcgcgggcaagcccgctcccacatttgatctgcgcgacgccctgatcaggcgtcttcgtcgccgaggctggctttgccggcatccttggaaaaatgcttgaaggccgcacccagcttgcgttgctcgaagatcgaaaacactaacgtgccaagcaggatcagcatccacaccagaaacagcttcaaggtatccacctgagccacaaacaacagcagcgtcaccacgccgccgatgaccatgcccagccccatccaagcgcccagcacccgccccacggccaggcgcatgcctttgggcaggaccagccgcgttgccatcatcaccacgataatcgtcaggaaaaagccaaatgccgccatgaagggaatcggaaaaccaccttcgcggtacagccacgccagcagccgatacacggggcccagtggctccatttgctgataggtgtcggggccgggtagatgcaattgggcaaaatgcgcaggtgtcatggccatgatgcccacgccaatcatccccaccacggcggcatagaaaccaccggcgcgccacagcggcgccagcacacgggtgttttctacatcctgggtcagcgccaggccaaacaccgcgttgcgctgtttgccttgggcaatcgcgggtttgccgtcgcgctcacaggcatcgccaatcagcatcacgtccaggtcctgcaccagcagaatttcgccttggcgcctggagctgccgaacagctcgtattcgtcaggggctttgttgccgaacaggtcaatgccttcggcgatcacgctgatttcgcccgtggcgtcctgcagacggaagtcattgcagcgcgcctcgccagagactcggctccagctccagtgcccgtcgtcgtctttcttgccatcttcgacaatccagacatagcccacgcacggcttgccattcaccggcgacaatagggtcttgtcggcaatcaccttgccgcgtacttccaccaggcccatcgccagcgaacgaatctggctggtggccagccgctgttcggttttatagaagttgggaccgaagctgagcagcagaccgaccaaaatgcctacggggaaaaacagcgcgataaagatgttcggcgcgtaagcaatcaagctgatgaagcccgcgagcaacaccagcgccaacgctgttttccatttgggtttcttcgcgacgacgccggcctgggtggttttcatgcccccggcacctcgagcttcacgccttcgtagcgggtttcttcggcgctgatggccagcaagggaatgcgctgatagccgagcatccgcgcaaagaacaggtcggggaacaccgcgatcgcgatgttgtagaggttgaccgattcgttgaaaaactcacgccggtcggcaatgcgctcttccaccgccgagatcgcctgctgcaactcgaccatattcggccccgagatcaacgccgggtaactctccgccaccgcaatcaccgacttgagcgccgcattgagctggttggacgcgtcgaccttgtcgttgaggctgctggcattcaggtattgagtgcgcgcgtcgctgagccgggtaaacagcgcgttctcatggttcatggcggtctgcaccacgcgcatcaggtcgggaatctggtcggcccgttgcttgagcaatacgtcgatattggcgaaggctttatccacatcgttacggcgcatgaccaggccgttgtagacgccaaccatccagccgaccagacccacgacaatgatcagcacgacgacgccggcgatgagcagttctatgttcatggtgaaggcattccctggctgagttatccacagggaggcattctagggtgaacctgacaggtgtttgcggtattggcgcacaaaaacgataaacgccgatgaccggttgattcggcggttttctacacgttcttcgccgataaaaaaccctcgattgccgagggttttttagtgatgccttacgagtccaaacgcattactccaccgtcaccgacttcgccaggttacgcggctggtccacgtcagtacctttcagcacggcgacgtagtacgacagcagttgcaacgggatggtgtagaggatcggcgacagggtgtcgtggatgtgcggcatgttgatgacgtgggtgccctcgccgttggtcatgccggctttttcgtcggcgaacacgatcagttggccgccacgggcgcggacttcctgcaggttggatttgagcttttccagcagttcgttgttcggcgcgacggtgaccacgggcatgtcgtcatccaccagggccagtgggccgtgtttcagctcaccggctgggtaggcttcggcgtggatgtacgagatttccttgagtttcagcgagccttccatcgccaccgggtattgcgcgccacggccgaggaacagggtgtggtttttgtcggcgaacagttcggcgactttttccacggtgctgtccatggccagggcttcgccgaggcgggttggcaggcggcgcagttcttctaccagcgtggcttcgacgccttcggcgagggtgccgcgcacttggcccagggacagggtcagcagcaacaggccgaccagctgagtggtgaaggctttggtggaggccacgccaatttcacgaccggcctgggtcagcagggtcaggtcggattcgcgcaccagcgagctgatgctgacgttgcagatggccaggctggcgaggaagcccagctctttggcgttgcgcagcgcagccagggtgtcggcggtttcgccggactgggagatggtcacgaacagggtgtcgggttgcaccaccaccttgcggtagcggaattcgctggcgacttcgacctggcacggaatgccggccagttcttccagccagtaacgtgcaaccatgccggcgtggtagctggtgccgcaggcgacgatttgcacattgcgtactttggcgaacaactcggcggcctgtgggccgaaggcgttgaccaacacttgcctctggctcaggcggccttcaagggtgcgttgcaccacggatggctgctcgtggatttccttgagcatgaagtggcggaattcgcccttgtcagcggcttcggcgccgtcgcggtattgcacggcttcgcgttccacggaattgccgttaacgtcccagatcgccacgctttcacggcggatgtcggcgatatcgccttcttccaggtacatgaagcggtcggtgacctggcgcagcgccagttggtccgaggcgaggaagttttcgcccaggcccaggccgatcaccaatgggctgccactgcgtgcggcaaccacgcggtctggctggctggcgctgaccacggccaggccgtaggcgccgtgcagctctttaaccgtggccttgagggcgacggtcaggtcgccgaggtccttgagcttgtggttcagcaggtgggcgatgacttcggtgtcggtgtccgaggtgaacacgtagcccaggcctttgagctgctcgcgcagcacttcatggttttcgatgatgccgttgtgcaccaccgccaagtcaccggagaagtgcgggtgcgcgttgcgctcgcacggcgcaccgtgggtggcccaacgggtgtgggcgataccgaggcggccgaccagcggctcaccgagcaacgcttgctccagctcgctgaccttgcccgggcggcgcatgcgctccagcttgccggcattggtgaagaccgccacaccggcgctgtcgtagccgcggtattccaggcgcttgaggccttcaagcaggatggcggtgacgttgcgttcagcgactgcgcctacaattccacacatggtttttctcctagatgattgccgcgcatatcagcgtaatgccgcgggcttggatctggtcgcgggcctcaagcggcaggcgatcatcggtaataagggtatggacgctgctccagggcagttccaggttgggaatcttgcggccgatcttgtcggattcgaccatcaccaccacttcacgggcgacctcggccatcacgcggctcaggcccagcagttcgttgaaggtggtggtgccgcgctgcagatcgatgccgtcggcgccgatgaacagctgatcaaagtcgtaggaacgcagcacttgctcggcgacctggccctggaatgaatccgaatgcgggtcccaggtgccaccggtcatgagcagcaccggttcgtgttccagctcgctcaaggcgctggccacgtgcaaggagttggtcatcaccaccagcccaggctggtggcccagctcggggatcatggcggcggtggtgctgccgctgtcgatgatgatgcgcgcgtgttcacgcaggcgcatcacggcggcacgcgcgatggcacgcttgtaggccgagatgggttgcgcggcgtcgcccaccagctcttggggcatggtgatggcgccaccgtagcgacgcagcagcaggccattgctttccagcgcggccaagtccttgcggatggtcacttccgaagtttcgaaacgcttggccaattcgtccacgctgacttcgccctgttcattgagcaaggtcaggatgttgtggcgtcgttggggtgtatttcgtttcgacatggtgatggtaagtttcgtttcgaaagataacgaaggcaatcaaaacctattgggggaagatcgtcaagcagggcatgcgatatttttaaagtcgccacacatcaaatgtgggagctggcttgcctgcgatagcggttggtcaggcgacattcagggtgaatgtcagaccgctatcgcaggcaagccagctcccacaggagatagcattagccagttggattgtggataactcagatttttttgattttgaccgggcgtttccaaccgtcgatgttgcgttggcgggcgcgggccaccgccagttgagacttatccacatcctggttgatggttgagcccgctgcagtattcgatccatcgccaatggtgacgggtgcaatcaacgagttattggagccgatgaatacatcctcaccaatggtggtctggtacttattggcgccatcgtagttgcaggtgatcgcgcccgcgccaatgttgctgcgtgcaccaatcaccgcatcacccaggtaggccaggtggcctgccttggcatcgtcgcccatttgcgcgtttttcagctcgacgaagttacccacatgagccctggcgccgagcacgctgcccggacgcaaccgcgcaaacgggccggcatcgctgccctcacccatcaccgcgccgtcgatatggctgttggctttcaccaccacgcctttgcgcagggtgctgtccttgatcacgcagttggggccaatcaccacgtcgtcttcgatgatcacgcggccttcgaggatcacgttgatgtcgatcagcacgtcacggcccacggtgacttcaccgcgcacatcgaagcgggctgggtcgcgcagggtcacgccttgggccatcaggcggcggccttcgcgcagttggtagtggcgctccagctcggcgagttgcttgcggtcgttggcgccctgcacttccatcgggtcatggggctgctcagtggcgaccagcaggccatcgctcacagccatctcgatcacgtcagtaaggtagtactcgccctgggcgttgttgttggacaggcggctcatccagtcggcgagcttgttggccggcaccgcgagaatcccggtgttgccttcagtgatggcgcgttgggcttcgctggcgtctttgtgctcgacgatagccgcgaccttgccgtcggcattgcgcacgatgcggccatagccggtggggtcatccagctcaacggtgagcaggcccatctggccaggcactacgtgcttgagcaggcgctgcagggtttccacttcgatcagcggcacgtcgccgtagaggatcagtacggtgtcggcgctgatgaacggcacggcttgcgcggtggcatggccggtgccgagctgtttgtcctgcaaaacgaaattcaggtcatctgccgccaggcgttcacgtaccacatcggcgccatggccgatgaccacgtgaatacgctgtgggtcgagttgccgggcgctgtggataacatggccgagcatggagttgcccgcgaccgggtgcagcaccttgggcagggccgaacgcatgcgggtgccctggcctgcggcgagaatgacgatttcaagagacatgaatggctaccaatcctgggcggtccggctttagaccagagaagtgttttgctaaaaaagaaaaagggtagccgaggctaccctttttaatcaatcgcgcttgaagcattgcggcgtggccgcttacttcttgcggatctgctggagcgtgcgcagctgagctgcagcctcggccagacgtacagcagcagcgctgtagtcgaagtccgcgcccttttcgttcagggccttctcggcagccttgacggcttcctgagcggaggcttcatccaggtcgccagcacgttgcacggtgtcggcaagtaccttgaccatgttcggctgaacctcgaggaaaccaccagagatgtaaaacacctctttgtccccgccttgcttggtcagagtgatcggacctggcttcaagctggtgatcaacggcgcgtggcccatggcaatacccaggtcaccgagttcgccgtgtgcaatcaccatttctaccagaccggagaagatttccccttccgcgctgacgatatcgcaatggactgtcatagccatctgattgcctcaacctgatgagcgcccgttgccgggcgccgggattacagtttcttggctttctcgatcgcttcttcgatgccgccgaccatgtagaacgcttgttctggcaggtggtcgtagtcaccgttgaggatgcctttgaagccagcaatggtgtctttcagggaaacgtatttacccgaggcaccggtgaagacttcagccacgaagaacggctgcgacaagaagcgctggatcttacgagcgcgggataccaactgcttgtcggtttccgacagctcgtccatacccaggatcgcaatgatgtccttcagttctttgtaacgctgcagcacgtactgaacgccgcgagcggtgtcgtagtgctcctggccgatcacgttcgggtccagctggcgcgaagtcgagtcgagtggatcgaccgctgggtagatacccagggaagcgatgtcacgggacagaacgacggtggcgtccaagtgggcgaaggtggtagcaggcgatgggtcagtcaagtcatccgcaggtacgtataccgcttggatcgaggtgatcgaaccttctttggtcgaagtgatacgttcttgcagaacgcccatctcttcagccagggtcggctggtaacctactgcggaaggcatacggcccagcagtgcggatacttcagtaccggccaaggtgtaacggtagatgttgtcgacgaacagcagaacgtcgttaccttcgtcacggaacttctcggccatggtcaggccagtcagtgctacgcgcagacggttacccggcggctcgttcatctgaccgtaaaccagtgccactttgtccagaacgttggagtccttcatctcgtggtagaagtcgttaccctcacgagtacgctcacccacaccggcgaacacggaataaccgctgtgctcgatggcgatgttacggatcagttccatcatgtttacggtcttgcctacaccggcaccaccgaacagaccgactttaccgcctttggcgaacgggcaaaccaggtcgataaccttgatgccggtttccagcagatcgttgccgccagcttgctcggcgaacgaaggagctggacggtgaatgccccagcgctcttcggtgtcgatcgggccagcttcgtcaatcgggttgcccagtacgtccatgatccggcccagggtcgctttaccgaccggtacggagatggcagcgccagtgtcgacaacgtccagaccgcgcttcaagccttcggtggaacccatcgcaatggtacgaaccacgccgtcgcccagctgctgctgaacttccagggtggtttccgcgccttgtactttcagcgcgttgtagatgctcggtacgctgtcgcgtggaaattccacgtcgataacggcgccgatgatttgaacgatacgtccgctactcatagctggatcctctgaatatttgaaccgttaaaccgcggcagcgccgccgacgatttccgagatctcttgggtgatcgcagcctgacgcgccttgttgtagatcagctgcaaatcgctgatcagatcaccggcgttatcggtagcgtttttcatcgcgatcatccgcgccgcttgttcagctgcgttgttctcgaccaccgcctggtaaacctgcgactccacgtagcgcaccatcaagccgtcaagcagctctttggcgtctggttcgtagaggtagtcccagtggtgcttgagttcctgatccggagtcgccaccagtggaatcaattgctccacggtcggctgctgggtcatggtgttgatgaacttgttggataccacggagaggcggtcaatccggccttccaggtatgcatccagcatcaccttcacactgccgatcaaatcattgatcgacggctcttcacccaggtggctgatagctgcaacgacgttaccgccgaagttacggaaaaaggccgcacccttgctaccaacaacacacagatcgatctcgacgcccttttcgcggtttaccgccatgtccttgaccagggccttgaacaggttggtattcaaaccaccgcacaaaccacggtcactgctcactaccacataacccacacgcttaacgtcgcgctcgatcatgaacgggtggcggtattccgggttggcgttggccagatgcccaattacctggcggatacgctccgcataaggacggctagcagccatgcgcatttgtgccttgcgcattttgctgaccgccactttttccatggcgctggtaattttttgcgtgcttttgatgctcgcaatcttactgcgaatctcttttgcgcctgccatgtaacacctatcaggttagcaagcgggagccttgcggctcccgctgcggcttaccaggtttgggtggccttgaacttctcgataccggctttcatgccagcatcgatatcgtcattgaagtcacccttcacgttgatcttcgccatcaattcggcgtgatcgcggttgaagtaagcaatcagcgcttgttcaaagctgccgaccttggcgatttcaacgtcggtcaggaacccacgctcagcggcatacagcgacaacgccatgtcagcgatcgacattggggcgtattgcttctgcttcatcagctcggtaacgcgctgaccatgctcaagttgcttacgggtcgcttcgtccaggtcagaagcgaactgggcgaatgccgccagttcacggtactgagccagagcggtacggataccaccggagagcttcttgatgatcttggtctgagcggcaccacccacacgggataccgaaacaccggcgttcactgcagggcggatgcccgagttgaacatggccgattccaggaagatctgaccgtcagtgatggaaatcacgttggtcggaacgaacgcggaaacgtcgccagcctgggtttcgatgatcggcagtgcggtcagggaaccggttttgccggttactgcgccgttggtgaacttctctacgtactcttcggatacgcgggatgcgcgctccagcagacgggagtggagatagaacacgtcgcctgggtacgcttcacggcctggtggacggcgcagcagcagggaaatctggcggtaagccactgcttgcttggacagatcgtcataaacgatcagcgcgtcttcaccgcggtcgcggaagaattcacccatggtgcaaccggagtacggtgccaggaattgcagcgcaggagattccgaagcactggcagccacgatgatcgtgttggccagggcgccgttttcttccagcttgcgaaccacgttggcgatggtcgattgcttctgaccaatggctacgtagacgcagaaaatgccgctgttcttctgattgatgatcgcgtcgatcgccagagcggttttaccgatctgacggtcaccgatgatcagctcacgctggccacggccgactgggatcatggcatcgacagccttgtagccagtctgtacaggctggtctaccgacttacgccagatcacgcctggagcaactttctcgaccgcgtcggtctcggtgttgcccagtggacctttaccgtcaacagggttacccagtgcgtcgactacgcgacccagcagttccttaccaaccggaacttccaggatgcggcctgtgcacttggcgctcatgccttcagccagactggtgtacgcgcccaatacaacggcacctacggagtcttgctccaggttgagggccataccgtagacgccgcccggaaactcgatcatctcgccgtacattacgtcggccagaccgtgaatccgcacgatgccgtcagatacgctgacgacagtgccttcgttacgggcttgggaggtcacatcgagcttgtcgatgcggcccttgataatttcacttatttcggaaggattgagttgctgcattgctctgctgccccttcaaactcaagatttcaatgcttcggcaagattcgcgagtttgccgcgaatcgagccatcgataaccaggtcgccggcgcgaatgacaacacccccaatgagggatgggtcttccgcaacttgcaggcgcacttcccggtcgagtcgtgcactgagaaccttggcgagtttgtcttgctgttcttggttcaatgcaaaagcactggtcacttcaacgtctaccgacttctcttgctcagccttgtacaggtcgaaaagagcggcaatctccggcaacagcgggagacggtcgttttcggcaacgacgtggatgaagttctgcactttcacatcaaacttgtcgccgcacacgtcaataaacgtggcggccttgtctgcgctcgtcagtcgcggggccttgagcacgcgctgcatggtgtcatcttgcgacactgctgcagccaggccgagcatggctgaccaagaggccagctgctggtgggcctgggcgtgctcgaaggctgccttagcgtaaggtcgggccaacgtggtcaattctgccatgatcgccctcgcttaaatttcagcagccagtttgtttaccagctccgcgtgcgcgttttgatcgattgtggcacccaggatcttctcagcaccgccgacggccagagcacccagttgggcacgcagcgcatctttgacaccgttcagttcctgctcgatctcggcctgagcctgaaccttcacacggtcagcgtcgatacgggctttttcaacagcctcttcaacaatctgattaccgcgcttcttggcttgctcaatgatttcagctgcctgtgccttagcatcgcgcagttgatggcccgctttctcttgggccaactccaggtcgcgagctgcacgggtggcagcgtccagtccatccgcgatcttcttttgacgttcatgcagagccgcgatgaccggaggccatacgaacttcatgcagaaaacgacaaaaatcaagaacgctaaggactgaccaataatggttgcattaatgttcacgccaatacctcgctcgttcgttgcacaacacaccaatcactcgaaaaaacgagtgattaaccggcgagttgaccaacgaaggggttcgcgaaggtgaagaacagagcgataccaacaccgatcatggtcacggcgtcgagcaggccggcaacgatgaacattttaacttgcagcattggcaccatttctggctgacgcgctgcgccttccaggaacttgccgccgagcaggccgaaaccaatggcagtacccagggcgcccaggccgatcaacagtgcaacagcgatagcggttagaccaactacagtttccatctttcctcccgacttttacgtcgtatggtttaggttttttagattttaaagcggtaaaacaaatcgtttcatagccctgttgggccaccttcccgtgttaccgggaaggacatcagactggtcgagaccggtcttaatggttctcttcgtgcgccatcgacaggtagacgatggtcagcatcatgaagatgaaggcctgcagggtgatgatcaggatgtggaacacagcccacgcccactgcagaacaatgcccaggccgctaagccagagcaggccgctgccgaacatcacagcgatcaggatgaacaccagctcgccggcatacatgttgccgaacagtcgcagggccagggaaattggcttggcgatcagggtcacgaattccagcaggaagttcaccggaatcagcagggcttgaacgaagatgttcttgctgccgaacgggtgcagggtcagttcgccgatgaagccgccgatgcccttgatcttgatgctgtagaaaatgatcaacgcgaacaccgacagggccatgcccagggtagcgttcgggtcagtggtcgatacggcacggaatggaatgtgcgggtcgcccgaaatcgccatggccaactgaggaatccagtccaccgggatcaggtcgacggcgttcatcaggaacacccagacgaaaatggtcagtgccagcggtgcaatcaccgggctacggccatggaagctgtctttcacgctgccatcgacgaattcgaccagtacttcaacgaagttctgcaaagcacctggctgaccggaagtcgccttttttgccgccatgcggaaaatcaggacgaagatcagacccaatgcgaccgaccagcccagagtatccaggtggaaagcccagaagcccatttctttggcttctgctgcggagtgagcgaagccccagccgccgttgggaagctgaccgaaggtcaggttctgcaagtggtgctggatatagcccgaagcggttgtttctgccatggttgcctcaaacgccctaaggtttcgaaagtcttgttttcattagcaggggagcgaaccagctgaccagttgggtcaacacgaagacgccgaatacagccagcggcgccaatggcttcacacctgcaaaggtcagtgcaaacagcactgccgtcaaaatcagtttccctgcttcgccagcataaaaagaccggacgatagcctgggctgctcgggcgccggaaaaccgaaaggccctgtgagcaaaatacatattgggcagcaaggctatcaggcctccgcagagtcctgaatatccggctacgactccatgccaataccaaagcgccaatgcggcgatcagcaaaatgacaaattgagccaataaaaccgggaaaacggccaagcgatggaacggcaacgtgtttggcgtgcgggtttccatcactcttgctcctcaatggtcggctgccgagaatcaataacttggcataatttgtgccgacaaaatgcgcgcagagtataggggcggttctgcccctattcaactgtcgggtagtgttttccgatcgcgcgctacataagcaaatgtttcagcggatgtgggcaaggacgccctgaagctcatcgagtgagttatatccgatgactaattgccctttgcctttcttaccgtgacgaatttgcaccgcagagcctaggcgctcggccaggcgctgctcgagtcgcgcgatatccggatcaggtttggcggtttcgaccggtgcaggtttgccgctgagccattggcgaaccaacgcctcagtctgacgaacggtgaggccgcgtgcgacaacgtgtcgcgccccttcaacctgttgattttccggcaaaccgagcaaagcacgggcgtgacccatttccaggtcgccgtgggacaacatggtcttgatgacttccggcagcgcaatcaggcgcaacaagttggacacggtgacgcgggatttacccaccgcatcggccacttcctgttgcgtcagtttgaattcctgctgcaaacgctgcagggcgatcgcttcctcgattgggttgaggtcttcacgctggatgttctcgatcaacgccatggcgatagcggtttcgtccggcacatcgcgcaccatcgccgggatggtgtccttgccggcctgctggctggcgcgccagcggcgctcgccagcgatgatctcaaagcggccgccgccaatcgggcgcaccacgatcggctgcatcacgccctgggccttgatcgaattggccagttcttccagcgcctgggggtccatgtcccggcgtggctgatatttaccgcgctggatcaggtccagcggcaagtgttgcagctcgcgctcgtcggcttgcaccgcttgttcttcaagcgaagtgacagtcggaccactcagcagtgcatccagtccacgtccgagacctcgtttcttgacggccatggggattccttaagttggctgggctgcagcggtgcgtgagttgcggcgttgacggcgaaccatctcgccggccagtgccaggtaggcaatggcaccacgggatgatttgtcgtacgccagcgcgggcatgccatagcttggcgcttcggccaggcggatgttgcgtggaatcacggtgtcgtacaactgatcgccgaagtgttccttgagctgcgccgacacatcgttcaaaaggctcaggcgcggatcgtacatggtccgcagcaggccttcgatttgcaggttcgggttgagcaactcggcgatacgcttgatgttatccacaaggtcgctcaaaccttcgagcgcaaagtactcgcactgcatggggataatcaccccatcggctgccaccaatgcgttcaacgtcagcatcgacagcgacggcgggcagtcgatcaaaatgtagtcgtaattctcgcggatcggcgccaaggcgctgcgcagacggctttctttcatctgcatttccagcagcaccacttccgccgcggttaaatcgcggttggccggcagcagttgataaccgccatgctcggaatagtgcatggcctgggccaggtcgcactcgccaatcagcaagtcgtagaccgagttttccaggccgtgtttatccacaccgctacccatggtggcgttgccctgtggatcgagatcgatcaacagcacccggcgcttggtcgcgaccagggatgctgcgaggttgatgcaggtggtggttttgcccacgccacctttctggttcgctatcgcgaataccttagccattcttgcttgtgttcccaatcatgccgtgcggcgcagtatcagcagatggcgttggccttggcaaccgggtacggccaaggcgtgttcgctatcgaggtggaagtctgccggcaatgctaacagctcgtcgcttggatgaacgcccttcattgccagccaacgggtgtcgcggtcgcctaagtggcgggtccagttgctgaagttctccatgctgctgaatgcccgggaaacaattccgttgaagggctgctgcggcgtgaaggcttcgacgcgactgtggataacgttgaggttatccagcttgagttcgagtttgacctgggtcaggaagcgggttttcttgccgttgctgtccaggcacgtgacttgcgactcgggaaacaggatggccagcgggatgccaggcatgccgccgccactgcctacgtcgagccagcgaccgttttcgataaacggcatgacgctcaggctgtcgagcagatgccgcgagaccatttcgtccgggtcgcgcactgctgtgaggttgtaagccttgttccatttgatcaacagggccagataacccagcagcaattcgtgctgggcttcggtcaggttgacgccaagctggcgagcacctgtggataactcttcggcgtgttgcgaggtgaccaacgaactcaagcgctttgctccaactgacggcccgcgccgcgttttttcaaatgaatcatcaacagcgaaatggctgccggggtgacgcccgggatacgtgaagcctggccaagtgtctccggccgagttatccccagcttgctttgaatttctttcgacaacccggaaatcccggtgtaatcgatatccacaggtagcttggtgtcttcactggcgcgcaggcgagcgatctcgtcctgttggcgatcaatgtaaccggcgtatttggtcttgatttcaacctgttcggcgacctgtgggtcttctgcaccgtggcctgtcacttcgaccagaccagcgtagtcgatttccggacgggacagcaggttcagcaagttgtattcgtgggtcagcggcgtgccgaatttatcggcaatcgcgtcgccctgctcggtgcctgggcggacccaggtacttttcaggcgctgttcttccagcgcgatgctttcgcgttttttgcagaacgcagcccagcgtgcgtcatcgaccaagcccagctcgcgacctttttcggtcaggcgcaggtcggcgttgtcttcgcgcaggatcaggcggtattcggcccgggacgtaaacatccggtacggttcctgagtcccgagagtaatcaggtcatcgaccaacacaccgatgtacgcctcatcgcgacgcgggcaccagctgtctttgccttgtgcacgcagtgccgcgttggtcccggccagcaaaccttgggcgccggcttcttcgtaaccggtggtgccgttgatttgcccggcgaagaacaggccgccgatcactttggtttcgaggctgtacttcaggtcacgcgggtcgaagtagtcgtactcgatggcgtagcccgggcgcacgatgtgggcgttttccatgccgcgaatcgactgcacgatctgaatttgcacgtcgaacggcagggaagtggaaatgccgttcgggtacagctcgtgagtggtcaagccttcgggctcgatgaagacctggtggctttccttgtcggcaaagcggtgaatcttgtcttcgatcgatgggcaataacgcgggccgatgccttcgatcaccccggaatacatcggcgaacggtcgaggttcgcggcaatgatttcgtgggtgcgggcgttggtgtgggtaatccagcaactgacctgtttggggtgctgctctttggaacccatgaacgacatcaccgggattggcgtatcaccggcctgttcggtcattaccgagaaatctacagaacgcccgtcgatacgcggcggggttccggttttcagacggccgacgcgcagcggcaattcacgcaggcgttttgccaaagcaatcgacggcggatcgccggcgcggccaccggaatagttctgcatgccgatgtggataagtccgccgaggaacgtaccggtggtcaacaccacggattctgcgaagaaacgcaggcccatttgcgtgacaacaccgcgaacctggtcttgttcgacgatcaggtcatccgctgcttgctgaaatatccacaggttcggctggttttccagggtttcgcgtaccgcggccttgtacaggatgcggtcagcttgtgcccgagtcgcccgtacggccgggcctttgcggctgttgagcacgcgaaattgaataccacccttgtcggtcgccatggccatgacgccgccaagggcgtcgatttccttgaccagatggcttttgccgatcccaccaatggcggggttgcaactcatggcaccgagggtttccacgttgtgcgtcagcaacagggttttaacgcccatgcgtgctgaggccagtgctgcctcggtaccggcatgaccgccgccgatgacgatcacttcaaaacgggaagggaaatccaccacgcacctcgtgcctgcttatgtaggtaatcaggaattgattgttgaaagagttttagagctttggcggcaagtatagggacttagcccttcctaaagaaccctttgcacaaaatttaaccagctgtggatgaatcacagacaatagaaattaaaaagaaagaaatttataagatctttgtttttatgtttatttctactgagcctactttctgtggatagatctctacaggcctttatttacgttgtgtacagcgattcaaaagtctgtggtcatgtgccaatgaggcccttggataagtgctttaagcctgtggattaaacaggtggttatccacagaggggtttttactcaggtttcaggccctgttatcaactgggcacaagggcggttattcacagggcttaatccacagaaatggcgtatttcgcccacgacgacgccaccgaaatcctgagacctggcaaacaacacttcaaaaacggagctattgtgagaaatcggtgtggcagttaataatagtaattatcattaacctagctcatcgcgccctatgcctcctccatcccactcggttgcagtccagcacatctatgagcagcaccattcgtggctgcaagggtggctaaaaggtaagttgcataacgcctgcgatgcggccgatgtggcccacgatacgttcgtgcgtattttgggcgggcgtcatgcggcacagatcctcgaacccagggactacctggcaaccatcgccagaggtttggtgattgaccgctatcgccggcatgcgattgaacaggcgtataaacagtcgttggctgagcgccctgaagccactgtcatcagtgaagaagacaaggccatcatcattgaaaccctggtggctgtggataaagccctgactgaccttggcgatcgagcccgacgaattttcatgctgtcgcagatcgagggcctgacttatcaacaaatcgccgaccaactgcaggtctcgctgaccaccgtaaagaaacacatgattcgcgccctgactgaatgctcattgctcatggccagcctgtaatggccgccccggaccgtaaggttttcgaagcggcggccagttggtacgtgcagtttcaatcgcaaccgcctacgcccgctgagcggcatgcctggcaacagtggctcaatggcgaccctgcgcatcaggcggcgtggaatcagatggagcaaattcagcgcagccttggcgccttgccgcaggatttcacccgtcgcgctttatcggccacgcaacaacggcggcaggtactcaagtggatgctggtgctgggcggcaccggttatctgggctggaacgtccaagaacacacgtcgctgggtagtgtctgggcggattaccgcacacgtgtcggtgaacgacggcgtatcgaattggccgatggcactcgcattgatctcaataccggcaccgccattgatgtggcgttcgacgggcgccagcgtttggtccgcctgcgcgagggcgaggtacttatccacaccggcaaactgggtgggcagacgcctttttatgtcgacacccaccaaggtcggattcaggcgttgggcactcggtttaccgtgcgccagttgccgggttcgacgcgtgtgggtgtgctggaagatcgggtgagcgtttcgcctgctgatcaacctgagcacagccgattattgaaagctggagaaagtgctgacttcgaccgccagaacatcacccccaaccaagcctatcgcagtacccagaccgcttgggtcgatggccaggtgatcgttctcgacgctcggcttggggatctgatcgacgacctggcgcgttatcgcccaggtgtcctgcagtgcgattcggcttctgccggcctgcgggtctcgggaacgtttcgcctcgactccaccgatgcagtactggccaacctgcaagccacgctgccgatccaggtgaaatatttcactcgttattgggtttcggtgaagcgcgttggttgaacgcaaaaaataatccacaggggggttatcttttttttacctggcccggccctacaggtaatcacgacgttaccttcagggcttacccacctatgcgcctcccaaccaagtttcgccaacgactctcttaccacggcatgacctacagtttactgctggccacggcgactacggccggtgttgtgttgtccacaggcgccatggccgccaacgtcgcgcaacactacaccatcgctgccggcccactggacgccgccttgagccagtttgccgccaaggccaatgtgattctgtcgttctcgccgcagcagaccgcgcgtttgaatacgcctgggctggaaggtgactactcgattgatcaaggctttgcgctgttgctgcaaaactctgggttgcaggcagtcacgcaagcccccggaagctatgtattgcaggcggcaccggccgggcaactgacgctggcaccgacgactgtgagcacttatcaacagctcggtttcaatcaagatattgctggcgatgtgggctacaaggcgcaaaacagccgcatcggcaccaagaccagcacgccgctctcggaaaccccgcgttcggtttcggtggttactggccaacgtatcaaggatcagaagtcgcaaacgctgacggacgtattgggttatgtgccggggatattcgcgccaccttttgccgccggcgacggcctggccggtgacctgttcttcattcgtggcttcaacgccacggattatggctacggcctgctgcgcgatggccttcgggtgcagggcaatcggtatgacaccaccagcgaaccgtatggactggagcgcgttgagattttccgtggcccgtcttccctgctttacggggaaaacgcgcccggcgggctggtcaacctggtcagtaaacacccaaccgctgcgcccctgggcgaggtgcaattgggttacggctccaacaatcgacgccagttgggtgtggatatctcaggcccgctcaatgacagcgacaacatcctcggccgcgtggtcatgctgggacgcaaatccgacactcaaaccgaccacgttcctgatgatcgcttgtacatcgcaccgtccctgaccctgaacttcgacgactacaacaccctgacgctgctggccaactaccagaaggaccacaccaatctggaacttggcttaccggccgccggcacgttgctgaaaaaccccaacggcaagctgtccaaacacaccatgctcggcgacccggactggaacaccttcgaacgggaagcctggagcgccggctacgagttcagccacagcttcaatgatgattggcagttccgccagaactcgcgctacatgcagtcacgcatcaaccgccatgaaacctggcccggcgcgctgaacaatcgcggcttcggcacccagctgaacatgaccgcctacgaccgctacaacaagtccatggtctattcgctggataaccagctcgagggtaaattcgaggtgggcggcctggaaaacaccgtgctgtttggcgccagctatgaccgcacctcgttcaatcaggactgggatgcaggctttgcaggcaccatcaatgtgtataacccggtgtacctgcgcgatccactcacgcctatcgcggttcaaaacaccctgctcgaacagcagatgaaaggtgtttatgcacaggtccaaagcaagtacgaccactggctattcctgctcggcggtcgccaggactgggtcgacagtgatttccgcgacaaagtgaacaaggccagcaacaccggctccgaagacaaaaagttcacgtaccagggcggcgtgatgtaccagttcgacaacggcctgacgccgtatgtcagctactccaccgccttcgtcccggtgcagcagatctccaacgccggtgcgccgttgaagccgatcaccagcagccaatacgaagtcggtgtgaagtacgaaccgattggctgggacaccgcgatgacgctgtcggtgtatgacctgcgcaagcaagacgacacgtatctggatgccaccaccaacagctatcgccaagtcggcgagagccgcgccaaaggtgcggaagtggagatcaacagcaacatcacccctaacctgaatgtcactgcggcctacacctacaccgacgcaaggattaccaaggattccgccacatcattggtcgaagggcgccaaatgaccggggttcctcgcaaccaggcatcggtgtggggcaagtatcgcttcctcgatggccagctgaagggcttgtctctgggcggcggcgtgcgctacttcgacagcaccttttcctacacagcaccgacgctgtacgggaagttggatgccggaagcgtcacgttggtggatgcggccatcggttatcagatcgacaaacattggtcggtggatgtgaacgccaaaaacctgttcgacaaggaatatgtatccggctgcaacgatgcggggcgttgctattggggtgacagccgtaccttgctcggtacggtgtcctacaactggtagagctctgtggataacgctgctatttgccgatacagaagctggaaaagatccgtcccaacagatcatccgagctgaacgcgccggtgatctcgcccaacagctgctgcgcctgacgcaaatcctcagccagcagctcccctgcccccgccaaggtcagttgtgcccgaccgtgctccaacgccgcgctggcatgacgcagcgcctccaagtgcctgcggcgtgcgctgaagctgctttccgaggtttgctcatagcccatgcaggccttgagatggtcgcgcaacaattccaagccatcgccggccgactttgcgctcaagctgatggtgacatggccatcctcgctggtttccatggcaatggcttcgccggtcaggtcagccttgttgcgaatcaaggtgaccttcgccgggtccggccgctgttcgaggaattctggccacagcgcaaaaggatccacagcctctggcgcggtggcatccaccaccagcaatactcgatccgcttcgccgatagccttgagtgcacgctctacgccgatcttttcgacctggtcgtcggtgtcgcgcaaaccggccgtgtcgaccacgtgcaggggcatgccatcaatgtggatatgttcacgcaagatatcccgggtggtgccggcaatctcggtgacgatggccgcttcgcgacctgccagggcattgagcaggctcgacttgccggcattcggtcggccggcaatcaccactgtcataccgtcacgcagcaaggcgccctgcccggcttcgcgcaggactgtggataactcatcacggaccttatcgagcattgccaggacatggccatcggcaaggaagtcgatttcttcctccgggaaatcaatcgccgcctcgacgtagatgcgcaggctgatcaattgctcggtcaagttatgcacacgcaacgaaaaggcgccctgcaacgagcgcaatgcattgcgcgctgcctgtgcagaactcgcttcgatcaagtcggcaatggcttcagcctgggccaggtcgagtttgtcattcaggaacgcgcgctcgctgaattcccccggacgcgccaagcggcagcccaactgcaggcagcgctgcagcaacatatccaggaccactgggccgccgtgaccctgcaattcaagtacgtcttcgccggtgaacgagttggggccgggaaaatacagcgccaggccttcgtccaatacggttttatcggcatccagaaaggggccgtaatgggcataccgcggtttcaactcacggccgctgatggcctgggctgccacacccgccagcggcccggaaattcgaacgataccgacaccgccgcgaccttgagcggtggcgacagcagcgatggtttcacgaggagcgctcatcagcaggttccagaacaaaagtgacggaaagcaaaacgccccactagggggcgtcttgagtggttatccacagagtaaattacgccgcagcttttttggtagccgcttcgattttacgtgtgatgtaccactgttgagagatcgacaacacgttgttgaccacccagtacagcaccagaccagcagggaaccacaggaagaagaaggtgaagatgattggcatcattttcattaccttggcctgcatcggatccggcggagtcgggttcaaacgctgctggatgaacatggtcgcgcccatgatgatcggcaggataaagaacgggtctttgatcgacaggtcagttatccacagcatgaacggcgcctggcgcatttccacgctttccaggagtacccagtacagcgagaggaataccggcatctgtaccagaattggcaagcatccacccagcgggttgatcttctctttcttgtacagctccatcatggcctgcgacattttctgccggtcatcaccatgttgctctttcagcgcggccagtttcggggccacggcacgcatgcgcgccatcgacttgtagctggctgccgacagagggaagaagatccccttgatcagcatggtcaagaagatgatcgagaagccccagttgccgacgatgctgtggatatgttgcagcagccagaagatcggctgggcaatgaaccacagaatgccgtaatccacagtcagttccagacctggggacaactctttcagcacagcctggcttttcgggccggcgtacaaagtggcactggtttcagccttggcacctggtgcgacggtcaacgccgggccagtaaaaccaatgatgtagttgccttggctgtctttgcgggtttgaaccaggttggcttcacccttgttcgggatccaggcggtcacgaagtagtgttgcaaccaggcaacccagccgccttggacggtttctttcagcgcgcccttgtcgatatctttcatcgacacttttttgtacggctcgctacttgtccacagggcggcgcccaggtaagtcgcggtgccggtggcagtgctggaagaaggatcggcgctgttgtcacgcttgagctgggcaaacaggttgccgctccaaggtttggcgctttcgttgtcgatcagataagtgactttcagatcgtacaaaccgcgggtgaagctgaaacgcttgatgtagttgacgccgtcctgactgaatttcaggtcaacgttcaactggttctggccatcagccagttgataagtcttctgttcggtcgaataaaccggacgaccggtagcacgagcatccggaccgtcggtgccggtcaggccactttgtgccagataagtacgttcaccaccgttgtcgaacagttggaacggaacatccggatggtcttggcgacgtggatacagcggcagtttcaactgcgcgatatcaccaccttgtgggtcgatagccaggtcgagcacatccgttttaacgtggatgaggtctttattggtgaccactggcgtttctagaggggcgtttgtctcgccattcgcgctgggaacatcggcactcgcggacgcattgttacccaacggagtgtccggaatagccggcgcagcctgattggtagcaacattctgagtcggcagggcagcctggccgtagtcctggttccacttaagaaccatgacgtaggacacgattgccagggcgacgatcaggatcgtgcgtttaatatccatgattactcggccatcgaagaagaacgggaggtagggataggtggaaccgggtcataaccaccgggattccacggatgacagcggcctaaacgacgaaaggccagccagccaccgcgcagaagaccatgattttctatggcctctaacgcgtagcaggaacaactggggtagaaacgacagtggtcagccatcagaggactaatggcataacggtaaaactggatcggaacgagggccagtttacgcattggtgctgtctacccctacagtttcggtgctgactgctggtgctggcttgttggtacgcgccaaacgtttccagagcttgccgaaatgctgaatcaattcggggttttctacgtcccccaagcctttgcgcgcgacgataacaatatcccaaccaaccagagtttcctggtggaggcgaaacgattcgcgcatcagacgcttgaggcgattgcgctcaacggagagctttacgctcttcttgccgatcaccaacccgagacgggggtgatccagatcgttgttacgcgcaaggagcaggagatttttccccggaaccttgccggtgggggagtcaaagactgccttgaagtgccggggggttagcagacgcttttcccgactgaagtcctgactcaccaccagtaccggattatcaaactgccagacgcgcacgacctttggcgcggcgacgcgacaggacagcacggccgttcttggtagccatgcgagcacggaagccgtgagtacgggcgcgtttgatggtgcttggttggaaagtacgtttcatggcgttgttacctggttcgtccacaacgggccggaatggcccccgttttaagagaccggcgattctagagaaagcaagcctctaggtcaatttccaaccagcttttcctttaattagatctctgcaggccaccaggccttttttgtccgctcggctttcatgagcaatgccatagatataaaaataaagaaggaagttatttaaagcttttctgtaaagcttataaaagctaggcaggcgttcttctgtggataactgccttaagcccatattccacctgatgtacagagaatgacaactaaggtggaaaacggtgcttagcctgtgctgcactgtcggataagctgtgggtggaatggattgttatccacaggccagttacccacagactttcgaccccacttgtgcaacgagcttaggggcgcttatccacagagcttatgcacagaccattggtcgccttttttacggttaacgcattgattttgggtgctctgtgagcaacctacatgtggataagtggacgactggccgctacaatggcggctgtttttgcctcaccggctttcaacttaggggatatccgtgtcagtggaactttggcagcagtgcgtggagcttttgcgcgaagagctgcctgcccagcaattcaacacctggatccgtccgctacaggtcgaagccgaaggcgacgagttgcgtgtctacgcgccgaatcgctttgttctcgattgggttaatgagaagtacctgagccgcgttctcgaattgctcgacgaacacggcaacggccttgcgcccgtgctttccttattaataggcagcaaacgtagctctgcaccgcgtgcagcgccgaatgcgccgttggccgccagtgcctcgcaggcccaggccgctgcggcacctgttaataactcgccagcgcccgttgcacagacgcctgcaaaatcggcgtcgcagaagaacgcgcctattaatgaagagccgtcccgcgacagcttcgacccgatggccggcgccagctcccagcaagcgccggtgcgtgccgaacagcgcaccgtgcaggtggaaggcgcgctcaagcacaccagctacttgaaccgcacgttcacctttgaaaacttcgtcgaaggtaaatccaaccaactggcccgcgcggccgcctggcaggtcgccgacaaccccaagcacggttacaacccactcttcctttatggtggcgttggcttgggtaagactcacttgatgcatgcggtgggtaatcacctattaaagaagaacccgaatgccaaggtcgtgtacctgcactcggagcgcttcgtggctgacatggtcaaggccctgcaactgaacgcaatcaacgaattcaagcgtttctaccgttccgttgatgccttgctgatcgatgacattcaattcttcgcgcgcaaggaacgttctcaggaagagtttttccacaccttcaacgccttgctcgaaggcggccagcaggtcatcttgaccagcgaccgttacccgaaggaaatcgaaggcctggaagaacgcttgaagtcgcgctttggctggggcctgaccgttgcggtagagccgccggagctggaaacccgcgtcgcgatcctgatgaaaaaggccgaccaggcgaaagtcgatctgccccacgacgctgctttctttatcgcccaacgcattcgctccaacgtgcgtgagcttgaaggcgcgctcaagcgggtcatcgctcactcgcacttcatgggccgcgacatcaccatcgagctgattcgtgaatccctgaaagacttgttggcactgcaggacaagctggtgagtgtggataacatccaacgcaccgtggctgagtactacaagatcaagatttccgacctgctgtccaagcgccgctcgcgctcggtggcacgtccacgtcaggtggcgatggcgctctccaaagagctgaccaaccacagcctgccggaaatcggtgatgtgtttggcggtcgcgaccacaccacggtcttgcacgcgtgccgcaagatcaacgaacttaaggaatccgacgcggatattcgcgaggactacaagaacctgctgcgtacactgacaacttgatgacaccagcgcagcttattaaggcaagggactagaccatgcatttcaccattcaacgcgaagccctgttgaaacccctgcaactggtcgcaggcgtcgtcgagcgccgacagaccttgccggtgctttccaacgtattgctggttgtcgaaggccagcaattgtccttgaccggtactgaccttgaagtcgagctggtcggccgcgtgcagctggaagagcctgctgaaccgggcgagatcacagtgccggcgcgcaagctgatggatatctgcaagagcctgcccaacgacgcgctgatcgacatcaaggttgatgagcagaagctggtggtcaaggccggtcgtagccgcttcaccctgtcgacgttgcctgccaacgatttcccgacggtggaagaaggcccgggctcgctgacctgcagccttgagcaaagcaggctgcgtcgtttgatcgagcgcaccagtttcgccatggctcaacaggacgtgcgttactacctcaacggcatgctgctggaagtgtcggaaggcatcatccgcgcggtggccaccgacggtcaccgtctggccatgtgctcgatgaaagctgacatcggccagccggatcgccatcaagtgatcgtgccgcgaaaaggtatccttgaactggcgcgtctgctcaccgagccggacggcaacgtcagcatcgtcctgggccagcaccacatccgtgctactaccggcgagttcaccttcacctccaaattggtcgacggcaagttcccggattacgagcgcgtgctgcctaaaggtggcgacaagctggtgattggtgatcgtcaggccctgcgtgaagcgttcagccgtaccgcgattctgtcgaacgaaaagtaccgtggtatccgtctgcaactggctaacggccaattgaaaatccaggcgaataacccggagcaggaagaagccgaagaagaagtgggcgttgactacaacggcggctcgctggagatcggtttcaacgtgagctacctgctggacgtgttgggtgtgatgaccactgaacaggttcgcctgattctatcggactccaacagcagtgccctggtgcaggaatccgataacgacgactcggcttacgttgttatgccgatgcgcctgtaatcatgctcagcagaagctagatgtccctcagtcgcgtctcggtcaccgcggtgcgcaatctgcacccggtgaccttctccccttccccccgcatcaatatcctccacggcgccaacggcagtggcaaaaccagcgtgctggaagccattcatttgctggggctcgcccgttcttttcgcagtgcacgcctattgccggtgattcagtacgaacaactggcctgtacggtgtttggccaagtcgaattggccgaaggcggtcatagcagcctggggatatcgcgagatcgcggcggtgaattccaaattcgcattgatgggcaaaatgctcgcagtgcagcgcaactggcggaaatcctgccattgcagctgattaaccctgacagtttccgcttgttggaaggtgcacccaaaatccgcaggcaattcctcgattggggagtgttccacgtggaaccgcgtttcatggccacttggcagcgcctgcagaaggccctgcggcagcggaactcatggctgcggcatggtacacttgacgccgcttcgcaagcagcctgggaccgggaactgtgcctggccagcgacgaaatagatgaataccgacgcgcctatatcaaagccttgaaaccagtctttgagcagaccttgagtgagttgttggatctcgagggcctgacgctgagctactaccgtggttgggataaagagcgtgagctgagcgcagtgctcgccacgtccttgcaacgggatcagcaaattggccatacgcaagcaggcccccaacgggctgatctgcgccttagattaggcgcacataatgccgcggatatcttgtcccgcggtcagcagaagttggtggtgtgtgcgctgcgcattgcccaagggcatttggttagccaagcccggcgcggtcagtgtatttatctggtggatgacttgccgtccgaactcgacgagcaacaccgccgcgcgttatgccgcttgttggaagacttacgctgccaggtgtttatcacctgtgtagaccacgaattattgagggaaggctggcagacggaaacgccagtcgctttgttccacgtggaacaaggccgtatcacccagacccacgaccatcgggagtgaaggcatgagcgaagaaaacacgtacgactcgaccagcattaaagtgctgaaaggtttggatgccgtacgcaaacgtcccggtatgtacatcggcgacaccgatgatggtagcggtctgcaccacatggtgttcgaggtggtcgacaactccatcgacgaagctttggccggtcactgcgacgacatcagcattatcatccacccggatgagtccatcaccgtgcgcgacaacggtcgcggcattccggtagatgtgcacaaagaagaaggcgtttcggcggcagaggtcatcatgaccgtgctccacgctggcggtaagttcgacgacaactcctataaagtctccggcggtttgcacggtgtaggtgtgtcggtggtaaatgctctgtctgaagagctgatcctgactgttcgccgtagcggcaaaatctgggaacagacttatgttcacggtgtgccacaagagccgatgaaaatcgttggcgacagtgaatccaccggtacgcagatccacttcaagccgtcggctgaaaccttcaagaatatccacttcagctgggacatcctggccaagcgtattcgcgaactgtccttcctcaactccggtgtgggtatcgtcctcaaggacgagcgcagcggcaaggaagagctgttcaagtacgaaggcggcctgcgtgcgttcgttgaatacctgaacaccaacaagactgcggtcaaccaggtgttccacttcaacatccagcgtgaagacggcattggcgtggaaatcgccctgcagtggaacgacagcttcaacgagaacctgttgtgcttcaccaacaacattccacagcgcgacggcggtactcacttggtgggtttccgttccgcactgacgcgtaacctgaacacctacatcgaagccgaaggcttggccaagaagcacaaagtcgccaccaccggtgacgatgcacgtgaaggcctgaccgcgattatctcggtgaaagtgccggatccgaagttcagctcccagaccaaagacaagctggtgtcttccgaagtgaagacggcagtggaacaggagatgggtaaatacttctccgacttcctgctggagaacccgaacgaagccaagctggtcgtcggtaagatgatcgacgcggcgcgtgcccgtgaagcggcgcgtaaagcccgtgagatgacccgccgtaaaggcgcgctggatatcgccggcttgccaggcaaactggctgactgccaggagaaggaccctgccctctccgaactgtacctggtggaaggtgactctgctggcggttccgccaagcagggtcgtaaccgtcgcacccaggccatcctgccgttgaaaggtaagatcctcaacgttgagaaggcgcgcttcgacaagatgatttcctctcaggaagtcggcaccttgatcacagcgttgggctgcggtattggccgcgatgagtacaacatcgacaagttgcgctaccacaacatcatcatcatgaccgatgctgacgtcgacggttcgcacattcgtaccctgctgctgaccttcttcttccgtcagttgccggagctgatcgagcgtggctacatctacatcgctcagccgccgttgtacaaagtgaaaaagggcaagcaagagcaatacatcaaagacgacgacgccatggaagagtacatgacgcagtcggccctggaagacgcgagcctgcacttgaacgacgaagcaccgggcatctccggtgagtcgctggaacgtctggttaacgacttccgcatggtaatgaagaccctcaagcggttgtcgcgcctgtaccctcaggaactgaccgagcacttcatctacctgccgtcggtgagcctggaacagctgggcgatcacgcgcacatgcagaactggctggcccagtacgaagttcgcctgcgcacttcggaaaagtctggcctggtctacaaagccagcctgcgtgaagaccgtgaacgtaacgtgtggctgccggaggttgaattgatctcccatggcctatcgaactacgtcaccttcaaccgcgacttcttcggcagtaacgactacaaaaccgtcgttaccctcggcgcgcaattgagcaccctgctggacgacggtgcttacattcagcgtggcgaacgcaagaagcaggtcaaggaattcaaggaagcccttgattggctgatggcggaaagcaccaagcgtcacaccatccagcgatacaaaggtctgggcgagatgaacccggatcagctgtgggaaaccaccatggacccagctcagcgtcgcatgctgcgagtgaccatcgaagacgccattggcgctgaccagatcttcaacaccctgatgggtgacgcggtcgagcctcgtcgtgacttcatcgagagcaatgccttggcagtgtccaacctggacttctgatcaggtcaacctgctaaaacaaaaaggccaacgctaagcgttggccttttttattggctctctaaagagcagttttcaaatgctccacgtggaacatacaagttttctaacctggggttgtcgctgcgacgctctccagccgatagccatatccgtagatcgtcagcagctgccagcctcgatcagcggtcaagcccagcttgttacgcagacgatagatgtgtgtgtccagcggccgcgaggagaccatttcctcgtgggaccagaaccgctcatagagatattcacgcgataatgggcgggccaggttggcgaacaagcaactggccaagcggtactcacgctcagtcaagttgatcggcttgcccgcgcgggtgacggtcagttcagcatcatcgaaggtcaggtcgttgaagctctgcacttcgtgggtcgcggatttttgcaggccatggcgacgtagcacggcgctgacgcgagccttgagttcgttaggccgaaagggcttgctgacataatcatccgccccgctgttcagcgctgtgacgatatcgctctcggcatcccggctggtcagcatgatgacggcggggggagactccatgtgctcgcgggtccagcgcaacagtgcaatgccgctgatgtcaggcagttgccagtcgagtatcagcaggtcgaaggtttcccggcgcaactggcgcaacaggtcttcaccgcgttcaaagcaatgcacagaccacggctgctccgtggtgctggggatctgtcgcagtgtctgctcaacccgacgcaattcggcaggctcgtcatccagtattgcgacacgcatgagtgggtcctttctactaaaaatacggcgtaaatgccggtcatcgaatctgaataattgtggtcagattcagcgagccttaaaactaccgatacgctgatatcaaacagcctttaatccattgaaagacctcgataccttggaggaacgataccgactcctgcccgtaaggaaaaggttctgcaccaagcactcaggaaagtctaacagtgagaccgaaatgagcttcactgggttcagtacgtcgttcatatcgaacagggagaaaccggggtatatggcgcacttaattttccacactcaacgttcatacaactctacggcggtagcctgttgatgctgtggcgcaaagcggagaaacgccaacccacccgagctcagctgctctttcacggtttggtacgtgaatggctgtggattggtctggtcttgctgcccttcaccgtctatctgtccctgagcccaggtctggcgctcaacaacccgctgtacgacagcctccgtcgtctgaccccgttgccggttgacccgcgtattttgctggtgaccatcgatgaccctagcctgaaaaaactcggcccttggccatggccccgcagcctgcatgccgacctgattgaccgcctgagtgcctcgcgacccgcgggcatattgttcgatgtgatcttcagtgagcccggcgatgcagcagatgaccagcggttggcggatgcagtgtgcaacgccggcaatgttttgttgccgctggtgaacgaaggcaccccgagtgccgactcgccacgtgaacaattattaccgttgctcaagtgcgccaaaggcatggggcatatcaatgtcgaagcggataacgacggcgtcgtgcgcagcctgtatatgcgtgaggggccgccagggaacacacttccgcagctggcgtggctggcctatacgttgagcgggcaaacctcacccatgcccggttttcccgaagagccgatcagcccgcagtggcaccgtgagcacgcgattcgcgtgcccttcacagtgcacagccattttcctagcgtttcatatgtcagcgtattgcgcggcgaggtgccccctgaagctttgcgaggccgactgatactggtcggagccaccgcctatggaatgggtgatcgctttgtcacgccgctctcctccaccgtgggcgccacggctggcgtggagctgcaagccaatgtcctcaacgggttgctgcaggggcgcagcattgttgatcttcccggctggctggccgccttggtggcgacttcattggtggccttgttactgggcctgctgttgtatcggccgcgttatgctctgtggatgactttggcgtgcatgggcaccgccctgcttagctcatgggctttattgcgcctggggcactggtggtcgcccgctgcgtgcctgatcggcttgctgctgagctacttgatctggaattggcgccgcctgagcgtgatcctggcgtacttcggctgggagcttgcacgtctggatgatgaacccaaagtccttcccgagcgccgccgtgcgccggccagcaaaggcgacgtgctacaagggcgaatctttgcgcttgaacaggcggttagccgtacacgcgacacgcgccgctttatggcggatgggttggaatgcctgccggtggcgacgctgatcaccgatccgaaaggcagcatcttgctggccaaccgtgttgcccgcgaagtgttcggcaatgacctggtaaacaacaatctgctggaacagctcgccgacctgggctacccgccactgcataacggggttcgccctgccctttcagcgttggaactcatcgagtttcgtgacatccaccagcgcagcctgcgtatggagcttgcgccgctgctgccggccgaaggtgatgtcgccctcggttggctgctgagcctcacagacttgagcaaagagcgcgaagcccagcaacaccgcgagacaatgctgcgcttcctttcccatgacctgcgcgcgccacattcggcgatcctggccttgctggatgtgcacaacggcgagtcaccgatatttgcgcagatcgaacagcaggtcagacgtgccttgggcctcaccgaatccttcgtgcagttggccaaggccgaagcggacggttaccacttccagccaacactcttcgcgatgctggtcttggatgcctttgaccaagtggcggtgattgctcagctcaagggcattcatttggtccacgacctggatgaggcggacgaggccatggtctctgccgatcaatcactgctgactcgagcactgttcaacgtgctggaaaacgccatcaaatactctccatcgggcactaccgttaccttgagccatggcagcgcgcagggatggctggaatgccgtatcagcgatcagggcccaggcattgcgccgcaggatttgccggagctgttcagccaataccgacgcttcgactccgcccaaggcagtgaaggattaggcctgggattaaccatggtcaaagccgtggtggagcgccatggcggtcgtattctgtgtgaaagcgagctgggcaaaggctcaaccttcagcctgcaactgccgctgctcgaagagtgaaaaaacgtactttttagctgtgcataaaaaaccggtcacaaggaccggtttttttatgcggaaaaaacttatgcacgtttttcgcaatattatgagcttgagaaatatgtaagaaaatcagcttcttatgaagcaaaaaggccaattcgccaacaaaccgtacacaggttatccacagaagctcaaatcgctggtgtctctacaacaacgggctctggaggcagcgaacccatggcccgttgctgtgcttcattccaggctgcggcgcggtcgttcaaggcggcaatggcacgcggtccttcgccttctgcgtacatcggctcaccaatgaccacggtgatggtgccttcgcgtttggcccagccagtcttcggccagaacttgccagcgttatgcgcaatcggcaacaccggcaggttggcgttgaccgccaaggcggtgccgccgcgggagaatttgcccacggtgccgaacggcacgcgtgtgccttccgggaagatcagcacccaaacgccatccttgagcagctcatcgcccttcttggcgacgtgcttgagcgcagccttggggttgtcacggtcgatggcgatcggacgcaacatggccatggcccagccaaagaacggcacgtacagcagctcacgcttaagcacctggctcaggggcgagaagtaagccgagaggaaaaacgtttcccaggtgctctggtggttcgacagaatcacgcagggttggtccgggacgttttctgcgcccttcacctcgaaacgaatattcaggaacaccttggtcagccacaacgcgcagcggcaccaatagacgttgataaagcgatagcgcgccctgaacggcaggaacggcgcaataaaaaagctcagggtgcaccagagaaacgaactggtgcccagcagcaggtaaaagaaaaaggttctgatggcctgcaagatcgacatggcggcatttaccgttgcgggacacggcccgcctgttaaaagcgcactcccgagcaatccttgttcaggaagtcgagggcggctagttgttaataagttctgcggcaaccgccgccagatcgtcaaaaatcaaagtgcctaccggcaggttcttcgcctgggtcttttcgcctttcccggtctttaccaaaactggctgagaatcgacggctttggccgcctccaggtcaccgaggctgtccccgacgaaccatatcccagccaagggcaccttgtaatgttctgcaatagttttcaacatcccaggtttgggtttgcggcaatcgcagccctcatccggcccgtgggggcagtacaccaccagccccacctcaccgccctgctccgccaccaacgtgcgcaagcgcgcgtgcatggcgtccagggtggcaatgtcgtagtaaccgcgggcgatgccggactggttggtggcgatggccaccgtccagccggctttgctcaactgcgcgatggcctcgatcgagccgggcagtggaatccattccgccactgacttgatgtaagcgtcggagtcgtaattgatcaccccgtcccgatcgagaatcagcagtttcaacatgatcagcccagtacggaaatgtcagcgatgttgatgaacaagccgcgcagacgcgccagcatggcgtagcggtttttccgcacgccggcatcttcggcattgatcattaccgcttcgaagaacgcatccaccggctcacgcaaggcggccaggcgcgccagtgcttcggcgtagttgcgttcggcgagcagcggcttcactgcgttttctgccttggcgatggccgagttcagcgagaactccttggcatcggcgaacaggcctgggtcgacttcggcattgccgaggttgtcggccttgctcagcaggttcgacacgcgcttgttcacggcggccagggcatcggcttccggcagcttgcggaaggcctgtacggcttgcacacgctgatcgaagtccagcgccgaacccggttgcagggcacgtaccgacaggtagacggaaacgtccacgccttcgtcttcataacgcgcacgcaggcggtcgaacacgaattccagcacttgctcggccaggccggcttgcttgaccttggcaccgaattggccgacggcaaacaccacggcctgggtcaggtcgaggtcgagcttcttgtcgatcaggatacgcagcacgccgagggcggcacggcgcagggcatacgggtctttgctgccggtcggcagcatgccgataccgaagatacccacaagggtgtccagcttgtcggcgatggccacggccgcaccggtcagggtggttggcagttcagcgccggcaccgcgcggcatgtactgctcgttcagcgccagggcgacatcgtccggctcgccgtcgttgagggcgtagtagtaaccggcaacaccttgcatctccgggaactcgccgaccatttcggtggccaggtcgcacttggacagcaggcccgcgcgggcagcccaggcagcatcaccgccaatgcgtggcgcaatgtaggcggccagcttggaaacacgcacggccttgtcgtagacgctgccgagtttttcctggaacaccacgttttgcaggcgcaggttgaagtcttcgagcttctgcttcttgtcttgcttgaagaagaactcggcgtcagtcaggcgcgggcgaacgactttttcgttaccggcgatgatctgctgcgggtccttgctttcgatgttggccacggtaatgaagcgcggcagcaacttgccgtccacgtccagcaggcagaaatacttctggttgtcctgcatggtggtgatcagggcttcttgcggcacatcgaggaaacgctcttcgaacgagcacaccagcggcaccggccattcaaccagcgcggtcacttcgtcgagcaggcttggcggcacgatggcggtgccttcctgcaggcgggccagctcttcggtgcgcttgctgatcagctcgcgacgctcattggcatcggccaacacgtaagcggcacgcaggtcggcggcatagttggccggcgaggtgatgcgcacagcttgcgggtggtggaagcggtgaccacgggaatcacggccggccttctgggcgaggatggtgcaatcgatgacctggtcaccgagcagcatcaccagccattgggttgggcggacgaattcttctttgcgagcgccccagcgcatacgcttggggatcggcaggtcgttgagggaatcttcaacgatggtcggcaacaggctcgccgtcggcttgccggtgatgacctggctgaaacgcagtttcgggccgctctggtcgatttcgctcagctcgacgccgcacttcttggcaaaaccaagggcggcttgagtcgggttgccttcagcatcgaaagccgcctggcgcggtgggccgtcgaggttgatgctgcggtccggctgctgggtttccagcgcggtcagcaacacggccaggcgacgtggcgcggcgtagactttttttgcagcgaacttcaggccggctgtgtgcaggcctttttcgataccggccaggaatgcctcggccagggtgttgagtgccttgggtggcagctcttcggtgcccagttcaaccaaaaaatcttgagcactcattgtgcagcctccagcttagccaacacttcatcacgcaaatccggggttgccatcgggaagcccagcttggcgcgagccagcaggtaggcttgggcgacggaacgcgccagggtgcgtacacgcaggatgtattgctggcgcgcagtcaccgaaatggcacgacgggcgtccagcaggttgaaggtatgggacgccttcaacaccatttcatagcttggcaacggcagcggctggtcgagttcgatcaggcgcttggcttcgctttcatagaagtcgaacagttcgaacagcttgtcgacgttggcgtgttcgaagttgtaagtggactgctccacttcgttctggtggaacacatcgccgtaggtcactttgccgaacgggccgtcagcccacaccaggtcgtagaccgaatccacgccttgcaggtacatggccaggcgctcgaggccgtaggtgatctcgccggtcaccgggtagcactcgatgccgcccgcttgctggaagtaagtgaactgcgtcacttccatgccgttgagccagacttcccagcccaggccccaggcgcccagggttggcgattcccagttgtcttcgacgaaacggatgtcgtgcaccagtgggtccaggccgacatgtttcagcgagcccaggtacagctcctggaagttgtccgggttcggcttcaataccacctggaactggtagtagtgctgcagacggttcgggttttcgccgtagcggccgtcagtcgggcgacgactgggctgcacataagcggcgttccaggtttccgggccgatggcccgcaggaatgtagcggtgtggaaagtgccggcgcctacttccatatcgtagggctgaagtaccacacaaccttgctcggcccagtattgctggagggcgaggatcaagtcttggaaggtacgcacggctggcgtaggctggctcacgaaattcacctgttacttgggctgcgatttaaagagcgggagtatacccgattcggccccgccaccactccctggagccttatgccacgctgcttttggtgttctgaagatccgctgtacatggcttatcacgatcaggagtggggaacgccgctgcgcgatgcgcagggtctgttcgagttgcttttgctcgaagggttccaggcgggcctgtcctggatcaccgttttacgcaaacgcgagcattatcgaaaggtcttgttcggctttgacgcacagcgtctggcacaactgagcgatgctgaaattgaagcgctgatgcaggacccaggcatcgtgcgcaatcgcttgaagctcaacgccacccgccgcaacgccgcggcctggctggcgctggaggatccggtgggcttgctctggtcatttgtcggcggcgtgcccaaggtcaaccacttcaaggatcgcagcgaggttccggcgattacgcccgaggccgaagccatgagcaaagccctgaaaaaagccggttttaccttcgtcggcccgaccatttgctacgcgttcatgcaggccagcggcatggtcatggaccacacccaagactgcgaccgttacgcggacttggccaacgccggttagaatgcccgctttgcgcaccacacacgatcaggagtgacctgtggaaaagtttaaaggcgccttgctggtaggcgctcttcggttatttgccctactgccctggcgcgctgtccaagccgtcggcacggcgattggctggatcatgtggaaaacccccaaccgctcccgcgagacggtgcggatcaacctctccaaatgcttcccggacatggaccccgccgcgcgcgagcgcctggtcggccaaagcctgatggacatcggcaagtccctgaccgaaagcgcctgcgcgtggatctggccggcacagcgctccatcgacctggtgcgcgaagtcgaaggcctggaagtgctgcacgaagccttggcctcgggcaaaggcgtggtcggcatcaccagccacttgggcaactgggaagtgctcaatcacttctattgcaaccaatgcaaaccgatcattttttaccgcccgcccaagctcaaggcggtggatgaattgctgcaaaaacagcgtgtgcaactgggcaaccgcgtggcggcttccaccaaggaaggcatcctcagcgtgatcaaggaagtgcgcaaaggcggccaagtaggcattcccgccgacccggagccagctgaatcggcaggcatcttcgtgccgttcttcgccacccaggcgctgaccagcaagtttgtgccgaacatgctcgccggccacaaggcggtcggtgtgttcctgcatgcgctgcggctgccggacggttcgggctacaaagtgattttggaagcggcgccggaagacatgtacagcaccgacaccgccacgtcctgcgcggcgatgagcaaggtggtggagcgctatgtcggcgcctacccgagccagtacatgtggagcatgaaacgcttcaagaaacgcccgccgggtgaggcgcggtggtattaattcacccagatccaagcccaatgaagctctaatgtgggagctggcttgcctgcgatagcatcacctgggtatcactgatacgccgaggtgcctgcatcgcaggcaagccagctcccacagggattactttacccctggcgatcgagtttcttcaggaacaccgtcatctctttttcggcctgcttgtcgccatgcgccagggccgcttctatgcccttctcccacgcatgccgcgccgctgcgctatcacccaaccccagctgcgccttgcccaacaacttccacgccgccgaatacttcgggtcgaactcaacgcatctgtgcaaatgctccgccgccttggcgttgtccttcaggtccagataacccttgcccaagccaaagcgcagcaatgaattatccacacccttggcgagcattttttccagggattcgagcatggctgtgagtcctttagctgtatagggtttgcgatcacctgtgggagcgggcttgcccgcgatgacggtggcaggctcacctgatttttatcagaagaaactcaagcccacgtggaacagcttctccacatcgcggatatgttttttatccaccagaaacagaatcacatggtcgcccgtggcgatcactgtgtcgtcgtgggcgatcagcacctcttcgtcacgaatgatcgcgccgatggtggtgcccggcggcaggccgatatcgcggatcgccttgccgatcaccttgctcgacttcgagtcaccatgggcaatcgcctcgatggcttccgctgcgccacggcgcagtgagtgcacgctgacgatatcgccacgccgcacgtgggcgagcaacgtgccgatggtcgccagctgcgggctgatagcaatgtcgatatcgccgccctggatcaggtcgacgtaggccgggttgttgatgatggtcatcaccttcttcgcccccagccgcttggccagcagcgaggacatgatgttggcctcgtcatcgttggtcagtgccaggaagatatcggcgtcggcgatgttctcttccatcagcaggtcgcggtccgacgcgctgccttgcagtacgacggtgctgtcgagggtgtcggacaaatgccggcagcgcgccgggctcatctcgatgatcttcacctgatagcggctttcgatggcctcggccaagcgttcgccgatctgcccacccccggcgatgacgatgcgcttgtaagtctcatccagccggcgcatttcgctcatcactgcgcgaatattcgcctttgccgcgatgaaaaatacttcgtcgtcggcttcgatcacggtatcgccctggggcaggatcggccggtcgcgacggaaaatcgccgccacgcgggtttccacattcggcatgtgctcgcgcagttggcgcagttgctggccgaccagcgggccgccgtaataggcctttactgccaccaattgcgctttgccctcggcaaagtcgatcacttgcaaggcgccgggaatctcgatcaggcgcttgatgtagtgggtgaccacttgctcggggctgatcaatacgtcgactggaatcgcatcgttatcgaaaagcccggcacgggtcaggtaagccgcctcacgcacgcgggcgattttggtcggggtgtggaacagggtgtgagcgacctggcaggcgaccatattggtctcgtcactgttggtgacggcgaccagcatgtcggcatcgtcggcaccggcttggcgcagcaccgtcgggaacgacgcacggccttgcacggtgcggatgtccaggcggtcgccgaggttgcgcaggcgttcggcatcggtgtcgaccacggtaatgtcgttggcttcgctggccaaatgctcggccagcgtgccgccgacctgccctgccccaaggatgatgattttcatccggtcactcccttaaacccattcagccgcgtgcggcggcaatcttgatcagtttggcgtagtagaagccatcgtgtccgccttcctgtgccagcaattggcggccatggggctgcttgatgcccgccgccgtggccaggtccagctcgcgcgcgccgctggtgcgggcgaggaaggcttcgatcacctcggtgttctcggtgggcaaggtcgagcaggtggcgtaaagcaggatgccgccgacttccagggttggccacaaggcgtcgagcagttcgccttgcagcacggccagggcggcgatgtcgtcgggttggcgggtcagcttgatgtccgggtggcggcgaatcacgccggtggcggagcatggtgcgtcgagcagaatgcgctggaagggtttgccgtcccaccaggtggcggtatcgcggccgtcggcggcgatcagctcggcgctcaggcccaggcgggcgaggttttcgcgcacgcgcaccaggcgcttggcttccaggtcgacggcgactacaccggcgaggtctttttcgacttccagaatgtgacaggtcttaccgcctggcgcgcagcaggcgtcaagcacgcgctggcccggtgcgaggtcgagcaggtcggcggccagttgcgcggcttcgtcctgcacgctgatccaaccttcggcaaagcccggcaaggcgcgcacgtcggtggccgcttcgagcacgatgccgtcgacgctgtacacgcacggggtggcgttgatgccggcctcggtgagcaattgcaggtaggcgtcacggctgtgatggcggcggttaacccgcagaatcatcggcggatgcgcattgttggcggcgcaaatggcttcccattgctcaggccagaaggctttcagggatttttgcagccagcgcgggtgggcggtgcgcaccaccgggtcgtgttccaactcggccagcagcgcttcgctctcgcgctgggcacggcgcagcacggcgttgagcagcgccttggcccagggctttttcagcttgtcggcgcaacccacggtttcgccgatggcagcgtgggccggcacgcgggtgtagagcagttgatagagaccgaccagcagcagcgcctccacatcggcatcggccgccttgaacggcttttgcagcaacttggccgccagcgccgacaagcgcggctgccagcgggcggtgccaaaggccaaatcctgggtgaaaccgcgatcacggtcttcgaccttatccagctgggtgggcagtgaactgttcagcgaagccttgccgttgaggacggcggcgagagccttggcggcggccagacgcgggttcattgagcgaccgccccgagaaccgtgcccagggcaaatttctcacggcggctgttgaacaaatcgctgaaattcagcgccttgccgccgggcaattgcagacgcgtcaggcacagcgcctgctcaccgcaagcgaccaacaggccttccttgctggcgccgatgatttcaccgggagcgcctttgccgtcagccaaggtggcggccagcactttcaaggcttcgccgctgagcgtgctgtggcagatcggccacgggttgaaggcgcgcaccaggcgctccagctcgacggccgggcggctccagtcgatgcgcgcttcgtctttgttcagtttgtgggcgtaagtggccaggctgtcgtcctgcacttcgccgtccagtgtgccggcagccaggccggcgatggcttgcaccacggcaggcgggcccagctcggcgagacggtcgtgcaggctgccgccggtgtcttcggcgctgatcggggtggtgactttaagcagcatcgggccggtgtccaggcccgcctccatgcgcatcacggtcacaccgctttcgctgtcaccggcttctacggcgcgttggatcggcgccgcaccgcgccagcgtggcagcagcgacgcgtggctgttgatgcagcccaaacgtgggatatccagcaccgcttgcggcaggatcaagccataagccaccaccaccagcaggtccggcttcaacgcggccagttcggcctgagcctcggcgttgcgcagggtcggtggttgcagcacctgaatgttgtgctcaagcgccaactgcttgaccgggcttggcatcagtttttgcccgcgaccggccgggcggtccggctgggtgtacaccgcgacgatgtcataagggctggcaagcagggccttgaggtgttcggcggcaaattcaggcgtgccggcaaaaacaatgcgcagtggctcggtcatgggaggtctcggttaaaaacagtcacaaaagaaaaaggcttgccgcagcaagcctttggaagaagggcatcaagcttgctggcgatgctttttttccagcttcttcttgatccggtcgcgtttaagcgtggacaggtaatcaacaaacagcttgccgttgaggtggtcgcactcgtgctggatgcacacggcgagcaggccatcggcgatcagctcgtacggcttgccatcacggtccagcgccttgattttcacgcgcagcgggcgctcgacgttctcgtagaactccggcaccgacaggcagccttcctggtattcgcccatctcgtcggtcagcggttcgaactcggggttgataaacacccggggttcgctgcgatcttccgacaggtccatgaccacgacgcgctgatgcacgttgacctgggtggcggcgaggccgatgcccggggcttcatacattgtttcaaacatgtcatcgaccaactgacgaaccttgtcgtccactacggccaccggtttggcgatcgtgcgcaggcgcgagtcgggaaattcgaggatgttcaaaatagccataagcgtaattgctgcacatgtgaggtagaggcaaatcggcggtgggatggacccaggcagccggtgtgaaaagttcgaaagccgcgaaggctatggcatttcacgcgaacgcacataataaaggagattcaccccatgaggaaatcgctactcgtcttgctgctgtgggcgccgctcaccctggccatgattccacagcccggccagcgcctggaacacgcgacgcaacaggccatccagcactttttactgcacaaccgcattctcgattcagcccaggacctggataacgcgccttacattgtcgcggccgacgcgggccgagtgttgggcgccaacggcgagcgtgtgtatgccagaggcgtcttggatccgacccagccaagctacgggatctttcgacgcggcaaggcctacaccgaccctcaaacccaagagatgctgggcataaacgccgacgacgttggcactgcacgctttgtgatggcgggcgatgtttccacccttgcggtgcagcgggtcacccaggaaatccgggcaggtgaccgcctgttgcgtgccgaaccacccgctgagcaggccagcctgaagcctgggcccttcatagaagggcacatcatcgacgtgcccagaggcgtcacccagatcggcgtattggacgccgtgaccctgaacaaaggccgccgcgacggcttggtcgaaggccaattactcacggtgatcaaggctggtgccaccgtacgcgacaccctgactggcacgcaaaccaccctccccgatgagcgcgccggcacgctgctggtgttccgcacctatgaaaagctcagttatggcctggtgctgagtgcctcgcgcgcactcgccgttgaggaccgattcgagactgcccgacaaacacaataaatagcctgctaaataagttaccaacagagttatccacagcttgttccggtcaaggatgatcaaatgtatccgataaacagcagtgaaatttccccgtcagaactggaagctcggctacgcttgcacaggctgccggaactgggtcccaagcgttttcgtgtattgatcgatgcgttcggctctgcctcaaaggccatcagcgcccctgccagcgcctggcgttccctcgggttgccggccatcagcgccgatgcccggcgtagccctgaaatacgtgacggtgccggtgaagcattggcgtggttggagcagccggcccagcatttgctgatgtgggaccaacctgagtacccggcactgctcgcccagatcgacgacgcgccaccgttattattcgtcgctggcgacccgaaaatcctggaaaaaccgcagttggccatggtcggcagccgccgtgcatcccgccccggcatggacaccgccgcagccttttcccgcgccttggcgagtgccggtttcgtcatcaccagcggcctcgcgttgggtatcgatggcgcggcgcaccaggcagcgctggatgttggcggccagacaatcggcgtgctcggcaccgggctggaaaacttttatccacagcggcaccgacggctcgcagcggcgatgattgcccagggcagcgcggtggtttccgagtttccgctgaacgccgcaccccaggcggctaacttcccccgacgcaaccgaatcatcagtggcctctcactgggcgtgctggtggtggaagccagcatggccagcggttcgctgatcaccgcgcggctggcggccgaccaagggcgcgaggtgtatgcgatccctggctccattcatcacccaggcgcaaagggttgccatcagttgatccgcgatggcgcgacgctggtggaatccatcgagcatattctagaaggcttgcgcggctggcaggccctgtcccgcccgacgccgatgccggtgactcacccactggtggcgctgctgcacgcggcgccgcataccagcgaggccttggcgattgccagcggtcggcctttgtcccacgtgctggcgacactgaccgagcttgagctggaaggccaagtgatctgcgaaagcgggcgctggctcgcgcgctgctaggttttgtaaagaagatcggtaaactgcgcagagctttagtccggagagtgagcaatggtcaacaggtggcgtgtgctggaaaccgcacgagaaattcgcgcaggcgcggtgatcgcctatccgaccgaagcggtctggggcctgggctgtgacccgtggaacgaagaagcggtggaccggctgctggcgatcaagaatcggtcggtggataagggcctgatcctggtggcggataacattcgccagttcgattttctctttgaagacttcccggacacctggatcgaacgcatggccagtacctggcctgggccgaacacctggctggtgccgcatcaggacttgctgcctgaatgggtcaccggtgtgcatgacacagtggcgttgcgggtgagcgaccacccgttggtgcgggatttgtgttcgttggtcgggccgctgatttccacctcggccaacccacagggccgcccggctgcgcgcacgcggcttcgtgtggagcagtatttccgtggccaggtggatcgggtgctgggtggtgctttgggtgggcgcaagaacccgagcctgattcgcgatttggcgacgggtgaggtggtgcggccgtcctgagacccaggtgcggccatcgcgggcaagccctgctcccacagggaaatgcgatcaaaatgtgggagccgggcttgcccgcgatgaggcccttaaaacctcaagagatctaccgccttatggcagcaaaatagtcgaccccgtcgtccgccgccccgacaactcagtctgtgccttcgccgcatctgccaacgagaaccgctggttgatatcaatgcgcaccttgccgctcttgatcatcgagaacaggtcatccgccatcgcctgcaggtctttcgggttgctggcgtaggtggccaaggtcggccgggtgacatacagcgagcccttcgccgccagaatccccaggttcacgccatccaccgcgcccgacgcattcccgaaactcaccaccagcccacgcggcgcaacgctgtccagcgaggtcagccaggtgtctttaccgacgccgtcgtacaccaccggcacctttttaccgtcggtcagttccagcacgcgttgtgcgacgttttccttgctgtagtcgatggtttcccaggcgccgagggatttggccagtgctgccttttccggcgaactcacggtgccgatcagcttcacgcccaaggccttggcccattggcaggccagcgaacccacaccaccggcagcggcgtggaacagaatggtttcgccgcccttcaattcgtaggtctgacgcagcaggtactgcacggtcaggcccttgagcatggcgccagcggcttgttcgaagctgatgtcgtccggcagatgcaccaggttggcggcgggcaatgtgtgcaactcgctgtaggcacccagcgggccgctgccgtaggccacacggtcgcccacgttgaattgcgtgacttcgctgcccaccgcgtcgaccacacccgcgccctctgcgcccaggcccgaaggcagcgctggcggcgcatacagaccgctgcggaaataggtgtcgatgaagttcaggccgatggcctcgttacgcacgcgaacctgctgcgggccaggctctgccggcgtgtagtccacatactcaagcacttcggggccgccatgggcgctgaactggatacgtttggccatctgcacttctcctgaggtcgaattcgcgtagccctctatcccactcctatgcttgatcttcgtcaactgcggcagcatggagtgcggtggtatcctgtgcgcccatttgccgccgacgcccaatggcctcgcgtagctttgcccgattcaaggtgatgccatgactactcgcaccgaggctgttaaagcctacctgctcgacctgcaagaccgcatttgcagcgccctggaaaccttcgagacggacactcgctttatcgaagacgcctggacccggcctgccggcggtggcggtcgcacccgtgtaattgaaaacggcacggtgatcgaaaaaggcggcgttaacttttcccacgtgttcggcagcggcctgccaccgtcggccagtgcgcatcgccctgagctggccggtcgcggctttgaggccttgggcgtgtcgctggtgatccacccgcacaacccgcatgtgccgacgtcccacgccaacgtgcgctttttcatcgccgaaaaagaaggcgaagaaccggtgtggtggttcggcggcggcttcgacctcacgccctactacggcaacgaagaagactgcatccactggcaccgcgtggccgagcaggcctgtgcgccgtttgggccggacgtgtacgcgcgctacaaggcgtggtgcgacacctacttccatatcaagcaccgcaacgaaccgcgcggcatcggcggcctgttcttcgatgacttgaacgagtggggcttcgacacctgcttcgccttcatccgcgccatcggcgatgcgtatatcgacgcctacctgccaatcgtgcagcgccgcaaggccatggcgtacaccgagcaacagcgccagtttcaagaattccgccgtgggcgctatgtcgagttcaacctcgtctatgaccgtggcaccctgtttggcctgcagtcgggcgggcgtaccgagtcgatcctgatgtcgctgccgccgcaagtacgctggagctacgactggaaagccgaggccggcagcgaagaagcgcgcctcaccgattacttcctgcaagaccgcgactggctcggcattgccgcgcccaaggcggcggtctgatggatcgttatgtcgtgttcggcaaccccatcggccacagcaagtcgccgttgatccaccgtatgtttgccgagcagaccggcgagcaactggactacagccccttgctggcgccgctggaggatttcaccggctgtgcccgtgagttttttcagcaaggccgtggcgccaatgtcaccgtgccgttcaaggaagacgcctaccgcctggccaacagcctgaccgaacgtgcccagcgggccggggcggtgaacaccttgagcaagctggccgacggcacgttgctgggcgataacaccgacggcgccggcctggtgcgtgacctgacggtgaatgccgggttgagcctgcaaggcaaacgcatcctgctgctcggcgctggtggcgcggtgcgcggggcgttggagcccttgctggccgagcaaccagcgtcgctgatcatcgccaaccgcaccgtggaaaaagccgaattgctcgccgagttgttcgacgacctgggcccggtgtccgccagcggtttcgactggttgcgtgagccggtggatgtgatcatcaatgccacgtccgccagcctttcaggcgatgtaccgccgattgccggcagcctgatcgagccgggtaagacgttctgctacgacatgatgtatgccaaggaaccgaccgcgttttgccgttgggctacagagcaaggtgccgcggtggcgatggatggtttgggcatgctggtggagcaggcggcggaagcgttcttcctgtggcgcggcgtgcgcccggactcggcgccggtgttggctgagttgcggcggcagttgtcggcctgacacaaatccaaattggggcacggtcaaaatgtgggagctggcttgcctgcgatagcggtgtgtcagatacaagtttgttggctgagccaccgctatcgcaggcaagccagctcccacagttttaatcctgtttattcttcaaaatggatggggcatttgtcggccccttccaatttctttaattcttccaccacctgcggtctggccccgcgcaacgtcaggctacgccccaaccccttcaaccgccgcgcctcctgatgcagcatctccacccccgaatagtcgataaagttgatctgctgcgcttcaatcaccacccgctcgccctgcaaactctgcagccgcacttgcaggtaatggctggcgccaaaaaatatcgagccgccgacccgcaacacatcttcgtcaccatcgcgccactgctgcacgcgcggttgcgaggtgcgcttgaggtagaaaaacaacgaggccagcaccccggcatagattgccgtttgcagttccagcagcaaggtggcgacgcacgtcaggctcatcaccacaaactcggcgcggctgacgcggaacagtgcgcgaataccgcggtaatccaccaggccccagcagatcagcaggatgctggcggccatgctcgggatcggaatatgcgcgatcaacgccgcaccaaacagtgcgaataaagccacccacagcgcagaaaacacgcccgccaagggtgagcgggcgcccgcttcgtagcttaagcccgagcgggtaaaggaaccggctgacaagtagccggaaaaaaatccgccaacgatattggataaaccttgcgcgcggacttcctggttggcatccagcagttgctgcgaacgcgccgacagcgagcgcgcaatcgacaggctcgtcaccagccccagcatgcccaccgccaccgcactcggcagcaaacgcagcagcgtatccaggtccattggcaacgggctgaacggcggcagcttgcccacaaacgaactgacctgcgccacgtgcccgaacatcgccggccacagccaggccaccaggctgcccagcgccaaggcgatcaacagcgtcggccagcgtggcacccggtatttgagcaacgcgcctaccagcaaggtgcctacgcccagggcgagggaagcgtggtcccattcgccagcgtgatcgatgagcgccagcaggcttttaatcgccgtggcctggctgggtagatccagcccgagcaagttgggcaactgccccaaggcaatcactacggcagcacccagggtgaacccgagtaccaccgagtgcgagacgaaattcaccagcgcgccgaagcgcagcatgcccagcagccactggaacaccccggcgagaaacgtcagcagcaggatcagcgtgatgtagtcctgcgaccccggcacggccaaggggctgacgctggcgtagagcacgatggaaatggcggctgtcgggccgcagatcaggtgccaggaggaaccccaaaggcaggcgatcagcaccgggatgatggcggcgtacaggccgtattccggtgggagaccggcgatcagcgcgtaggcaatcgactgcggcagcgcgagcacggcgccactgaggccgaccatcgcatcccggccgacgctggcgcgggtttggcgcggtagccaggcgaggaaggggaagagagtgtggcggttgggccggggcatcgcaaactcggtcgaaaaggttatctcagggtatcagcacataccggtacctgtgggagctggcttgcctgcgatagcatcacctcggtctgactgattgaccgagccgtctgcatcgcaggcaagccagctcccacaaaagccagttcccaaaaaggatcgatttcgggggttagagcttggcttttaccgcaggcagcgcatcctggccatccacggtttttaccccgtcgagccacttatccaacaccgccggattggccttgatccacgccttcgccgcctcggcattgctgagctttttattcgccacctcagccatgatgctgttctccatctcctgtgtgaaactcaggttggtcagcagcttcccgacattcgggcaggcctgtgcataacccttgcgggtcagggtgaacacgctgcctttgtcaccgaagtacttctcgccgcctttgaggtaatgcattttcaactgcacgttcatcgggtgcggcgtccagccgaggaaggtgacgaatttctgtttcttcaccgcccgcgacacttcggcgagcattgcctgttcactcgactcgatcagcttccactggcccagatcgaagtcgttcttcttgatgatctcctgcagcgaaatattcgccggtgcgccggagccgatgccgtagatcttcttgtcgaacttgtcggcaaacttgttcaagtcagcaaagtcatgcaccccggcgtcccacacgtaatccggcacggcgagggtgaactcggtgccgtcgaggtttttcgccagttgcaccacgtcgccattggcgatgaacttgtcatagaaaccctgctgcgccggcatccagttgcccaggaacacatcgacctggccgtccttgagcccgccaaatgtaatcggcaccgccagggtgtcgaccttggccttgtagcccatgccgttcagcaaaaaaccggtgatggcattggtggcggcgatatcgctccagcctggatcggccatcttcaccgtgtcacagctggagtccgcgtacacattggcgctactgagcaccaacatgcccagcactacagtcaacttttgcatggccttccctctgtctaattattggttttggcagggttgtggataacgtgccttgcgctccaggtcgtcgaggtcgatatggttgcgcatgtattgctgactggcgtccaccagtggctggtgatcccagctcttcagcttgccttgggtcagcgcctcaaacaccaggcggcgacggcgttggctggcgagcacctgttggtggatcgccgggatgtcccatttggcccgcgcctccctcaaaaacgcctcgaacagtggccggtgttccggtgactggctgaggttttcccgctcgtgcgggtcgttgtgcacatcgaacagtagacaagggtcgtcttcgctgtagatgaatttgtaagcgccacggcgaatcatcatcaatgggctgatggtgccttcggccatgtactcgccaaacacttcgtcatgcccgccctgccctcgcaaatgcgcgagcagcgagcgcccgtccagcggcaagcgcgggtccagctcgccgccggccagttccaccagggttggcaacaggtcggcggtggacacggctttgctcacgcggcccgccgcaaactgcccaggcgcactgaccagcagcggcacgcgagcggccatttcgaaccagtgcattttgtaccaaaggccgcgctcaccgagcatgtcgccgtggtcgccggagaaaatgatgatggtgtcatcggccaggccggtgtcttccagggtttgcaggagtttgccgacgttgctgtcgatgtagctgcacgcgccgaaatacgcacgccgcgcgtcgcgaatcttgtccaccggcagcggcttgtcccacaggtcatagaccttgagcaggcgctgggaatgcgggtcgaggtcggcctgggcgggcgtcgcaggcaacgggatgtcgctgtcgtcgtacaggtcccagaacggcttgggaatcgtgtacgggtcgtgtgggtgagtcatcgacacggtcaggcagaacggctgctcgccgtcttcgcggatatggtcgaacaggtactgctgggccttgaacaccacctcttcatcgaaatccagctggttggtgcgcacgcacgggccggcttgcagcaccgaggacatgttgtgataccaggtggggcgcacgtccggctcatcccagttcactgcccagccatagtcggcggggtagatgtcgctggtcaggcgttcttcatagccgtgcaactggtcagggccgcagaagtgcatcttgcctgacagcgcggtgcggtagccgaggcggcgcaggtagtgggcataagtcggcacatcggcagggaaatctgccgcgttgtcgtaggcgccgatcttgctcggcaactggccgctgaccagggtgaagcgcgacggcgcgcacagcgggctgttgcagtaggcggcatcgaagaccacgccctgttcggcgaggcggctcaggttcggcaatttgatcggggaaggtccgtagaaaggaagcagcggcgcggccatttgatcggccatgatgaaaagaatgttcttgcgcttcatgagtcttcggcattccataggcagtgtttatgcgaatgagcatgcagcccatggaaaatggggtaaagcccatgaagagcaatgtctaggataagcacagcttatgtatgaagccctcggcgatgtatccctcgacctgctgcgcgcgttcgaggcggcggcgcgccaccgcagctttaccgctgcggccatggagctgggcaccacccaaccggccatcagccagcagatcaagcgcctcgaagaacagctggcgattcgcctgtttgatcgcatttaccgtggcattgaactgaccgatgccggcgccctgttgttcgagcatgtgcaaggcggtttgcagaccatcaaccaaggcctgagcgcgatcacccagcaggaccagcatgaagtgctgcaagtggccaccgacttcgccttcgccgcctattggctgatgccgcgcctgcaccgctttcaccaggccaacccgcaggtcgatgtcagcctggtgaccagcgaacgcaaccacgccaccttgcgcagcgatatcgacgtggcggtgttgttcggcgacggccgtttcaaacagggcgacagcctgtggctgttcaacgaggaagtgttcccggtgtgcagcccgcaatggctcaaggaccaagcccagccgctgacggtgcagacgttgcaggactatccgcttctgcacctgcgccaggaaaacaacagccagtggttcgactggagcggcgtgtttcgcgagctgggtattaccaccgcgcccacgcccggccaactgcgcttcgacaattacaccttgttgattcaggcggcgattgccggccagggcgtggccatcggctggcgccatttggtggataacctgctggagcagaactggctgtgccggccgatcagcgacacagtgatttcacgcttcggctattacgtggtgcaaccgcagcgcaaacgtcgcgggcaattggtcgagcgctttgtcgactggctggtggccgagcaagccagcagcgcgcaatcgctgaccgggctggccctgccgtcgattgcggtctaggatcggcgcatattggatccggatttcgccatgcaacgtatcaagggttatcacgcccatatctacttcgacgccagcaccatcgaccaggcgcgccagctctgcgaggacgcggccaagctgttcccgctgcgcatgggccgtgtgcacgaacgctcggtgggcccgcacccggactggagctgccagctggcattcgagccggagtacatcggcgtggtgctgccgtggttggcgttgcaccgcgaagggttggtggtgttcctgcaccctgataccggcgatgacctgaaggatcacaccgattacgcgatctggatgggcgccatgcgtgagctggacctgtctatcttttaaccagttctgatcaaaatcccgtcgccgcgtaaaagccgacgggattttttgtggattaacccaatatatgggactgttatttatatattgagatatcgccagtcataggtttatattcgcccatctgcttttttcagcacccactcatttcaggtgaagcgatgcaggcgcaattgatcgcgctcgactgggggaccagctcccttcgtgcttataaactcggcccggccggcaaggtgcttgaacaacgcacgctggcgttcgggatcatgcacctgcccagcgaacctcgggagattgccggcgtacgttgcagcgatggcttcgagttggcgttcgatgcggcctgcggtgattggctggaggccgaaccgagcctgccggtgatcgcctgcggcatggtcggcagcgcccagggctggagcgaagcggcttatcgcaacacgccggtcgatgtcgccagcctgggccaggcgctgcattccgtgcgcagcctgcgcggcgtcgaggtgcacatcgtgcccggcgtgatcgaacaagtgggcttgccgaatgtgatgcgcggcgaagaaacccaagtgttgggcgtgctgcagggcctcggtgcgcaggtgttgatcggcctgcccggcagtcattccaagtgggtcgaggtggtggatggctgcatcacccacttcgacaccttcatgaccggcgagctgtttgcggtgctgagccagcacagcatcctcggccgtacgcaaaaggctgccgaacactttcaggccgaggcgtttgatcgcggcgtgcacgtggcgctgtctgaagacggccagcgcggcgtgctttctacattgttcagtgcccgcaccctgggcctcaccgccgagctggcacctgaccagcagccggattacctctccggcctactgatcggccatgaactggccggcctgccggcgcacgcaaaacatcagcctatcgtgctggtcggcaccgcaccgctctgcgcccgttaccaacgcgccctcgccctttgcggcttcgcccacgtcagcctggcgcaagcggccaccgagcgcggcctgtggcaattggccgtggccgctgggctcactcaacctgtcctggaggcctgacatgctcaagcaagcactcgcacacaacggtttgatcgcaatcctgcgcggcgtacgaccggacgaagccgaggcgattggccaggtgctctatcaggccggctttcgggtgatcgaagtgccgctgaattcgccggacccttacaccagcatccgcaccctgcgcgacagcctgcccgccgattgcctgatcggcgcgggcaccgtgttgacgccggagcaggtcgagcaggttaaagccgcgggtggccaagtgatcgtcatgccccacagcgatgccaaggtgttgcgcgcggcgaaagcggcgggcttgtacctgtcgccgggcgtggccacgcccaccgaagccttcgccgccctggctgaaggcgccgatgtgttgaagctgttcccggccgagcaaatgggcccggcggtgatcaaggcgtggctggcggtgttgccgacgggcaccttgttgctgccggtgggcggcgtgaccccggacaacatgcaggtgtatttcgacgcgggcgccaagggcttcggcctgggttcggggttgttcaagccgggcatgtccgtggaccaagtggcgagcagcgcccaggcgtatgtcgccgcgtggaacgcgttgaattgatgccctgaaaagaaaacacgttttgcgccctcggcgctgcatcgacaagagagataagaagatgaaaatcaccaaactgaccaccttcatcgtcccgccgcgctggtgcttcctcaaggtcgaaaccgaccagggcgtgaccggctggggtgagcctgtggtcgaaggccgcgcgcacaccgtggcggccgccgtcgaagaactgtccgactacctgatcggcaaagacccacgcaatatcgaggacatctggactgtgctttatcgcggcggcttctaccggggcggcgccgtgcacatgagcgccctcgccggtatcgaccaggcgctgtgggacatcaagggcaaggcactgggtgtgtcggtcagtgacctgctcggcggccaggtgcgcgacaagatccgcgtgtattcgtggatcggcggcgaccgcccggccgacacggcgcgtgcggccaaagaggccgtggcgcgtggttttaccgcagtgaaaatgaacggcaccgaagagctgcaattcgtcgacagctttgaaaaagtcgacctggccctggccaacgtcgccgctgtgcgcgatgcggtgggcccgaacgtcggcatcggcgtcgacttccatggccgcgtgcacaagcccatggccaaggtgctgatgaaagaactcgacccctacaaactgatgtttatcgaagagcctgtgctcagcgaaaactacgaagccctcaaagaactggcaccgctgaccagcacgccgattgccctgggcgagcgcctgttctcgcgttgggacttcaagcgcgtactcagcgaaggctacgtcgacatcatccagcctgacgcttcccacgccggtggtatcaccgaaacccgcaagatcgccaacatggccgaagcctacgacgtggccctggccctgcactgcccgctgggcccgattgccttggcggcctgcctgcaattggacgcggtttgctacaacgcgtttatccaggagcaaagcctgggcattcactacaacgagagcaacgacttgctcgactacgtgcgcgacccgggcgtgttcgactatgacaaaggctttgtgaagatccccaacgggccgggcctgggcatcgagatcaacgaggaatacgtgatcgaacgcgcagccatcggccaccgctggcgcaacccgatctggcggcatgccgacggcagctttgccgagtggtaatcgtccactgaaggaaccggatcacctgtgggagctggcttgcctgcgatagcggtctctctgtacccgattagctggctgatacaccgccatcgcaggcaagccagctcccacctgaaccgtgtttttccagtaagacctgtcctcaataaacataacaagaggcaacccccatgcaccctgaatccttcaccgggcaggcttctttagtcacgcccagcagaaagcgcttcttcatcatggtgctgctgtttatcaccgtggtgatcaactacctcgaccgcagcaacctgtcgattgccgccccggcgttgaccagcgagctgggtatcgacccggtgcacgtcgggctgattttctccgccttcggctggacctacgccgccatgcagatccccggcggctggctggtggaccgcgtgccgccgcgtattctctacaccgtggccctgctgctgtggtcgattgccaccgtgatgctgggctttgccgccagctttatcgcgctgttcgtgctgcgcatggcggtcggtgcattggaagcaccggcctaccccatcaacagccgcgtcgtcaccacctggttccccgagcgcgagcgcgccacggcgattggtgtgtatacgtcggggcaatttgtcgggctggcgtttctcacgccggtgctggcctggctgcagcatgcgtttggctggcacatggtgtttgtcgccaccggtggcgtgggcattctgtgggcgctgatctggtacgcggtgtaccgcgagccgaaggatttcaaaggcgccaacgccgctgaaatcgagctgatccgcgaaggtggcgggctggtggacatgcaggcgaaagcgctcaaggcacccttcagttgggtcgacctgggcatcgtgctgagcaagcgcaagctttggggcatctacctggggcagttctgcctgaactccacgctgtggtttttcctgacgtggtttccgacctacctggtgaaatatcgcggcatggacttcatcaagtccggcttgctggcgtcgttgccgtttctggccgcgtttatcggcgtgctgtgttcggggcttttttctgactggctgattcgccggggcacgtcggtgggttttgcgcgcaagttgccgattatcggtgggctgctgatttccacggcgatcattggtgctaactatgtggactcgaccgcgtgggtgattgcgtttctggccgtggcgttctttggcaatggcctggcgtcgatcacctggtcattggtatcgaccttggcgccggcgcggttgctggggctgacgggtggcgtgtttaacttcatcggtaacttgtcggcgattaccacgccgattgtgattggctttctggccagcggcgattcgtttgcgccggcgattacctacattgcggtgctggcgttgctgggggcgctgtcctacgtgttgctggtaggcaaggtcgaacgcatcgaactgaatgaataacctgtggcaagcccgcccctgtggtgagcgggcttcctgtggcgagcgggcttgctgtggcgagcgggcttgccccgcgttgggctgcgcagcagccccctcaaggccactgcggtgtttcagaaaaaccgcgttattcggttttgggggcgcttcgcaccccaacgcggggcaagcccgctcgccaccacagccccgctcgcacaacaagcctgcctcaccacaagcgcatcggttttagttgagcacgccgtccagaatctcgtagacgatgcccgtgcccactgcaatcaacaccacatctggcccggaccggcgccattcatagccttggtaaaccggcaagcgcgacagggcgcggttatccaggcgttcgccgtaatagccgcgtggcaacggctggccgcgtaccaggcgtacattcggcggtggcggtgcgccgcgtgagaactggccgtggttgtcgtggatgatctgccgcaccgggccgaagtcccgaggcgggccgcggcggttgtcctgcgggccacgatggtcgtcgccacgttgttcgtgctggccttgcgggccgccacggccagggccatcgccatcaccgcgttggtcaggcggcgcggcctgcaccaaggcactcgcgccgagcatcagcacgccgagaccagcgatcaagcgtttaggcattttcatggggtgtttcctcagtactgcacgaacaaaaaagggatttcgaaccgggttcgaaatcccttggtcttgtcagtttaggtactgattcgacagtttgattcctctgtatcaggaactttacctactgctacatggcgtttacttacgggcgctgcgaacgccttccgacagcgccgcgcacaggcccaaaacaccgtcaatggcttgctgatcatttttggcactggcgatgtggtcgatcagtgccgaacccaccaccacaccgtctgccaggcgcgcgatggcggcggcctgttccggtgtgcgaataccaaaaccgatgctgatcggcaggtcggtatgccgacgcaggcgggtcacggcttcttcgacgtgttccagggtggcggcaccggcaccggtcacaccggccaccgacacgtagtacacaaagccggagccgccattcagcacggtcggcaggcgcacgtcgtcggtggttggcgtggtcaggcggataaagtcgatgcctgcggcctgggccggatcgcacagttcgccgttatgctcgggcggcatgtcgaccacgatcaggccgtcaaccccggcttctttcgcatcagcgatgaactgcggcacgccgtatttgtggatcgggttgaagtagcccatcaacaccagcggcgtttcgtggttgtctttgcggaattcgcggaccatctgcagggtttttgccaggttctgcttggcttccagcgcgcggatgttagccagctgaatcgccgggccgtcagccatcgggtcggtgaacggcatgcccagctcgatcacgtcggcaccggcggcaggcaagcccttgaggatcgccagcgaggtgtcataacccgggtcgccagcggtgacgaaggtcaccagggcggcgcggttttgttctttcagctgcgcaaagcgggtttgcaggcggctcatcagtgtttctcctgcttcgactgttccatatggtgcatcacggtctgcatgtctttgtcgccacggccagacaggttcaccaccatcaggtgatctttcggcagggtcggtgcgcgtttgaacacttcagccagggcgtgggcgctttccagcgcaggaataatcccttccaggcggcagcatttgtggaacgcctcgagggcttcgtcgtcggttaccgaggtgtactggacgcggccgatgtcatgcaaccaggcgtgttccgggccgatgccggggtaatccaggccggcggaaatcgagtgggcgtcgatgatttggccatcgtcgtcctgcaacaggaaggtgcggttgccgtgcagcacgcccggtacgccgccgttgaggctggcggcgtgcttgccggtttcgatgccgtggccggccgcttcaacgccgatgatttcgacgctggtgtcatccaggaacgggtggaacaggcccatggcgttggaaccgccgccgatgcacgccaccaggctgtccggcaggcggccttcctggacttgcagctggtcgcgggtttccttgccgatcacggcctggaagtcgcgcaccatcgccgggtacgggtgtgggccggccacggtgccgatcaggtaaaaggtgctgtcgacgttggtcacccagtcacgcagggcttcgttcatcgcgtccttgagggtgccggtgccggcgaccaccggaatcacttcggcgccgagcagcttcatgcggaacacgttggcttgctggcgctcgatgtcggtggtgcccatgtagatcacgcaatcgaggccaaagcgcgcggccacggtggcggtggccacgccgtgcatgccggcgccggtctcggcgatgatgcgttttttgcccatgcgccgcgccagcaggatctggccgatgcagttgttgatcttgtgcgcgccggtgtggttcagctcttcgcgcttgaggtagatcttggcaccgccgcagaactcggtcaggcgctcagcaaaatacagcgggcttgggcgtccgacgtagtcgcgctggaagtaggccagttcctcgttgaacgccggatcaatcttggccgcttcgtattcgcgggccaggtcgaggatcaacggcatcagggtttcggcgacgtaacggccgccgaacgcgccaaacaggccgttggcgtcagggccgttgcgaagatcggtctgggactgagtcatggggcgctccgttaaaaaggtgaggagaagcaatgacggccactctacccctgacgcgctacgctgaaaaccgataagatcgccgtaacctgtcaggaaaactcacagatgagccgagaccttccgcccctcaacgccgtgcgcgcgtttgaagccactgcccgcctcaacagcgtcagccaggctgctgagcaactccatgtgacccacggcgccgtcagccgacagttgaaggtgctggaggagcatttgggtgtcagcttgttcgccaaggacggtcgcggccttaaactcacagatgccggggttcggctgcgcgatgccagcgccgaagccttcgagcgtttaagggacgtttgcgccgaactgacccaggccagcgccgacgcaccttttgtgctcgggtgttcgggcagtttgctggcgcgctggttgatcccgcgcctgggtcgcttgaacgccgacttgccggatttgcgcctgcacctgtcggcgggtgacggtgacctcgacccgcgacgccccggcctcgatgccctgctggtgttcgccgaaccgccgtggcccgcagatatgcaggtgtacgagttggccagcgaacgcatcggcccggtgatgagcccgcgcttcgcaggttacgagcgcctgcgtcaggcaccgccgcaagccctgtgcgacgaagccctgttgcacaccacttcccgcccgcaagcctggccgagttgggcgcagcaacacggcatcgcgcccgacgcgttgaaacacggccaggggtttgagcatttgtattatttgctggaggcagcggtggcaggtttgggggtggcaattgcgccagaaccgctggtggcagaggacctgcgagcgggtcgcctggtggcgccgtggggtttttgcgaaaccccggcgcacctggcgttgtggctacccaagcgcgccgcagatgggcgcgcgggtcagttggcgcagtggctcaaggccgagttactgcgccagccgttatagccggtcaatcagtcgccgcgtttgcacagcaggtaggccgccagcagacccagcgcgccaacggcaacgccggcggtagtccatgggtgctcttgtgcgtagtcacgggttgcaacaccggtttcgcggattttgactttgctttcttcgtaggcatcgctgatcaggtgacgggagtgcttgagtgcattctcggcattgcttttcagggccttcagcgttttgcgcgactcatcggacgcatcatccttgaggctctcaagggacttgagcaggctcgaaatctcggcttccatgctttccagcgacgctttgcgtaaagaagtgttggccatgtggactctcctgaagtgattgagtggcatgtgtagataccgactacggcgttttcagaaagtgcagtaaatctgaactttcaggtaggaacagtcgccagaagcagtacgaacattgactgctacgctgactagagacctcaggagaaaacgctatgtctgatcaccacacgtacaagaaagtcgaactggtcggttcttcgaccaccagcatcgaagacgccatcaacaacgcaatcgccgaggcgcacaagagcatcaagcacttggagtggtttgaagtgaccgaaacccgtggtcacatcaaggacggcaaggccgcgcacttccaggtgacgctgaaggtggggttccgaattgccagtagttgatccggtgagttgaactttgctgactggccgattgccataacctgcgctacaaacaatgggtgccgatgcgataagcgtcggcacgctcttttcgatcagcgcaaggaaagtatcggatgaagaagttcctgttagcggtaggtttgttgagcattgcgggcacagccctggcggcgggcaagccttgtgaagagctgaaaagtgaaattgcagcgaaaatcgacgccaagggcgcttcgggttattcgctggaagtggtagataaaggcgcagcacccagcgaccacacagtcgtcggcagctgcgaaggcggcaccaaggaaatcgcctacaagcgcggttaatcccgtgttgcagacttaagaacgacgcacttgtggcgagggagcttgctcccgctggagtgcgcagcgctcccatatttggggccgctacgcagcccagcgggagcaagctccctcgccacaggtgcgtcgttttttttgcctttgggtcagcccttcatcacctgcgccagcagctcgtaggaatgaatccggtcggcgtgttcgtacaggtcgctggtgaagatcagctcatcggcgccggtctgttcgatcagcacctccagtttggcgcggatcttcgccgggctgccgaccatggccaggccgaggaagctgccgacggcatctttttcatggggcagccacaggccgtccatggtttttaccggcgggcgctgtaccaggctctgcccgcgcatcagcgcgaggatgcgctggtacaccgaagtggccaggtaatcggcttgctcgtcggtatcggcggccaccagcggaatgccgagcatcacgtagggcttgtccaacacggcggaaggcttaaagtgattgcgatacacgcgaatcgcctcatgcatcaaacgtggtgcgaaatgtgaggcgaaggcgtagggcaacccgcgctcaccggccaactgtgcgctgaacaggctggaaccgagcagccacaccggcacattggtgccggtgcccggtacggcgatgatccgttggtcgggcgtgcgtgggcccaggtaggccaccagttcggccacgtcgtccgggaagtcgtccgcgctgcctgagcgctcacggcgcagggcgcgcgcggtcatctggtcggaaccgggggcgcggcccaaacccaggtcgatacggccgggatacaggctttccagggtgccgaactgttcggcaatcaccaacggcgcgtggttgggcagcatgacgccgccggagccgacgcgaatcgtcgaagtgccaccggccaaataacccagcaataccgaggtagccgaactggcgatgccgtccatgttgtggtgctcagctacccagaaacggttgtagccgaacttttccacgtgttgggccaagtccagggagttgcgcaacgactgcgcgatgctcccgttggcgcgcacgggcacgaggtcgagggtcgagaacttcacgtcggacagcgatttcataagcctgcttctccattgggtgcgcaggcttatagacaaaccaaaacctgccgcttcatgtgcatggtctatgcaatgagggcatatacccgagattcaatagcagtcgggtaaatttcctactgaattgctaggtttctccgacaagatgaactttgccagagcttctatcctcagaacccttactgaagcaaaaccaccgttcgaggagacagctatgagtatcgttaaaaaagcatccgcgcattgggaaggtgatctgaagacaggcctgggttccatttccaccgaaaccggcgtgctgcgcgaagcgccttacggctttaaggcccgtttcgaaggcggcaagggcacaaaccctgaagaactgattggcgcggcccacgccggctgtttctccatggcgttttccatgattctgggtgacgccggcctcaaggctgacagcattgatacccaggctgaagtgaccctggaccaggtagacggtggttttgcgattaccgctgtgcacttggtgctgaaagccaagatcccgggcgcaagccaggcgcagttcgatgagctgagcaaaaaggccaaagaaggctgcccagtctccaaggtgctgaatgcaaaaatcagcctggatgccacgctcgtcagctaatgcggtctgcgtaacaccgtagatccaatcaatgtgggagcgggtttgtgtgggagtcgggcttgcccgcgatagggacacctcggttttcagttgcaccgaggtggggccatcgcaggcaagccagctcccacataagcctgctcccacattcagttctgctttaaatcagaactcgcgtttcgaaactgtggtcgaatagcctatgcagcttaggcgcacacccgtgcgcatgcattcagggagctacacacatgaaacgttttgccttggcgatcatctgcggtgttttggccacttcggccgtggccgcgccaaaagattgtgaagagctcaggaaagaaatcgaggtcaagatccaggctaacgccgtaccgtcctacacccttgagattgtcagcaaggaagaagccgacaagcacgacagcgccatggtcgtcggcagctgtgagaacggcaccaaagccatcgtctaccagaagaacaacgactgatcagatgcagttcacgctgcgttcttgcgccagcaactgacgcgctgagttgtacagccgaatgttgggcgtaaaggccagcgagcgcccttccagcacatagtgctggcctgcctggaagttgtcgtactgcaaggtcatgaagcaggttcggtcgtgcgtctggtccagcccgccaaagcctgcccccgtgttcacctcgaaatcaaagcgcaccatcaattcgtggctgcccggtggcacctggaaaaaacgcccgtcgttgaggttcttgccatccaggcgctgagccatgaccaacttggcgcccggcgtgggggtggtgaaatcgacccaggcctggtgcgggtctgcgggcggaatcggcgtcgaagcgcaggcgctgagaaacagggcggtgatgggaagcaagagctggcgcatggcaggcactcaacggtgagttgggattgagcccggcgcgatggcagcagactcgttatgagtataaacacgcttgggcatggaaaaattccgcgtgggcaggatagtctggcgagccaatcacccaggagcagtcggagcatgttgaggcgttttcttccagggttaatggttgtgctgctcagcggctgttccagtgtcagttattacagccagttggccagcggccagtggcaattgctgcgggctcgcgagccggttgccgaggtcatcgcggacccttctcgcccacaggtattgcgtgatcacctggtgcaatcgcaaaaggcacgcgcctttgccagtgaacacctgcacctgcccgacaaccagagctaccggttgtacgccgacattggccggccttatgtggtctggaacgtctttgccacgacggaattttccctctccccccaaacccattgcttcccgattgccggatgcgtcgcctatcgcggttattacaaccaaggcgcggcgcgcggcgcggcggcgttgttgcggcaacaaggcatggacgtgtcgattggcggcgtcgaggcctactccaccctgggctggttcaacgacccgatcatgagttcgatgatgaactggggtgatgagcgcctggccacgctgatcttccatgagctggcgcaccagcggttttatgtgaaggacgacaccgagttcaacgagtcatatgccaacttcgtcgagcaggaaggcacgcgccagtggcgtgcggcgcggggcttggcgcccttgagcaatgcgacgttgcagcagcgtgatcagtttatccggctggtgcttgatacccgcaaacgcctggaaacgctctacgcacagccgttggcagccgatgtgatgcgccaggccaaggcggcgcagttcgagcgtttgcgcagtgagtatcggcagatgcgcgatagccagtggggcggcgacaagcgttatgaactgtggatcaaccagccgatgaacaacgcgcggttgttgccatttgggctgtatgaccaatgggtgccggcgtttgcggcgttgtttgcgcaggaaggtagggattgggtgaagttctatgcggcggtggagaagctgggtgggttgccggtggagcagcgtaaggcggcgttgaggcagttggagggtgtaagccgttagggcctcatcgcaggcaagccagctcccacaggttgatgtgtgaacacagtcaagtgtgggagcgggcttgcccgcgaaagcggcctcaagcgcgctgcaaaaacgcctgatgcatctcatccagcgtctcaaaatgccaagtcggcgcctcggcattcagctcttcaaaactgccaaacccataccccaccgccgccgagtccagcccattgctgcgcgcgccgatcaggtcatgcttgcgatcaccaatcatcaaggtggtcgccgggtccaggccctcttcgctcatcaagtgcgcaatcaactcaaccttgttggtgcgcgtgccgtccagttcgctgccgtagatcactttgaagtgcttggcaaaatcgaaatgccgggcaatctcgcgggcgaatacccacggcttggacgtggccacatacagctggcggccctggccgttgagctcttccagcagcggcatcacgccgtcgaacacgcggttttcatacagcccggtgaccttgaaacgctcgcggtagaaattcaccgcttcccaggccttggcctcatcaaagccgtagaactgcatgaaggcttgcagcagcggcgggccgataaagtgttccagcttggtcaggtccggttcatcgatgccgagcttggcgagggcgtactggatcgaacgggtaatgccctcgcgcgggtcggtcagggtgccatccaggtcgaacaggacggtttggtaacgctgggtcatcggtcgaatccttccgccaggtgcaggtctttgagcttcacgtagttcgccgcgctgtaggtgaaaaaggcgcgttccttgtcagtcagcgcgcggacttgtttaaccgggctgcccacgtacaaaaagccgctctcgagtttcttgcccggtggcaccaggctgccggcgccgatgatcacgtcgtcttccaccaccgcgccgtccattacgatgctgcccatgccgatcaggatgcggttgccgacgctgcagccgtgcagcatgactttgtgggcgatggtcacgtcatcgccgatcagcagtgggaagccgtcaggattgaacggcccggcgtgggtaatgtgcagcacgcagccgtcctgcacgctggtgcgcgcaccgatgcggatgcggtgcatgtcgccgcgaatcacggtcagcggccataccgagctgtcggcgccgatttcgacatcgccgatcaccaccgccgaattatcgacaaaagccccggcgcccagggttggcgtgtggttctgataggtgcgaagggtcacgatagcctctctcttgtgtgctgatagctgcggtgggtgttgattgtaattaagatggccccatctttgttcttacatgtttcttcagccaaggtgccaaccgtgagcgcgaacaaccctcttctgcagtcctacgacctgccgccgttctcggcgatccgtgccgagcacgtacagccggccattgaacagatcctcgccgacaaccgcgtcgccatcgaaggcatcctgcaaagccagggtaaaaatccgacatgggccgggctggtgctggcgatggacgaattgaatgaccgcctgggcgccgcctggagcccggtcagccacctgaatgccgtgtgcaacagtgccgagttgcgtgaagcctatgaggcttgcctgccggcattgagcgcctactccaccgagatgggccagaaccgcgcgctgttccaggcctttgaagccctggccaacagcccggaagccgccggtttcgacgtggcgcaaaaaaccatcctcgagcactcgctgcgcgacttccgcttgtcgggtatcgatttgccgcctgagcagcaaaagcgttacgccgaagtgcagagcaagctctccgagctgggcagcaaattttccaaccagttgttggacgccacccaagcctggaccaaacacgtcaccgatgaagccaccctcgccggcctgaccgactcggccaaggcgcaaatggccgccgccgcccaggccaaaggcctcgacggctggctgatcaccctggaattccccagctactacgcggtgatgacctacgcccacgaccgcgccctgcgtgaagaggtctacgcggcctactgcactcgcgcgtcggaccaaggcccgaatgccggcaagaatgataacggcccggtgatggaacagatcctcgacctgcgtcaggagctggccaaactgttgggctacgcctcgttctccgagctgagccttgccaccaagatggccgagtccagcgaccaggtgctgagcttcctgcgcgacctggccaagcgcagcaagccgtttgccgcccaggacctgcaacagctcaaggcttacgccgccgaacaaggctgcgccgacctgcaaagctgggacagcggtttctacggcgaaaaactccgcgagcaacgttacagcgtgtctcaggaagccctgcgcgcctacttcccgatcgacaaagtactgggcggcctgtttgccatcgtccagcgcctgtacggcatcgaaatcgccgagcaaaaaggcttcgacacctggcatccggacgttcgcctgtttgaaatcaaggaaaacggccagcacgtcgggcgtttcttcttcgacctgtacgcccgcgcgaacaagcgtggcggtgcctggatggacggcgcgcgcgaccgtcgccgcaccgtcgacggcgtgctgcaaagcccggtagccaacctggtgtgcaacttcaccccggccgacagcggcaagcctgccctgctgacccacgatgaagtcaccaccctgtttcacgaattcggccacggcctgcaccacctgctgacccgcgttgaacacgctggcgtgtccggcatcaacggcgtggcctgggatgcggtggaattgccgagccagttcatggagaactggtgctgggagccggaaggcctggcgttgatctccggccactatgaaaccggcgagccgctgccccaggacctgctggaaaaaatgctcgcggcgaaaaacttccagtccggcctgatgatggtgcgccagctggaattctcgctgttcgacttcgaactgcacgccacccatggcgatggccgcagcgtggcgcaagtgctggaaggcgtgcgcgatgaagtctcggtgatgcgcccgcctgcgtacaaccgcttccctaacagcttcgcgcacatcttcgccggcggttacgcggcgggttactacagctacaagtgggcggaagtgttgtcggcggatgccttctccaagtttgaagaggacggtgtgctcaatgccgaaaccggccgtgcgttccgcgaagccattctggctcgtggcggttcccaagcgccgatggtgctgttcgtcgacttccgcggacgtgcgccgtcgattgacgcactcttgcgccacagcggcctgagtgaggacgcggcagcatgagtgaagggcctgtgatcaccaaaaagcaatttatcgccggggcggtctgcccggcgtgcagcgagccggacaagttgaagatgtggaccgaggacaacgtgccgcaccgcgaatgcgtggcctgcggttataccgacacgttgaatgaccaaggcctgtcggtgcccaaggaattgggcacgcgggtcaatacatcggcgttgaaagcgccggcggacccgaaagtgcaggcggtgcagtttttccccaaccccaagctgaaaaaagactgacgcccgcccccacttgctgtgggggcacgcattctgtgggatctggcttgttgtggcgagcgggcttgccccgcgttgggatgcgaagcggccccaaaacctgacgaccgagttctgtttggatgaactcggcgcctgtaatggggctgctacgcagcccaacgcggggcaagcccgctcgccacggaggattgttgtgtagatacctatgctgcgatagcctcaacgcggcgcaactgatacaccgcgttgcctgcatcgcgggcaagcccggctcccacagcccacagcccacagaaaggcgcgctacaattttttctcgtctttgcccgttgtagtgatccaatcttccatcgagcacagcgcaaacgcgctggtgctgcaatcgccattcgccaaggctgtgcgtaacttgtcgacatcggccttcatcatgtagcgaacgctgtccttgaagccactgctgctgccgaagccgcccaaggtcatctcgttcagcgcatcttctttgctccagccctggatcaccacgcgatacatggccgccatcaggccggtgcggtcggaaccatgtttgcagtgcatcagcaccgggcctttggtttcggcatcccggatcgcccttagcgcagcgagtacgtcggaatcgtctacgtggttggtgcgataagtcagctgcacctgtttgatatcagatgtcttcagccacgacgcatcagattccggcaaaaaattgatcaccgtgccgatcttcagattttgcaaaaccggcagcgcatcgctgtttggcaatgcgctgcgatacagcgtgggcgtcatctggtgcaggttgaattggtcgcccaccggctgcgcccattccgctgaacgcagcgatgaggtgccgtcggcctgggcgtgggcggtggcgaacagggccagaaacaccatgccgagggcaggcagcaatcgaatctcgaacatgcgcgttgtaaccgactagggaaatggctgatgggccatagattcgcctgcggggggtcaacgcggcgtgaggttctcgtcaaagaatcgtgaatacccggcgtgatccggtgtttttctcgctgaatcgattcctctgaatgcttagcctgctatcatttgtaactattgattgccggtgtgttctatcccttggatccaatttcctggcaagccttcacgctgctcccagaagcggcggataaacccgtgaccacatgatgaggtgcacccatgtctgatcaagatcaagacaacccccggcgtgactttttacgcaaatccttgaccttgatcccggtggtcacggttgccagcactggctttggtggctcgatgctgatggccacgccggagccggcccaggccgccgaggctaaaccgccggtcagcgacaaagcctatgagccgagctacttcagcgccgaagagtgggcgtttatcaacgccgccgtcgcgcgcttgattcccgctgacgcccaaggccctggcgccctggaagccggcgcgccggaatacatcgaccgccagatgaacacgccgtatgccgccggcgcgctgtggttcatgcaaggcccgttcaacgccgacgcggcgccggagatgggctggcagagcaaactggtgcccaaggacatctatcgcctgggcattgctgccacggatgcgtggtcgaaggcgttcaatgggaaagcttttgccgcgcaagacagcgctacccaggacgacatgctgcggcgtatggaggcgggcggcggcgaaatgaccgcgcatttcgaggcggtgccggcgaagatgtttttcaacctgctgctgcaaaacaccaaggaaggcttcttctgcgacccgatccacggtggcaacaaaggcatggtcggctggaccatgatcggcttccccggcgcccgcgccgatttcatggactgggttgaacgcaacgagcaataccccttcccggctgtttccattcgcggcgagagggcgtaaacgtggcgaccatcatgaagaaagtggatgcggtgatcgtcggtttcggttggaccggcgcgatcatggccaaggaactgacggaagctggcctcaacgtggtagcgctggagcgcggcccgatgcaggacacttacccggacggcaactatccccaggtcatcgacgaactgacctacagcgtgcgtaaaaaactcttccaggacatttccaaggagacggtgacgattcgccatagcgtgaatgacgtcgccctgcccaaccgtcagttgggcgctttcctgccgggcaatggcgtgggcggtgctggcctgcactggtcgggcgtgcattttcgtgtcgacccgatcgagttgcgcatgcgcagccactacgaagaacgctacggcaagaacttcattcccaaggacatgaccatccaggacttcggcgtgagctacgaagagctggagccgtttttcgactacgcggaaaaagtcttcggcacctccggccaggcctggacggtgaaaggccagctggtgggcgaaggccgcggcggcaacccgtatgcgccggatcgctccaacccgttcccgctggaggcgcagaaaaacaccgtctccgcacagctgtttcagaaagcggctgccgaggtcggttacaaaccctacaacttgccttcagccaacacctcggggccgtacaccaacccttacggcgcgcagatgggcccgtgcaacttctgcggtttctgcagcggctacgtgtgctacatgtactccaaggcttcgccgaacgtgaacatcctgccggcgctgcgccaggtgccgaactttgagctgcgggccaattcccacgtactcaaggtcaacctcgacagcaccaagagcaaggccaccggcgtgacctatatcgacgcccaggggcgcgagtgcgagcagccggcagacctggtgatcatcggttctttccagttcaacaacgtgcggctgatgctgctgtcgggcatcggcaagccttacgacccgattaccaatgagggcgtggtgggcaggaacttcgcctaccagaacatgggcaccatcaaggccttcttcgacaaggacacccacaccaacaacttcatcggtgcgggcggcaatggcgtggccattgatgatttcaacgcggacaacttcgaccacgggccgcacggctttgtcggcggttcgccgatgtgggtcaaccaggccggcagccggccgattgccggtacgtccaacccgcccggcacgccagcgtggggcagtgcctggaagcgcgcgaccgccgattactacacccaccaggtgtcgatggactcccacggtgcgcatcaatcctaccggggcaactacctggatctggacccggtgtatcgcgatgcctacggcctgcccttgctgcggatgacgttcgactggcaggaaaacgacatcaagatgaaccgcttcatgatggagaaaatgggcaaggtcgcagctgcgatgaaccccaaggccatcgccgtgctcggcaaaaaagtcggtgagcacttcaacaccgcgtcctaccagaccacccacctcaacggtggcgcaatcatgggcaccgacccgaaaaccagtgcgttgaaccgctacttgcaatcctgggacgtgcacaacgtgtttgtccccggcgcatccgctttcccacaaggcttgggctacaaccctaccggcctggtggcggcgttgacctactggtcggcgcgggcgatccgcgagcagtacctgaaaaaccccggcccactggttcaggcataaggagcgatgaccatgaaagcacttgttatcgccagtttcgccctgttcagcagctgctcggtgagcgccgccgaaaccgacttgatcaagcaaggcgaatacctggcccgcgccggtgactgcgtggcctgccacaccgccaagggcggcaaaccctttgcgggcggcctgccgatggaaaccccgatcggcgtgatttactccaccaacatcaccccggacaagactgggctgggcgactacagcttcgaagacttcgacaaggccgtgcgccatggcgtcgccaagaacggcagtacgctttacccggcgatgccgtatccgtcctacgcgcgtgtcagcgacagcgacatgcaggcgttgtatgcgtacttcatgaagggtgttgagccggtcgcccaagaaaacaaggacagcgatattccttggcccttgagcatgcgttggccattggcggcctggcgctggatgtttgcgccgacggtcgaggagcatccggcacaagcggctgccgaccccgtagtcagccggggcgcctatctggttgaaggcctcggccactgtggcgcctgccatacaccgcgtgccctgaccatgcaggaaaaagccctcagtgccactgacggcaacgcgttcctgtccggcagcgcgccgttggaaggctggattgcgaaaagcctgcgcggcgaccacaaggacggcctcggcagttggagcgaggagcaactggtgcaattcctcaagaccggtcgcagtgatcgcagcgcagtgtttggcggcatgagcgatgttgtggtccacagcatgcaatacatgtcccaggacgacctgaccgccatcgcccgttacctcaaaagcctgccggcggtcgatcccaaggatcagccgcaccagtacgacaaacaggtcgccgaggcgctgtggaaaggtgacgacagcaagccgggtgcctcggtgtacatcgacaactgcgcggcctgccaccgtaccgacggccatggctatacgcgggtgttcccggcgctggcgggcaacccggtgttgcagacggcggatgccacgtcgttgatcaacatcgtgttgaacggcggcaccctgccggctacgcacacggcgccttcgacctttacgatgccggcgtttgcctggcggttgtcggaccaggaagtggcggatgtggtcagtttcgttcgtggtagctggggcaataaaggcgcaccggtaaaagccagcgacgtggcggacctgcgcaaaagtgatatgcgaaccacctcgggcgatgacctggggcaagtgacccaaaagcactgatcccgtgctggccgctaaacggcactggtcataacgacgacgcccctatactgtatataaaaacagtataggggcgttttcatgtctgcacctctgccgccccgtggccggggcacggcgaccaacctgcacaaccgttttgcgccgactgtcagtgtggccgaggatgacggctggtttcaggaagtgccgccaacccagggcactgaagtgcgtatcgaaacggccaagagcatcatcacccgcaacaactcgccggacttgccgttcgatcgctcaatcaacccctatcgcggctgcgagcatggctgcatctactgctatgcgcggcccagccatgcctattgggacatgtcgccggggctggatttcgaaaccaggctgatcgccaagaccaatgccgccgatgtgctggaacaacagctgtccaagccgggctatgtgtgtgcgccgatcaacctgggctccaataccgacccgtaccagcccatcgaacgtgaatacaagatcacgcggcaaaccctcgaagtgctgctgcgctaccggcacccggtgaccatcatcaccaagggttcgttgatactgcgcgatctcgacctgctgacccagctggcccggcagcggctggtggcggtgatgatcagcctcaccagcctggacgacgagctcaagcgcatcctggagccacgcacggcggcgcccaaggcgcgcttgcgggcgatacgggtgatgcgtgacgccggcatcccggtgggcgtgctgtgctcgccgatgattccgatgatcaacgacagcgagctcgaaagcctgctggccgaagcccacgcggccggcgcacaaagtgcggcctacatgatgctgcgcctgccattggaggtggcgccgctgttcgaggagtggctggcggcgcattacccgcagcgcgcggcccatgtgatgagcctggtgcgccaggtgcgcggcggtgaggtgtacgacagccgcttcggtgtgcgcatgcgcggcgaggggccgtttgccgatctgctggcacagcgttttagcaaggcgatcaagcgcctggggcttaatcgtcgcgaaggcttcaacctggattgcacggcgttctgcccaccgggcagacagttggctttgttgtaaactgaagaagatcaacccaacgcttgcgtaggaatggtcgcgttttgacatcactgaaacccgcgagctagagcgtttcattcagtttgagttaagtttcggtggttaccttgttcagcgagtgactgatcagtcggcgcgctgggtgtgtggtgtttacaactattgcacaggccaggcgtcagaactgagttgagccactcccctgccttaatcaagaggatgaattatgagtgacaaggataaacagccgttggctgcgtcggcttcagcccctcacgaggccgagtccgccgatgcagcgctaaagcacatcgttgacggctttttgcatttccatcacgacgtcttcccgcagcaggaagaactcttcaagaaactcgccacggcccagagcccacgggcgatgttcattacctgcgccgattcgcgcatcgtgcctgagctgatcacccagagctcccccggcgacctgttcgtgacgcgtaacgtcggcaacgtggtaccgccttatggccagatgaacggcggtgtttccacggccatcgagtacgcggtactcgccctgggcgtgcagcacatcatcgtttgcgggcattccgactgcggcgccatgcgcgcggtactcaacccccaaagcctggaaaagatgccaacggtgcgtgcctggttgcgccacgccgaagtcgccaagtcgatggttgaggacaactgcgactgcgccaacgagcacgaaagcatgaaggtgctgaccgaagaaaacgtcatcgcccagttgcagcatctgcgcacccacccttccgtggcttcgcgcatggccaatggtcaattgtttatccatggctggatctacaacatcgagaccagtgaaatccgtgcttacgacgcggatcaagcggcgttccgatcgctgagcggcgacgggccgatcccttgcgcgacgcctaaagcgcgcttctaaaaacacttccctgccgggtaaagcggtggctgccatggacgcagccaggctttgccgcgcccggcgaatgcctcgggagagtcatcatgcgtgctgctcaattgaaagctgtattgccacgggagctgctcgcgtctgtggttgtgtttctggtcgccctgcccttgtgcatgggcatcgcgattgcgtccggcatgccgccggccaagggcctgatcaccgggattatcggtggcctggtggtgggctggctggcgggatcgccgctgcaagtcagcgggcccgccgcagggttggcggtgttggtgttcgagctggtccgccagcacggcatgatgatgcttgggccgatcctgttgttggcggggttcctgcaactggtggccgggcgtttgcgtctgggctgctggtttcgtgtcacggcgcctgccgtggtgtacggcatgttggccggcatcggcgtgttgattgtgctgtcgcaggtgcatgtgatgctcgacggtgcgcccaagccttcggggctggataacctggcgggcttcccggccgccttggttgaggcgattccgaccctcggtggtggcctgggttggcaggccggtttgctcggcttatcgacaatgctggtgatgtacctgtgggacaaatttcgcccgcaaacactgcgcttcgtgccgggcgccttgctgggcgtgggcttggcaaccgtcaccagcctggtgctggcgttgcaggtcaagcgtgtggaagtaccggaaaaccttgccgacgccatcgactggctacgccccagcgacttgctgaacctggccgatccacagttgttgatcgccgcatttgccgtggcctttatcgccagcgccgagaccctgctgtctgccgcagcggttgaccgcatgcacagcggccagcgttccgacttcgataaggaattgtctgcgcaaggcgtgggcaacatgctgtgcgggctggtcggtgccctgccgatgaccggcgtgatcgtgcgcagctcggccaacgtgcaggcgggcgccaccacgcgcttgtcggcgatgttccacggtgtgtggctgctggggttcgtgttgttgctgtcgagcgtgctgcaaagcattccggtcgcgagcctggcaggcgtgctggtgtacaccgggatcaagctggtggacgtcaaggcgttcaaggcattgggacgctatgggcggatgccgatgttcacctatgccgcgacggcgctggcgatcatcttcactgatctgctgaccggcgtgctggtgggcttcgggttgacgttggtgaaactggccttcaaggcgtcgcggctgaaggtcagcctgatcgacctgcctcaggacggtgagatggaactgcgtttgaccggcgcggcgacattcctgaaagtaccggcgctgacccaagtgctgtcgacggtgcccgcagggaccacgctgcatgtgccgctgagcaacctgagctacatcgaccacgcctgcctggagttgctcgaggaatggggtcgggcgaatgcggccaagggctctacgctggtgatcgaggcgcgcgggttgaagcgccggctggaaggccgggtgcgcacgacggtggggattggttcggcgcctgtctgaacaccacaaaacattgtgggagccgggcttgcccgcgatgagggagtgtcagtcaacacattggctgactgatacaccgccatcgcgggcaagcccgctcccacatgggttttgcatgatattgaagagttaagcaggctgatccaacgccaactcaacccccaactgccgcgacaggcacggccagcgcttccacgccgcttcggtgttcgggctcttgagcgtctcgcggtacgcctcgaccgattccagcgcaaagctgtcttcgttgagcatctcatccaccgccaagtgcacggcttcatccagttgattggcgaacgcctcgccgatcagttgatgagcgatcaggttggccacggtggtgtccgccggaatcaacggctgaccgaaatgcttgatgtacaggtcgttgacctcttccaccaaccgatgggccaggtaggcttcgtcgagcagaccgtcgaggccttcgtggccggccaggatcgcgggcggctgcaggaagaaatgctcggcaatcttcagcaccggcttgatctggctttcgataccggcttcgcgggccacgtcattggcggcttcgagcaaatccgggaccagctcaatgtaggcggtaacaaaacgggtcatgacaatgttgcgatcaccgtcagccagggagatggccgaatgcaggtgcggcaattgtttttccagttgctgggcaagctggccagtgctggcttcgtgttgatgggcacgggaaatctgctcgcgcaatgcggcggtgttcatgaaagctccagtgaaacaggcgtaggaaaagggagaggataaggtagctcgtttatacgagagcctaagacgcgtttgtcataattatttcatggttatgcgcatgcgttatatcgaattgccatcgttcgtcggataaacgtttgcgggcccgtatttattgggcccgcccgtctgtttttgctcatttgcccctacacattgcggggttggtgcggctgtctatactcgattttgtacgcaattagctgatgacgcccaactgcatgaagcaggcaaggcttggcggttgtaagcagtatggaagccgctcccttcgccgcaggtgcaaaccggcgggataacaagaaacataaaggggaacccgcaatgacgcgacatccacacgtttggatgggcctactgttgtggtcagtattcggccaggcgcacgccgcctggacaacgaatatggcgccaggggcgactgaagtcagtcacgccgtgtttgacctgcacatgaccattttctggatttgtgtggtgatcggcattgtcgtgtttggcgcgatgttctggtcgatgatcctgcaccgccggtccacgggccaggtggccgccaagtttcacgagagcacgaccgtggaaatcctctggaccgtggtgcccttgctgatcctggtggcaatggccattccggccaccaaaaccctgatcaatatctacgacagcactgagtcggatatcgatattcaggtcacgggctaccaatggaagtggcactacaaatacctcggccaggacgtggagttcttcagcaacctggccacgcccgccgagcaaatccataaccaggccaccaagggcgagcactatttgctcgaagtcgaccagccgctggtgctgccggtgggcgccaaagtgcgctttttggtgaccgccgccgacgtgatccactcgtggtgggtgccggcctttgcggtcaagcgcgacgccatccccggcttcgtcaacgaggcctggacccgtgtcgagaagcccggcatctaccgtggccagtgcgccgagctgtgcggcaaggaccacggttttatgccgattgtggtcgaggtcaaatccaaggccgactacgacacctggctcggcgaacgcaaggccgaagcggccaagctcaaggagctgacctccaaagagtggacgctggacgagctggtggcgcgtggcgacaaggtctaccacaccacctgcgtcgcctgtcaccaggccgagggccagggcctgccgccgatgtttccggcgctcaagggctcgccgattgccatcgggcctaaggaagaccacctgcaccgcgtttacttcggcaaacccggcaccgccatggccgccttcggtaaacagctgtcggaagtggatatcgctgccgtagtgacttacgagcgcaacgcctggggcaacaacaaaggcgacatggtcacgcctaaagacgtgctggccatcaagcaggcggaaagcaaatgacagcccttactgcgtatgccacgaaccgtcccgcccactcgcttgcaggagaacggccatgagcactgtgatcgaccatgggcatgccgaccatgcccacggccccgccaaaggcctgatgcgctgggtgctgaccaccaaccacaaagacatcggcacgatgtacctgtggttcgccttcaccatgttcctgctcggcggctcgttcgccatggtgatccgcgccgagctgttccagcccggcctgcaaatcgtgcagccggcgttcttcaaccagatgaccaccatgcacggcctgatcatggtgttcggcgcggtgatgcctgccttcgtcggcctggccaactggatgatcccgctgatgatcggcgcgcccgacatggccctgccgcgcatgaacaacttcagcttctggctgctgccggcggcgttcctgctgctggtctcgaccctgttcacccccggcggcgggccgaatttcggctggaccttctacgccccgctctccaccacctacgcgccggaaagcgtgacgttctttatctttgccattcacctgatgggcatcagttcgatcatgggcgcgatcaacgtggtcgccaccatcctcaacctgcgcgcgccgggcatgaccctgatgaaaatgccgctgttcgtgtggacctggctgatcaccgcgttcctgctgatcgcggtgatgccggtgctggccgggtgcgtgaccatgatgctgatggacatccacttcggcaccagcttcttcagtgcggccggtggcggtgacccggtgctgttccagcacgtgttctggttcttcggccaccccgaggtgtacatcatgatcctgccggccttcggcgccgtcagctcgatcatcccgaccttctcgcgcaagccgttgttcggctacacctcgatggtctacgccacggcgagtatcgcgttcctgtcgttcatcgtatgggcgcaccacatgtttgtggtcggcattccgttggtgggcgagctgttcttcatgtacgccacgctgctgattgcggtgccgacgggcgtgaaggtgttcaactgggtcagcaccatgtggcaaggctcgctgaccttcgagacaccgatgctgttcgccgtggccttcgtgatcctgttcaccatcggcggcttctccgggctgatgctggcgattgccccagcggacttccagtaccacgacacctactttgtggtggcgcacttccattacgtactggtgcccggcgcgatcttcggcatcttcgcttcggcctactactggctgccgaaatggaccggccacatgtacgacgaaaccctgggcaagctgcacttctggctgtcctttgtgggcatgaacatggcgttcttcccgatgcactttgtggggctggccggcatgccgcgacgggtgccggactacaacctgcagttcgccgacttcaatatggtgtcgtcgattggcgcgttcatgtttggcgccacgcagatcttcttcctgttcatcgtgatcaagtgcatccgtggcggcccgccagcgccggccaagccatgggatggcgccgaaggcctggaatggagcattccttcgcccgcgccgtaccacacgttcaccacgccgccggaggtcaagtgaataccctgaagcaggccgccttggtctcctgtgggagctggcttgcctgcgatgaaggcctgacagtcgatggattcggtgcctggcacaccgctatcgcaggcaagccagctcccacagaacttcaaaagcagggtgatcgccatgcttgaatccgtccccatcaaacgcctcgtcacccgcctgctaatcctggtagtggccatgttcgccttcggcttcgccctggtgccgatctacgacgtgatgtgtaaggcgttcggcatcaacggcaagaccgccggccagtacgagggcgagcaaatcgtcgaccctacccgccaggtgcgcgtgcagttcctgtcgaccaacgccatcgacatggtctgggaatttcactccaaggctgacgaagtggtggtcaaccccggtgcggtcaccgagatgctgttcgtggcctacaaccccaccgacaaggccatgaccgcccaggcggtgccgagtatttccccggccgaggcggcgatgtacttccacaagaccgagtgtttttgcttcacccagcaagtgctgcagccaggtcagcgcatcgaaatgccggtgcgctttatcgtcgaccgcgacatgcccaaggatgtgaagcatttgaccctggcgtacacgctgtttgatatcactgcgcgccaaccgccggtggccgtccgtaccggcggctagctactgtttgccccctcaatcaggagagcgaatacatgtcgtctcatgatacgtactacgtaccagcgcaaagcaaatggccaataattgcgacctttggcatgttgatcaccgtgtacggcctggccgtgtggttcaacgatctgaaggcggcgcgcccggaatcccacggcccgtggatatttttcgtcggcggcctgctattggcctacatgctgttcggctggttcggcgccgtaatcaaggaaagtcgcgccggtttgtacagcccgcagatggaccgctcgtttcgctggggcatgacctggttcattttttccgaggtgatgttcttcgtcgcattctttggcgcgctgttttatgtgcggcacatgtctggcccatggctgggcggtgaagggcacaagggcatcgcgcacatgctgtggccgaactttcagttcacctggccgctgctcaacaaccccgacccaaaaatgtatccgccgccggaaggcaccatcagcccgtggggcttgccgctgatcaacacgattttgctggtcagctccagcgtgaccatcaccatcgcccatcacgccttgcgcaaaggccatcgcggcgcgctgaaaatctggctggcgctgacggtgctgttgggttgggcgttcctggccttccaggccgaggagtacatgcacgcctacaaagagctgggcctgaccctcggttcgggcgtgtacggcgcgacgttcttcatgctcaccggtttccacggcgctcacgtgaccatcggcacgatcattctgtttgtgatgctgatgcgcatcctgcgcgggcatttcaatgccgagcaccagtttggcttcgaagcggccagttggtattggcactttgtggatgtggtatggatcggcctgtttttcttcgtttacgtgctgtgaggtgcattaccacggcgcatgagacaccagctggccgctgaaaaagccccaggcaatcaagcccacggtgatcgcggccagcaccacgcgcacggtcaaggcagtgacgaggcggttggagttgccctcgtccttgaccagaaagaacaagccactgaacaggctcacgacagtcgcgatcagcatcagggcaatagcagctttgagcatggtcaggttccatttggatgagcgggcaatgaaaaggcgggcaatgaaaacaagtatagccagcgccataaaagactttcgcccagggctcgcacccacgttggtggtgctggtgctgctgccgctgatggtcggcctggggttctggcagctgtcgcgcggccatgaaaaacagctgctggtggacagctacgccgagcggcgggtggccgagcccatcgacagcgtgcaactcaatgacatggccgacccggcctttcgccgcgtgcgcctgcgcggccaattcgacgccgaacacagcgtgttgctcgacaaccgcatgcgtgacggcaaggccggtgtcgagttgctgcaacctttccatgaccaggccagcggccagtggctgttgctcaatcgcggctggctgccgtggccggaccgtcgcacgccgccggtcttcaccacacccgatcaaccgttgaacctcgacgcctgggtgtacgtcgcccccggcgaaaccttccagctgcacgccgacccggctaccacgcattggccgcgcttgctcaccgccctgcaccccgccgccctctggaccgaattgggccgcagcggttttgcctatgaattgcgcgccgagcccggccccggcacgtacgacaccacgtggccggtagtcgccatgggcccggaaaaacacttgggctacgccgtgcagtggttcgccatggcgttggcgttgctggcgctttacctctacctcggatggcacaacaacaaggagaagtcccatgggaacggccatgaatccacccagcacgtctgaggcgcccgaccggcgcaaaggtcgctggcagctgatcctgatcctgatgatggtgatcggcccgatggcgttggccacgttcatgtacaagctgcagttctgggtgccggacagccgcagctaccatggcgaactgatcggcaatggccagacccgcgccgacatcggcgtgcaggccgatgaaaaccgctggcagctgctcgtaaccgcgcccaccgcctgcgccgccgagtgtcagcagctggtgtacctggcgcgccaactgcaaatcagcctgggccgcgatgcgtcccgcgccagccatgccctggccagcgcgcagccagtgagcacggaatacgaggccaagctcaaagccgaatacccgcagctgcaacgctacccgctggacctgtcgaccttcacccaagacgccgccgcgcccggtgatgcacagctgtggatcgtcgacccgcacggcaacctggtgctgcgctacgacgccaaggtcaagggcaaagacttgctcaacgacctgcgcctgctgctgaaactgtcgagcatcggataagggcatcgtcatggccaaacctggatttcgcctcgcgttgtttgccaccttgctggcgctgatcgtcgtgctgctgggcgcctatacgcgcctgacccacgcggggctgggttgcccggactggccgggctgctacggctttatcagcgtgccgcaaagcgaagcccagttggcgcatgccgagctgcattttcccgacacaccggtggaggccgacaagggttgggccgagatgacccatcgctacttcgccggcactctgggcctgctgattgtgttgctggcggcgcgttcgtggagccatcggcgggacccgggccaaccggtgaaactgccgctgtttgtgttggcggtggtgtttgcccaagcagctttcggtatgtggacggtgacgttgaagctgtggccgcaagtggtcaccagccatctgctcggtggttttgccaccttgagcctgctgtttctgctgagcttgcgcctgtccggcgtgctgccggcgttgattgtgcccaggcgcctgcaatattgggcgacggccgggttggtgctggtgatcggccagatcgcgttgggcggctgggtcagttccaactatgcggcggtggcctgtgtcgacttgcccacctgccatggggagtggtggccggcggccgacttcgccaacggctttcacctcacccagcatatcggccccaattacctaggcggccagctcgacagtgaagcgcgcacggccatacatctcacccaccgcatcggcgcagtattggtcacgctggtgctgctgggcctggcctggcaattgcgcgcagtgggcatgacgcggctggcgggcctgttgctgatcgccctgtcggcgcaaatcagcctgggcgtgagcaatgtggctttcggcttgccgctgccggtggcggtcggccataacgcaggcggcgcggcgctattgctgacgctggtgctggtcaattaccacgcgcgtaccagcctggtccgggtgcgcaatcagttgccgttcggctggcgctttattccacgcaaacacgtttcgggcctcatcacccttaaaggagagatgccatggcgaccttgatcggcgcacgtcacgatcaagcgatctggcgcgactatttggagctgaccaagccgaaagtggtggtgctgatgctcatcacatccttggtgggcatgttcctcgcgacccgcgccggggtgccgtggacggtgctgattttcggcaaccttggcattgcgctgtgcgcgggtggcgcagcggcggtcaaccatgtggtggaccggcgcattgatgcggtgatggcgcgtacgcataaacgacccatggcagaaggccgcgtatcgccagtggcggcgttggcctttgctgtgtttctggctgttgcgggcttggcgttgctgctggcgttcactaacccgttggctgcgtggctgacattggcctcgctgctcggttatgcggtgatctacaccggctttctcaagcgcgccacgccgcaaaacatcgtcatcggcggcctggccggtgccgcgccgccgctgctgggttgggtggccgttaccgggcatgtcagcgccgagccgctgctgctggtgctgatcatcttcgcctggaccccgccacacttttgggccctggccattcatcgcaaggaggaatacgccaaggccgacatcccgatgctgccggtcacccatggcgagcactacaccaaggtgcatatcctgctgtacaccttcgcgctgctggcggtgagcctgatgccgtatgtgatccacatgagcggcctgctgtacctggcctgtgcgctggtattgggcgcgcgctttctgcaatgggcctgggtgctgtaccgtggcagccagccgcacgcggcgatcaacacgttcaagtactctatctggtacttgttgctgctgtttatcgccctgctcgtagaccactacttactgttgaacctatgactcgaactcaaaaaaccgtctttatcctggtggccatcgtcgcgttgatcatgggcctgaccgttaacaaagtgctcagtggcaaaggccagggcgacccgaccgcgctgatcgacgcgggcatcatccttctgccgcaaagccgccagctgccgccggtgaccatgactaaccatgaaggccagccagtggtggtcaacgagttgaaaggcaagtggagcctgctgttcttcggctacaccttctgcccggacatctgccccaccaccctcgcccagttgcgccagatcaagagcgaactgcccaaagaggcggtggataagttgcaggtgattctggtcagcgtagacccgaaccgcgacacgcccgctcagctcaagcaatacctgggctacttcgacccgcaattcgaaggcctgaccggcgcgaatgtggacgatgtgcagaaggtctcgaatgcggtgagcattccgtttattccggcggataccagcaagccgaactacaccgtcgatcacagcggcaacctggcgctgatcggcccggacgggacgcagcgtgggtttattcgtgcgccgttgaataatcaaaagctggtggcgcagttgccagggttgctgcagcgcaagtgatcgttcccacgctctgcgtgggaatgcctcttgtgacgctgtgggtcgcgacctcaacagcgggacgcagagcgtcctgggctgcattcccacgcggagcgtgggaacgatcactcgccaccccggcaaacaaaacaaatcatctgtgggagctggcttgcctgcgatagcggtgggccagcttgcatctcagttgctgacccaccgccatcgcaggcaagccagctcccacagtggttttgtgtaaggtttgaacggggtgtcgtcggagatttcccacgtgttgtcgcgctgtgcgtgaacttgttggacggtcttggggtggctagtctttggcctgtcgctgcaaattcagtgacagggcgtaggaacccttttatgtacccttggcgtcatagcgccaccgtctgattgcggcgttttttttgtgcccgtactatcagtcgcggcggctatgcgcgggcacgtttcgacgtggctgagatccctgggtactcggttcctaccccgcgtatggctgccacccatgcccgtaggaaggctgttggcagctcctgttcatacccggagttgtcccaatgcaagcacttacccctgatccaccgatcacacccaaagtcttcacccgccaccatcaccagctgcacgccgtgctgatcgacagccaaccctggttcagcgcctccgacatcggccacctgatgggcctgcacctaaaccctgcgctactgcgcaagctcgatcccgaccaacaacacaccttgccgctgatcactcatggccactgtgcgccgacgttgatggtcagtgagtctggcgtctacgcgctgcttatctaccactactacccggagaatcggtgtttacgccaatggttgacccatgaggtggtgccagccctgcgctgagagcaaaagccggtggcacagttgccgggtttgctacagcgcacatgatcgttcccccgctctgcgtgggaatgcctcctgtgacgctctgcgtcgcgacctcaacagcgggacgcagagcgtcccggcctgcattaccacgcggagcgtgggaacgatcatccttcaggcaacacaaaacaaaagtgggagcgggcttgcccgcgaaggcggagtgtcagtcgactgataagtgactgatccaccgccttcgcgagcaagcccgctcccacattttttgatcttcagtgtgtgaggatcgagtttgatcagaacgccggcagaatcgcgcctttgtacttatcaaggatgaacgctttcacttcaggtgtgtgcagggctgcaaccagcttcttcacggcgtccgagtctttgttgtcttcgcgggtcaccaggatgttcacgtaaggcgagtcgttgccttcgatcaccagggcgtccttggacgggtccagtttggcttccagcgcgtagttggtgttgatcagcgccaggtcgacctgggtcagcacgcgcggcagggtcgcggcttccagttcgcggaatttcaggtttttcgggttgccggtgatgtccttgatggtcgacaggatgttggtcgggtccttcagggtgatcaggttgtgcttggccagcagcagcaatgcgcggccgccgttggtggcgtcgttcgggatcaccacgttggcaccgcttggcagctcttccagctttttgtacttgctggagtaggcgcccagaggttccaggtgcacggcgccgacgctcaccaggtgagtgcctttggccttgttgaactcatccaggtacggctggtgctggaagaagttggcgtccaggcgcttttcagccacctgtacgtttggctgtacgtagtcggtgaagactttgacctgcagatccacgccttctttggcgagtgcaggcttcacgaattcgaggatttccgcgtgcggcaccggcgaggcagcgaccgtgatggtttcggcgtgggcggaaaacgcagcaacggcggcgaaagcaaccagtagttttttcatccaacaagctccttgttcgggcatgtgccggcgggggccggcaatggccgttattttcgagaaaagtgcaccaccagcttatcgccgacggtttgcagaatttgcaccagaaccagcagcatcaccacggtgacgaccatgacgtcggtctggaagcgctggtaaccgaaacgaatcgccaggtcacccaagccacccgcgccgactacaccggccatggccgtgtaggaaaccagtgtaattgccgtcaccgtaatcgccgcgaaaatgccggggcgtgcttctggcagcagtgcgttgacgatgatctgacgcgtactggcgcccatcgactgagtggcttcgatgatgccgcggtccacttcacgcagagcggtttccaccaggcgcgcgaagaacggcgtcgcgcccaccaccaatggcggtatcgcaccggccacgcccagcgaagtgccggtgatcagcaccgtgaacgggatcatcacgatcagcaggatgatgaacggcagcgagcgcaggatgttcacgatcagcgacagcagcgcgtacaggcctttttgttcgaacaattggcgcgggctgcacaggaacagcagcacgcccaatggcaaaccgagcagcacggtaaagaacagcgaaccgaacagcatggtcatggtgtcgccggtggccagccagatctcggaccagtcgatattggcgaagaaactcaacaggacttccattagcgcagaacctccatgtggacgtctgccgcggtaaagcgggcgaaagcggcttccatgtccccaccggtgacggcgagggtcagttggccgtaaggaatatctttaatgcggtcgatacgaccggcgaggatgctgtagtccacacccgtttcgcgggcgacggtgcccagcagcggcgcgtaggtcgcttcgccctggaacgtcaggcgcacgatacggccgggcacgtgggcgaagtcatcacgctgctcgccttcgtcgacctgctcggcttcctgtacgaagcgcttggtggtcgggtgcttggggtgcaggaacacatcggccaccgagccttgctcgacgatcacgccggcgtccatcacggccacctggtcgcacacgcggcggatcacgtccatttcatgggtgatcagcacgatggtcagcttcagctcacggttgatctcggccagcagttgcagcaccgaggcggtggtttgcgggtcgagggcgctggtggcttcgtcgcacagcaggatttttggcttggtcgccagggcgcgggcgatgccgacgcgctgcttctggccgccggacaactgcgccgggtacttcttggcgtggtccgacaggccgacgcgggccagcagttcggccacacgctggtcgatggccttgcgcgacagttcgccggccagggtcagcggcagcgccacgttgtcggcaacggtcttggaggccagcaggttgaagtgctggaagatcatcccgacttgctggcggaaacggcgcaggccgttggcgtccagcgcggtgacttcttcgccgtcaacgttgatctggccaccgctgggttgctccaggcggttgatcagacgcagcaaggtactttttcccgcaccggagtggccaatcaggccgaacacctggccgttttcgacacgcaggctggtggggtgcagggcggggatttccttaccggcgacgcggtaggttttatggacgttatgaaactcgatcacgtagcgaaccttgtggggcgcatggaaaagggatcagcggttagccgggcgcgcattttagcctgtccgtatagcggtatttagcatttatttctcattcaaccagcgatttggcaataacgcgatcaaaggtcataaaaaaggaacggcgcaaaaccgtgtcagtcactacttaagcaactcaatttcccaggtgccgtgcctggagttttgctcaaacgagccggggaccgctctggccactttgaataaggagttttgtctgatgagtaccaaaaagccagctaccccgccgaagagtgaactcgcgggcaccgacaccctggaccgtggcaacaccaacgccaagctgcaggcgctggaggagtttcgttcagacgctaccggccaggcgctgcgcaccaaccaaggcgtgaagatttccgacaaccagaacaccctgaaagtcggcgcccgtggcccatcgctgctggaagacttcatcatgcgtgaaaaaatcacgcactttgaccatgagcgtatcccggagcgcatcgtgcatgcccgtggcaccggcgcccatggctatttccagacctatgagaaccattcggcgctgagcaaggccggtttcctgcgtaaccccgagcataaaaccccggtgttcgtgcgcttctccaccgtgcaaggcccgcgtgggtcgggcgatacggtgcgtgacgtgcgtggttttgcggtgaagttcttcaccgacgaaggcaacttcgacctggtgggcaacaacatgccggtgtttttcattcaggacgcgatcaagtttcccgactttgtgcacgcagtaaagcctgagccacataacgagattcctacgggcggctcggctcatgacacgttctgggattttgtctcgctgcagccggaatcggcgcacatggtgctgtgggcaatgtccgaccgtgccatccccaaaagcctgcgcgccatgcagggctttggcattcataccttccgcttcatcaacaccgaaggtaagtcgagcttcgtgaaattccactggcacccgaaagtcgggacctgctcgctggtgtgggacgaagcgcaaaagctcgctggtaaagataccgattaccaccgtcgcgacttgtgggaagcgattgaaagcggcgattaccctgagtgggaattgggcgtgcaaatcgtcgcggaggaagacgagcacaagttcgacttcgacctgctcgacccgaccaagatcatccctgaagagctggtgccgattacgccactcggcaagatggtgctgaaccgcaacccggacaacttctttgccgaagttgaacaggtcgccttctgcccaggccatatcgtgccgggtatcgacttcaccaacgacccgttgctgcaaggccgtctgttttcctacacggatacccagatcagccgtctcggtggcccgaactttcatgagctgccgatcaaccggccggtcacgccgttccataacggccagcgcgacgcccagcatcgcaccgtgatcgacaaaggccgtgctgcctacgagccgaattcgattgatggcggttggccgaaagaaaccccaccagctgcacaggatggtggtttcgagacctactacgagcgtgtcgacgccaacaaagtgcgtgagcgcagtgagtcgtttggcgatcacttctcccaagccacgctgtttttccacagcatgagccaccacgagaaagagcacatcatcgcggcctacagcttcgagttgggcaaggtggagcgcgagtttattcgcgcccgtcaggtcaacgagattctggccaatatcgacttggagctggccaagcgcgttgcgcagaacctcggcctgcctgcaccgaccaaaggcaccgtgccgccgcgtaagacctcgctcaaagagtcgccggcattgagccaggtgaacctgctatcgggcgatatcaaaacgcgcaaagttgcgattcttgcggctaacggcgtcgatggtgcagcgattgatgcgttgaagaaggcgctggaagctgagggcgcacacgccaagctgctggggccgacctcggcgccggtgaccacggccgacggcaagagcctgaaagtggatgcgtcgatggaaggcatgccgtcgattgcgtttgatgcggtgttcgtaccgggcggcgccaagtcggtgcaggctttgagtggcgacggtgtggcgttgcacttcctgttggaagcgtacaagcacctgaaggcgatcacggttgccagtgatgccaagccgttgttggatctgctgaagcttgaggcggatgcggggctgatcgtggggtcggatgcgaaggcgtttaaggcgttctttgcggcgattgcgcagcatcgggtttgggctcgggagccgaaggctaaggctattccggcttaagcttttggttgactgttagaccgctatcgcgggcaagcccgctcccacattttgaactgtgaatacattcaagtgtgggagcgggattgcccgcgatgctttattgcgccttgcgcggaatcaaaacaacctgcgccgggatgcgtttcacaatctgccggtgaatcttcaggtcaaaccccgaatcaattcgcttcacccgtttggtcagcaatgtggccagccacgggtaatcctgcgtgcgcggcgcctggatggtcacatcgcactggtaattcaccacatcggtggcgatcgcatccagttgatggcgaagttcttcaatatcgatgaggttaagcgccactgtggtgctttcggccgcggggtcgatgaccttggcggcaggcttggcttcggcggctttcaaggcggcttcggctttgtccaactcggctttacgcgcatggctgatggcgctgttgacgccgccggtcagcgcgggtgccttgggcatgagggcgcgggcacggctcagtgcggtggcggcggcgttgacgtcacccttttgcagcacgatctggctgcgctgcaggtaggcttcggccaactggcgctggtaagtttccagggctgggtcgttgggcgactgggcctgcaaggcggcgagttcgtcttcggcggtggccagctcactgctggccaggttttgctccagctgcgcgatggccgcagcgcgtgcgtccggtacctgaggggcagcgggcggtgtgctttgacaggcgcccagcagcagggaaaatgcggcaaggagcagataacgggcgttgaacagcttcattcctgcgactctctatttgcgcaaaaagcgagcaagtctacacccctcgacggggcaggacaaaactcagcagaaagagggcggccgccgtcactacaatcgacggaccggccggtgtgtccttgaaccacgacagcgccaggcccccgcacactgcgagcatgcccaacaggctggcgccgatcgccatttgctcgggtgaccgggcgtggcgctgggcggcggctgcgggaatgatcagcagtgacgtgatcaacaatacgccgacaatcttcatcgcgacagcaatcaccacggcgatcaacagcatcagggtcatgcgcagcgccggcacgggcaggccttctaccgtggccagctcttcgtgcacggtgattgccagcagcggacgccacaggaccaccagcaagaccagcaccgcggcgcttccgccgaggatccaggccaggtcggtagggctgatcgccagcaagtcgccgaacaggtaagccatcaggtcgatgcgcacttcgtgcatgaagctcagcaccaccagcccgagggacaaggtgctcggcgccaggatgccgagcagggtgtcggatgccagcggctggcgctgttgcagggttaccagcagcaccgcgagcagcaggcagccgacggtgacggcgatggtcgggctgacatcgagcaaaaagcccatggccacgcccaacaacgcggcgtgcgacaacgtgtcgccgaaataggccatgcgccgccagaccacgaacgagcccaacgggcccgccaccagtgccaaagccaagcctgccagcagggcgtagagcagaaaatcagccatgcttgcagctatctccatgaacgtgggtgtggggggcggcgggatcgtcgaccactgcaccatgcaaatcatgggcgtggtcgtgatggtgatgatagatcgccaggctctgggcattcttgccgaacagctcgacgaacgccgggtcgccgctgacctgttccgggtggccggagcagcagacgtggcggttgaggcacaccacttggtcggtggtgctcatgaccaggtgcaaatcgtgggaaaccatcagcacgccgcagccatggcggtcgcgcaggcgagtgatcaggctgtacagctcggcctggccagcgacatcgacgccttgcacgggctcatcgagcaccagcaattcaggctcgcgcagcaaggcgcgggccagcagcacgcgctgcatttcaccgccggagatgctctgcaccgggctgtcgatcacctgttcggcgccgacttccttgagtgctgcctgggcgcgggcgcggtctacaccgggcaccaggcgcaaaaaacgcagcacggacagtggcagggttgggtccacatgcagcttttgcggcatgtagccgacgcgcagcctgggcttgcgccatacactgccggtgtcgggcttgagcaggccgagcacggcgcgcaccaaggtggtcttgccggcgccgttggggccgatcagcgtgacgatctgccccggttccacgctcagtgcgatgttatccagcacgttttgcccggcgaacgtgaccccgacctgctccaggcggattaacgcgttgctcatcaagccccctggcaacccgagcagagcccgaccacttcgacggtttgcccttcgacccggaagccgacctcggcggaactcttgatgatggcgtcgctgatgcttttttgttcaagctcgatggcggcgtggcactcgcggcagatcaggaactggccctggtgcgcgtgttccgggtggttgcagccgacaaaggcattgagtgaggcgatgcggtgcaccaggccgttttccagcaggaaatccagcgcgcggtacaccgtcggcggcgcggcgcggcggccatcctgctcgctgagcacgccgagaatgtcgtaggcgcccagtggcttgtggctctgccacaccaattccagcacccggcgacgcagcgcggtcaggcgcaggccttgacgggcgcacagggtgtcggcctctgacagcgcggtatgtacgcagtgagagtggtcgtggggacggctggcaagcggtgttttaggcatgagcggcgacagacatttgatagagacgttattatgttacccgttcctacgccattgagtggtcatcgtgtcccgactttttcccgtttttgtcgtatttgtcaccagtttgttcatcgccggggcggctcaggccgaggtcaaagtgctgaccagcatcaagccgctgcagttgattgccgcggcggtacaggacggcgtggccattccggaggtgttgttgccgcccggcgcttcgccgcacaactatgccctgcgcccatccgacgtacggcgcgtgcagtcggtggacctgctgtattggatcggcccggacatggaaagcttcctgccgcgcgtgctcaaggggcgtagcctgccgaccgtggccgtacaagacctgccggatatgaaactgcgtcgtttcgccgaagatagccactcgcacgccgatgatgctgacgaacatgaccacgatcatcgcccaggcagcctggatgcgcacttgtggctctcgacggtcaacgcgcgcgtaatcgctgcgcgcatggcggctgacctcagcactgccgacccggccaatgcggcgcggtatcaaagcaacgtgaaggcgttcgatgagcgcctggacgcgttggatgcccggttgaaagcgcgcctggcgaaggtgggcgataagccttacttcgtgttccacgaagcctttgattacttcgaagatgcttacgggctcaagcacaccggcgtgttcagcgttgccgcagaagtgcagccaggcgcccagcatgtggcggcgatgcgcacgcggttgcaggaagtgggtaagacctgtgtgttcagcgagccgccattgcgcccgcgtttggccgagaccctggtggccgggttgccggtgaagctggcggaactggacgcgctgggtggttacaccccggcgacggcgcagggttatgagcaggtgttggagaagttggggaacgacttggccgggtgcctggagtcgctctaactatcaccgcataaccgatgtgggagctggcttgcctgcgatgacggtgtatcagtcgacatcgctatcgcaggcaagccagctcccacattgaccgggtcggcctttagagtgcgaacggcaggtggacagttacctgctgacgctgcgccagccggtgctcgaactcggccgggtcatgaatcagcacatcctgcccggcaaacgattcagcggcgatcagccgcgacagccagaaccgcacgcacgctacccgcaacatagtcggccacagctcggcttccttcgccgtaaacggccgcagaccggcgtaagcacccagcagtgcccgagcgcgttgcccatcgatcacgccatcggcgtccgaacaccagtcattcaaagcgatcgccacgtcgtacagcatcgggcccgagcaggcgttgtaaaaatcgatcagcccggtcaggtgcgtgccttcgaacatcgcgttgtcgcggaacaggtcggcgtgaacgttcgcgcgcggcagtgcgagaatttcggctttgtgggcttcgatctcggtcagcgcgtcttgcagcaggtgttgctgggcgtcgttgaggtgcgaaatcagctgcgcaccttcggtgagcatccagtccagcccgcgatccgtcttgcgttccagcactttctcgccttgagtggccaggtgcagatggccgagcaggtcgccgacctgggcgcaatgctgcgcgttggcgtccttgatgtgcttgccggccaggcgtggttgcagcagcgccggcttgcccttcagctcgcgaagggcttcgccgtcggtggtgcgcagcgcgtaaggcacgggcaggtcggcgtcgtggagcacgtcgagcagctcgatgaagaacggcatttctgcaaccgggccgcgctcaaccagggtcaggacgaattcgccctgttccaggctgataaaaaagttggtgttttcgctaccggcggcaatcccctggaaatcaagcaggcggccgagcccgtaaggggcgagaaaggtttccagctcgggccgagccagcggggtgaacacagacatggttaaaactgccagtacgggcgccgcgatgggcggcgccaatttaagttaagaaatcatttccattcgaagatcttccatgacgggatcagcatatccggctggtcagaacggatgaagttcgcatcggttccgtccgcgcgcaccaggaaatacggtggcgcgccctttacggtgaccttgatcgcgtacaggaaaccgttttggcggtactcctggatggttctgtcaccttcggtgcggatcgtgacttccgggtctcccgagggtgcgctgtcagctgccgtggcggccagcggcaagaacgcaatcaagccggtcaacaacaggcgatttactgtacgcatgataaccttgtccctttgtcgtcattggtccggctattctagcgcctgacccgccgaaaaggttgatcctgctcatgagccaagcccccctcgtcctggtggacggttcttcttatctgtaccgcgccttccacgcgctgccaccgctgaccacctccaaaggcctgccgaccggtgcggtcaagggcgtgttgaacatgctcaaaagcctgcgcaagcagtatccgaacagcccgttcgccgtggtgttcgacgccaagggtgggacctttcgcgatgacatgtacgccgaatacaaggccaaccgcccgagcatgcccgatgacatgcgcctgcaaatcgagccgctgcatcaaagcgtgattgccctgggctttccgctgctgtgcgtcgagggcgtcgaggccgatgacgtgatcggcaccctggcccgcagcagtgcggcggcggaccgcccggtggtgatttctaccggtgacaaggacatggcgcagctggtcgacgggcacattaccttggtcaacaccatgaccggtagcgcgatggacatcgagggcgtgaaggagaaattcggtgtcgctcccgagcagatcatcgattacctggcgctgatgggcgattcgtccgacaacatcccaggcgttccgggcattggtccgaagaccgcttccggcctgctggtgggcgttaacggcggcctcaaagagctttatgagcagttggatatcgtgccgaccctgccgatccgcggggccaagaacctgccggccaagctggaagagcacaaggaaatggcgttcctgtcctatcagctggcgacgatcaagatcgatgtgccgctggacgtgggtctggaagacctgcacttggttgagccggaccgcgagaagctgctggagctgtacacgctgcttgagttcaagagctggattgatgagattcagcgcgatgccaagcgtgttgagctcaaggccccggccgctgaagcagccgttgaggtggttgaggctgcacctgtggaggcgtcctacaccacgattcttgaccaggcgacattcgacagctggttgaagaagctcaacgaggccaagttgttcgcattcgacaccgaaaccaccgggatcgacgcacaacaagcgcagttggtcggggtttctttcgccgtacagcctcacgaagcggcctacatcccgctgacccattcctacgtcggtgcgccgcagcagttggatcgcgacacggttctgttggcattgaagccgctgctggaagacccgagcaagctcaaggtcggccagcacgccaaattcgacatgaacatactggccaattgcgccatcggtggtgaccctgcgcacggcatcacggtgcgcggtatcgcgttcgacacgatgcttgaatcctacgtgttgaattccaccgcgacccgccacgacatggacagcctggccaagaagtatctggactacgacaccgtcagcttccaggacatcgccggcaaaggcgccaagcagctgaccttcgaccagattgcacttgaacaggccggcccgtatgccgccgaagatgccgacgtgacgctgcgcctgcatcaggccttgcacgcacaactggcagccataccgagcctggccagtgtgctgaccgatatcgaaataccgctggtgccggtgcttgcgcgtatcgaacgccagggcgcgctggtggataaggcgctgctgggcatccagagcatcgagcttggtaacaagatggttgagctggagcgccaagcgttcgagatcgccggtgaagagttcaacctgggttcgcccaagcaactgggggcgattctctacgagaaactcggtttgccagtgttgaagaagaccggcaagggccaagcgtctacggctgaagaagtgctggccaagttggccgaagatgatttcctgctgcccaaggtgctgatgcagtaccgcagcatgagcaagctgaaaagcacgtataccgaccgcctgccggagcagatcaacccgcgtactggccgtattcacacgtcttatcatcaggcggtggccgcgaccgggcgcttgtcttcgagcgatccgaacctgcagaacatcccggtgcgcaccgctgaagggcggcgcattcgccaggcgtttgttgcgcccaagggttacaagctgctggcggcggactattcgcagatcgagctgcggatcatggcgcacttgtccaaggacgagggcttgatgaatgcgttccgcaacgacctggatgtgcataccgcgacggcagccgaggtgttcaaggttgaattgcctgaggtgacgtccaatcagcgtcgcagcgccaaggcgattaacttcggcctgatctacgggatgggcgcgcagaagctgggcaaggatattggcgtcgataccaagaccgccaaggcctacatcgacgtgtacttcgcgcgctacccaggcgttcgcgagtacatggagcgcacacgtgctcaagctgccgaccaaggctatgtggaaaccttcttcgggcgccggctgtatttgcccgatatcaactccaacaagccacaggagcgcgcggccgcagaacgcacggcgatcaacgcgccgatgcagggcacggcggcggacatcatcaagaaggccatggtgctggtggacaactggctggccgagtcgggcctggatgccaaggtcatcctgcaagtgcacgatgaactggtgcttgaggtgcgtgaggacctggtggcagaagtcagcgagaagattcgcgagcacatgagcgcggcggccaagctggatgtgccgttggtggtggacgtgggcgtaggcgacaactgggacgaggcgcactgatttcgcggctctgccattgctggggtgatggcagagcgctttagatcagaaagcgctgcgagttatttccaatagttttttgagcgtgccggaacttaacctgtgaactgctactcagagttactgaatgggtggtgaagcccttcaatgctcctatgttgtgttaagtgttggcagatatctggaccccgccctagcggtccggaacttggaccccgaacttcccctccccatacgaagtccggggttttttttgcccgcagaaaagttactcggcgatttccgcgcccttgtctgccaattccatccagccggccaatacagtgtaggcgtcttccaggcccatgcgcttgggggccgagaacagttggatggtgatcgcatcgccccaacccttacggatttcggactgcactttgagcaaggtgttcttggccgcgccgtaggtcagcttgtcggccttggtcagcaggatgtgcatcggcatgccgctggcgacggcccaatcgagcatcagcaggtcgaagtcggtcattggatgacggatgtccatcatcagaatcaaacctttcaaactctcccgaccacccaggtaagcctcgaggtgacgctgccagtgcagcttcaatgggataggtacttttgcgtaaccgtagcccggcaggtcgaccagacgccgatcatcgtctagcttgaagaaattgagaagttgcgtgcggcccggggttttcgaggtgcgcgccaggctggcgtgggtcagggtgttcagcgcgctggatttaccggcgttggaacggccggcaaaggcaacttcaaagccttcgtcatcggggcattggtcaactttggcggcgctgagcatgaacgtggactgttggcacagaccgaggatgggattcttgagttgcatgagatttccgatgtgggcggtgccgaaaaagggtgcggcaagcggtgtcgtttccgtttcagtagcgccagtatataatgccgcagattttgtgtgtgctttgtcccagcgaaggatgaagttcacgggagcgaaagaccttcattgcgcattagaacgcaaaacgctctcaaaccctgaaaaggtcgatgtatgacccgttggttgctcgctttcggtgtcctggttccgctttacggcgctcaggctacacaggatccggaggcgctgtacaaccgagtttgcgtggacacgctggtgcaacacgtgacccagggtttcaaggcaatgccgccgcgtggtttgtgcatggactgcagtactgaggattaccaggccatcattgagttgatggtgagtaaacccggtagataactcttaaacccttagccgtagttggattagctgatgaacaaactgatcgtgagtctgctgttgaccttgggcatcaccggtgttgcccatgctgcaggcgacgctacagcgggtcaggcgaaagccgccgtgtgtggtgcttgccatggaccggatggcaatagcccggcgccgaacttccccaaactcgcaggccaaggtgaacgttacctgaccaagcagatgcacgacatcaaggacggcaagcgcacggtgctggaaatgaccggcttgctgaccaacctcagcgatcaagacctggcggacatcgcggcatattttgccagccagaagggcagtgtgggagctgctgatccgaaactggtcgagaaaggccaagcgttgttccggggcggcaagctcgctgatgagcagcctatcggcggcatgccggcatgcaaggcttgccatattccggacggtggtggtgtcgcagcagcaggcttccctcacttgagtgggcagcatgctcagtacacggccaagcaattgaaggatttccgcgagaaggttcgttatatcgatggcgatgccggtaacaaaatgatgaccgacattgcggccaaactctcggataaggacattgaagcgctgtccagctatatccagggcctgcattgatccaggcagtacgttaacgctcgattaatccatcgatgcaagcataaaaagggtggcttaggccgcccttttttgtggccggtgccgttacactaacgaactcatgcccgcgtagacctgtcacacctaaaggtcgcgtgaggcgactttatttgtccaggagtaaagcatgcgtaatctgatcctcagcgccgctctcgtcactgccagcctcttcggcatgaccgcacaagctgccgataatgtgccgcttgaagccggtaaaacctatgttgaattggccaacccggtcccggtttcggagccaggcaagatcgaagtggtggagctgttctggtatggctgcccgcattgctacgcctttgagccgaccatcaatccttgggtcgaaaaactcccgtccgacgtgaatttcaaacgcatcccggccatgttcggcggcccatgggatgcgcacggccagctgttcctgaccctggaagccatgggtgtggagcacaaggtccacaacgctgtatttgaagccatccagaaacaaggcaagcgcctgaccaagcctgaagacatggctgactttgtcgccacccaaggcgtcgataaggacaagtttctggccaccttcaactccttcgctatccagggccagattaaacaggccaaggaactcgcgcagaaatacggcgtgcaaggcgtaccgaccatgatcgtcaacggcaaataccgtttcgacctgggcactaccggtggtcctgagcaaaccctcaatgttgccgaccaactgatcgccaaagagcgcgcagccaagtaaggggcctaccatgcgccgctggggtactgaacgtgtggttggcctgcatgatccgcaggtcaacgagcaccacctggaatccacaggcttgccggcagacagccgcctgcgcctgctcagcttcaatattcaggtgggtatcagtactgaaaagtaccggcactacctcacccgtggctggcagcatttgctgccgcacaacgggcgggccggtaacctgcaaaagatcggcaacctgctgaacgacttcgacctggtcgccctgcaggaagccgacggcggcagcatacgctccggctacatcaaccaagtggaacacctggctcagctcggagcgttcccgtattggtatcaacaactcaaccgcaacctcgggcgcctggcgcagcacagtaatggtgtgctcagccgcttgaagccgaccgctatcgaagatcacccgttgccgggtccgaaggggcgcggggcgatcctcgtgcgttttggcgaaggcccggaagccttggtggtggtgatgatgcacctggcgcttggggggcgtacgcgcaacctgcagcttgcctacattcgtgatttgatcggcaactataaacatcaggtgttgatgggtgacatgaacacccatgccaacgacctgctgcagaattccccgctacgggacctcgggttactggccccgcaagtcgaagccacgtttcccagctggcgcccgcaacgctgtcttgaccatatcctgctcagtccgaccctcacgctcgaaagtgtgcaggtgctggcgcagcccatctccgatcacctgccggtcgcggtagagattcgtctgccgggttcgctcacggctgatgcataccccgcattgagcccaggcaccagcggaccccttgcatgagcgacgacgcccagcgttggaaagagaaataccttaaaagcatcgagcagcaagacaagctcgaacgccgttgggctgcccgcctcgacctgctgcgtcgtgggctggtgcgcagcaccctggcggctgaggggaccgaccgtgcggtggaccaatgcatgaaggagatgcgcgacgtcgtgcgcaccgacgacatggacgccgccctcgccgccttgctgccgcgcctcgaaaaagccgtactggattctgagcaacgccgcgaaacccgggtcgaccagatcagcaccgcgctcaccgccctggtcgcccagttgcaaaagctaccgctgccgcgcgaggtggcccgcccgctgaaaaccttcgccaagcagctggatggccgagtcgggcaggcgcgggaaattccgctgttgctcagcgagttgagcagcctgcaggggcaggcactgaataacctggagccggagggtgaaaccccgcgcgccgggccgggcctgctgcaacgcctgtttggctccaaagaggtttcaaatgacgcgccggtggtcgacgccgcgccactggctgccccggagccgactgcgccaaagcccgctgcacccaaactcgcccctgagccgaaggagccggtgcaatcggaagagctgacccaagccttgcgagctttcgcgccgctggcgcaagctccggcccccgcgcctgctgagccggctgaacccgtcaaagtggcagagttggccggcgaaacatttgtgttcgaggcgcccgtgccggtcgaggcaaccgccttgtctatcgaggtgcctgcgcccgaagtgcaggagccgctggtcgacgaagccgcacccgaaagcgccctcgccgcgtttattgaggcaccgcaggctcaggtcgatacgccggatgaaacgaccattggcagtttgtcccttccgcccgtgctggaaagccccgagcccgacccggatgcgctgcaagcggacggcacctacgccctgcccgactcgcccgagccgtcctatagctcggtcgccaagcatatcgaagacaccttgctcggcctgctggaggacttgtcgctgcccgagcgccaccggccccaggccgaagccatgcgcgagcgactggcccacggcttgaactggtacgaactgctgccgatcctcgatgacctggccgtgctcatgctggcgatcaccgacagcggccagcatgagttcgaggcctatctcaagcagctcaatgagcgcctcgaagcgttccagggtcatctgcaagtggccagtgacggccacgccgacagccgctcggcggcgcgggaactggacacgcagattcgtgaacaagtcgatggcctgcaaagcagtgtgcaggacgcggctgacttggacagtctcaagcatgtgctcgaaagccaccttgaaggcctgctcggcaccatggaccagcaccagcagcaacgtgaccagcgcgagcaggaagtagcagcacgtcttaaaggtctggctgagcgtgtggcgaacatggagcaggaagcccaaggctatcgcgagcacttggaggtgcaacgccagaaggcgttgatcgatccgctcaccggtctgcccaatcgtgcggcctggagtgaacgcctggaccaggaagtgaatgcctggcaccagcgcggtaacagtctgtcgctggccatgctggacctggatcacttcaagcgtatcaacgacggctacggccacttggcgggtgacaaggtgctgaagatcatcgccaatgtgctgcgtaagcgcctgcgccccagcgactttattgcgcggttcggcggtgaagagtttgtgttgctgatgcccgactcagccttggcggatgccctggacgtgggtgaagtgctgcgcgccgcgatcgaggcgtgcccgttccacttcaagggcgagccggtgacgatcacggtgtcgatgggcgtggcgcagttgcagccgggtgagcgcagcgacttggcgctcaagcgtgccgacgaagcgctttatcgggccaaggcggcggggcgtaatcaggtgcaggcggcctaaaagatgttccattttgtaatttgaccgcccagcaacaatcggtacgttacactgttgcattatcgtcttcagcgtaatgtcttccgccatgaaatccatttacttcgccttcgtctttctcctgcttgccggctgcgccagcggcccacggctggacaccaaccatccttcggtcaactacgacaaccgcgtgcagttcgtcgttgtccattacacctcaaccaaccttgaacgctccctggcgctgctgacgcacggccaggtcagcagccattacctgatcggcgacgacgcctccgccaccatctacaagctggtggatgagagccagcgcgcctggcacgccggcgaaagcgagtggatgggtcgcacctggctcaactccagctccatcggcatcgagatcgtcaacccgggttatcgcgacacaccgacaggccgcgtctggtatccgtattccgaggcgcaggtgcagtcgctggtggtgttgctcaaggacatcagcaagcgcaatggcattgaccccaagaacatcattggccatagcgacatcgcgccgttgcgcaagctcgacccgggcccgttgttcccgtggaagcgcctggccgccgagggcttggggatctggccggatgctcaggccgtggcgcggttccagatgcagtacgcggcggacctgccgagcgttacctggttccaggaagaattggcgcgtttgggctaccagacaccccagaccggtgagctggatgtcgccacgcggcatgtgatcgcggcgttccagatgcacttccggccgtcgctgtttgatggcacgccggatgctgaaagtgccgccatcctgcgcgcgttgaaccgtagctaagcgtgtaacccgattcaaattgtgggagctggcaagtcagctcccacacttgtttgtgctcggcaggcaacccaagttgccagattacagcggcagcgccatgtagaactgcgtcccctgccccggccgcgagtacacgcccatgcggccgccgtgcagctgcacaatctctttgcacagcgccagcccgaggccagcgccgcctttcttgcggcccacctgcacgaagggttcgaagatccgaccctgctggccataggcgatgccttcgccgttatcctcgacgctgataatcacccgctcgccatggcggcgcgcctgcaggcgaatctgcccgccatcagcggtatggcgtaacgcgttgcctaacaggttgtcgagcacgcgctccagctgcgcctggtcggcgtacagcctgggcaagtcagcctgggcttccaccaacagctcgatattttgcgcattcgccggctctgcgaagcgtgcgcgtgcgtgttccagcaagtcgttgacatcgcatggcccgagcgtgagtttttgcaggccattctggtagcgcgagaagttgagcaagtcattgatcagctgcatcaagcgctgcatttcttcgttaacggtgtccagcaggtccgcttcgcgggagtcggcgggaaacttcgctcgctcgcgaaacaggccgaaggccatgtgcataccggtcaccggcgtgcgcagttcgtgagaggcgcgcaatacgaattcactgcgcacccgttcgaaggcgcgctgctcggtgacgtcatgcagcaccatcacggcgccgagaatgtgcccctgtgtatggctgaccggtgtcaggctataagtcagcaggcgcagttcgccctcgacttccacttccagatcttccggtgcccgttccaggttgccgccgcgcagtaccagttgcagctgttcatccatttcggggcggcccagtgcctcgcccaagccctggcccaaacgagcctcgtcccaacccagctgacgctgcgccacagggttaaggtgttccaggcgcccttggcggtcgatcatcaacaagccatcgtcgatgctgtcgagcaccgcttgcaggcgctgctggccggcgagcaattcatcgacattggttgcctgatgctggcgcaaggcctcggccatgatgccgaagcgtcgggtcaactggttcatttccgctgccgacgagatcggcagcgtcacctcgaaatcgccctgcccgatcttgtcggcggctttggccaaggcttcgatcggcccaccgaagcggcgggcaatgccgtgggcggtgacgaagccgatgatcaaaaccgcgagcccgaccagccccagaagaccggcaatcaataacgcccggttgcgggacttgtgttcgctggcgttgatgttttccagggcgtgcttgtgctctgcgatcaagccgctgcgcaatgcgttgaaggtttcggtgagtttctggtttttattgttcgccagggagctttgctgggcctcgtcaaacgcctggaggaagcttagataatcccggcgtgcctggctgaacccactggttttgccgtcttgctgctcgtgggcgataccctgatccagcagcgcaaaatactgctgttttgaggtctgcagcgccacggggtccggttgttcctcgagcatcaggatcaactggtcccccagggtctggcgcagcttgagacccaggtccaaggtgatgaagttgctgcggatcagcgactcctggctcttggccatttgcataacactgaccagtcccaggaccagtcccagcagggcgacggtgatcagcgctgagatactcaggaacaaacgagtgcgcagtttcatcgctagcttcatagggtacagctcacaggttgtactgtttacgtttgcggtacagggtcgacgcgtcaatgccgagagtgcgggccgcctggtccagggtgtcgctggtggcgagcaccgcgccgatatgggctttttccagctcatccaggctcaacgccgcgccgatacgcggcgcattgttggtcggctgctcggccatcccgaggtggctgatttcaaccttttcctgcgggcaaatgatgctggctctctcaacaacgtttcgcagctcacggatattccctggccaacggtagttgagcagcgcctcacgcgcgtcgtcgctgaacccgcgagccggccgggcatattccttcacgaaacgcgcgaggaagcggtcggccagtgtcaggatgtcctcactgcgttcacgcaatggcggtaggtgcaacgtgattacgttgaggcgatagagcaaatcctcgcggaaacggccatcgcgcaccatgtcttccaggttcaggttggtcgcggccaggatgcgcacatcggcacggcgggtgaccgggtcgcccacgcgctcatattccttgtcctggatgaaacgcagcaattttggttgcagcgtgaggggaaaatcgccgatctcgtcgagaaacagcgtgccgccgtccgcctggttaacgcggcccaacgtgctttcgctggcaccggtaaaggcgccgcgactgtggccgaacaattcactttccatcagctccgccgtcagcgacgggcagttgatggtcacgcaggatttcttcgagcgcttgctccagccgtgaatggcacgagccaattcacctttacccgtacccgactcgccaagaatcaagatgttggcgtcggtgcccgcaacttggcgcgcggtttccagcaccaccatcatggccgggctgtgggagtcgaggccgtctttgggttggcgtacttcgccttccagcgcttccaggcgggccgagagttggcgtacttcaagctgtttggcggtggccaaacgcagttgatcagggctgcaaggcttgaccaggtagtcggcggcgccggcctggattgcgtctacggcggtgtccacggcggaatgcgcggtgacgatcaccacacgcatccagggcgcctggatacgcatctgggccagcacgtccaagccattgtcttcacccaggcgcaggtccaggaaacacaggtcgaatacctggcgttgcatcagggcatccgcctgggcggcgctgttggcggtggctacggtgtagccttcatcttccaggcagtaacggaaggtgcgaaggatcgcggattcgtcatccactaaaagaatgcggccttgaagttccttggctgattccatctgtcccacgctccttaactatgaatgatggtgattagtcccggaataatcgggcaagttgcatggtttattctgattgataaacggcatcttcgcgcaggtatctgcacatctctctgcaaacgcgccgattgctggcgttttcatgccttcatgccacttcggcaacgcgttattcggtttcgatcccttgatccgaccattgaccatcgtgcatttcgcacggcctggataggggcatcgtgcaggatgctgggctctatgcttgagcatcattcataacatgctgattttattgagttttattttgtaaaaaacctggcatgcactctgcaataaccctctcaacagcgtcatgaccgaataatcagaatgcgggagaaatgcagcatgactcgccaaagcctcagccaattgcgtgtatcgccactgcggttgcagcaaggtctgttcgccagcctggccttgatggtcacgttgattgccggccagcagatgcagcattggcagcagagtcagcagcaagccccgcaattcgaacgtccagtgatgacccaatcccatttccgttccgttggcagtgcgactgccgatgtaaccgccccgcaactgagagtggctgaccaggattcgaccctggaccaattgcctgctcaagaacgctgggtgttctaggcaacaaaaggtcgcttgtgttgagcggccgcacggcactaccgctgttacccctaaagaagcataaggagaatcaccatgttgagttgggcaatcacatttctgatcatcgccattgtggctgcagtcctgggcttcggtggtatcgcgggcaccgccacgggtatcgcaaaaattctgtttgtggtcttcctggtgatgttcatcgcttcgttcttctttggtcgtcgcggccgaggctgaatatgaccagtctgtctctcaaagccattgctgccgccctgctcttgggcggtagcggcctggtgatggccgccaacgacggtcaatcacgggccaacgaattgctcagtgcggacaagcagtaccgcgaaacctggcaaagcgtggtgaagaaagaagagcgcctgccggaatgggtgatgaacctgtccggtacggccgaacaaatgaatgccgtagaagaagatggcgacaagtacttggtcggtccgctgtgcgaaacggctgacacgtgcctgaacaaacgcctgatcgttgccttcagctacgacaaagaagatgcctacgccatgttggtggaagtgcccgccggtttgccggcagacaaatccccgacgcggcacgccgaataccgatttatcggtaagccggacgacggcatgaaaaagctgctgatggagcagcttaagaaagatccgaattggtactaggttccgtctgacgcttctgtcgtcaacggagccggcgtccatagaaagaagccctcgcttctttctgtctgcaccgctcgccaagggcggtgcatgaccagggggccgggttgctctgatcaatcaggatcggcgtgacctacgggtacagggagtgcctgcgcaagggccgggtcaggtgaaaagctgcgacgcaagttcacaagtcctcaagcttgctgaacttgcgacgggcttatcgctctcatcactcgtctcgtatgtcgcccttagtcgctattttcttttccgcctcctgctaatcattgctgggtatgtcgaagcgaccttctatctagaaaattttgcgcgcgccataggacttgtccgacgccaagctcatcaaatcccaggcatttttggcagtgactcacagtcgtccaatatctctgagcgagccggtattggccggttcacggcatattcacctgcctaaatggcatatttgaactgaccgttcggacagttattttcaaaaaaagccatgccgattcggcatagggtaggcgtttacggcattagacgtcgcactcttgcatgggaatagttgcgccttttttcgcctgccagtaagccatttcggccacgctgcggtgaccttctacggaggcagatgcacacactttttcgcttccgagcgttccagatggcgcatttgccttaagtccacttgaagtaagggtaatgacatgaagaaggcaaagctaagcctcgcctggcagatcctcatcggtttggtgctggggatcgcaatcggtgcagtgctcaaccatttcagtgctgaaaaggcctggtggatcggcaatgtgttgcagccagcgggcgatatctttatccgcctgatcaagatgatcgtgatcccgattgtgatttcctcgctgatcgtcggcatcgccggtgtaggcgacgcgaagaagctcggtcgaatcggcgtcaaaaccatcctttacttcgaagtagtcaccaccatcgccatcgtggtcggcctgttgctcgccaacctgttccacccaggcgccggcatcgacatgagtaccctgggtactgtcgacatctccaagtacaccgccactgccgccgaagtgcagcatgagcatgcgttcatcgaaaccatcctcaacctgatcccgtcgaacatcttcgctgccgtcgcccgtggcgaaatgctgccgatcatcttcttctcggtgctgttcggcctgggcttgtcgagcctcaagcctgaactgcgcgagccgctggtgaccatgttccagggcgtgtccgagagcatgttcaaagtcactcacatgatcatgaagtacgcccccatcggcgtatttgccctgatcgcggtgaccgtcgccaacttcggcttcgcctccttgctgccgctggccaagctggtgatcctggtttacgtggcgatcctgttcttcgcctttgcggtattgggcttgatcgcgcgcctgttcggcttctcgatcctcaagctgatgcgcatcttcaaggacgagctggtactggcctactccaccgccagttccgaaaccgtgctgccacgtgtgatcgagaagatggaagcctacggcgcgccgaaggccatctgcagcttcgtggtgccaaccggttactcgttcaacctcgacggttcgaccctgtaccagagcatcgcggccatctttatcgcgcagctgtacggcatcgacttgtcgattggccagcaactgatgctggtgctgacgctgatggtcacctccaaaggcatcgccggcgtaccgggcgtgtccttcgtggtgctgctggccaccttgggcagcgtgggcatcccgctggaaggcctggcgttcatcgccggtgtcgaccgcatcatggacatggcgcgtaccgccttgaacgtaatcggtaatgccctggccgtactggtcatctcccgttgggaaggcatgtacgacgacgccaagggcgagcgttactggaactccctgccgcactggcgcagcaagcaagcgctgccgaccggcgaaaccagccgcggctgatcgttgctgagtgcctacacaaaccccggaaaaatccggggtttgtcgtttctgccagccccgctatcattcgccccatctttcgggggattcaactgatgctcaatggcctgtggcttggcttctttgtcgtggcaatggtgtcagcactggcgcaatggctggttggcggtaatgccgggatttttgcggcgatggtggaaagcattttcgccatggccaaactgtcggtggaagtgatggtgctgctgttcggcaccctgaccttatggctgggctttttgcgcatcgccgaaaaagccgggatcgtcgactggctggccaaggccctcggcccgctgtttcgccgcctgatgcccgaagtgccggctggccacccggccatcggcctgatcaccctcaacttcgccgccaacggcctgggcctggacaacgccgccacgcccatcggcctgaaagccatgaaggcgctgcaggaactcaacccgatccccaacaccgcaagtaacgcgcagattctgttcctggtgcttaacgcctcgtcgctgacgctattgccggtgacgatcttcatgtaccgcgcgcagcaaggcgccgccgacccgacgctggtattcctgccgatcctgttggccaccagcgcctcgaccctggtgggtttgctttcggtcgcggtgatgcagcgcctgcgcctgtgggatccggtggtgttggcctacctgattcccggcgcgctggtgctgggcggcttcatggccttgttggccaccttgtccgccacggcgttggccggcctgtcttcgatcctcggcaacctgacgctgttcggcttgatcatgctgtttctggtgatcggcgcgctgcgcaaggtcaaggtctacgaggcctttgtcgagggcgccaaagagggcttcgacgttgccaggaaccttctgccgtatctggtggcgatgctctgcgcggtgggtgtgctgcgtgcttccggggcgctggacttcggcctcgaaggcattcgccacgtggtggcctggaccggcatggacacgcggtttgtcgacgcgctgccgacggcgatggtcaagccgttctccggcagtgccgcgcgggcgctgctgatcgagaccatgcaaaccaagggcgtggacagcttcccggcgctggtggcggcgacgattcagggcagtacggaaaccaccttttatgtgttggcggtgtactttgggtcggtggggatccagcgggccaggcatgcagtggggtgtgcgttgctggcggagtttgccggtgtcgtggcggcgattgctgtttgctactggttctttggttaaggcttaaattgctatcgcaggcaagccagctcccacactttgatgtgtcaatacattcaaaaaatgtgggagctggcttgcctgcgaagaggccctcagcgtttcgcagcagtattgccctgctgcaccacccaatccaccacctgcctgttcaactgatcccccgcctgcccaaacgccgccaccaccgccggcaccttggtgtcaccgacgggctgccgaacctcaaaccgccggctggcgatgatccgctgatcactcccacgcaccagtcgcgcatccaatcggaccacgacttcaacggcactgccgtggtactcgctctgaaacgcctgcaactgcccgcccagctcatagtcggcctgcaagttggtctcgtcggtgctcagcaacgtcactcgcccatcgcgttggaagccgtccataaaccgattgcgcagcaacaccggcgtcgggtcgctccagcgcgcgttcgcatagctgctgatcaggtcgccattaggcaccacggcaatgcgtgggctgtcgagaaattcgctgctctgcggcttgctcacgcgcaacgaccagcttaccggtgtgccttgggtggtcgtttgcgccgaagccaggcggtacacgtccgacgggtcgggtttgggcaggatcgagcacgcgctgatcagcgcgagcgccacaggggcaatcagttggtaagcacgcttcatggcgtgaactccttgttcttgtcgctgcccagcaggtaaccgctggggttggcttccaggcggcgtgagatggcgcgcagcgaacccagggtttcgcgcagttcgcgcacggccggcgccagttcgttgaggccttgcatgccgctgttcaccgagtccttgttgttggtcagcaaggtgttgatggtcgcggtgctttgctccagtgatttcatcgcctgctcagcactgccgaaggcctgcttgccttggtcattgagcaagccattggcgttgcgcatcagcacggtggtttgctccagcgccgcgctggcctgtttgctcacctgcatcaactgttgcatcaccaccttgatatcgccgcgttggtcggcgatagcgccggtggtttgttgcaggttgtccagggtattgctcaggcgttcgacgttctcgcgggagaacatatggttggcgttgtgcagcagcaggttaatgctggtcatcaagtcgttgctgttattcagcaagcgcgcgatgggcgatggcgaggcaatgatttccggcaggttgccgtccttgcccttgagctcggggctttgcggggtgccgccgctgagctggatgattgaggtgccggtgatgccggtcagtgccagcttggcctgggtgtcttccttgatcggcgtttggcccgccagccggatgcgtgcgagtacgcggcgcgggtcattggggtccaggcgcaggctgatcacgtcgcccaccttgatcccgctgtactgcaccgagctgccttgggacaagccgctgaccgcctcgttgaacaccacctcataatcctggaaggcgctgtcgatgctggatttggccagccacagcccaaacagcatcgcaccgaccaccacgattacgctgaatagaccgatcatcacatgatgggctcgggtttccatgtcatacctcgttgagcgattgagcggcatccaatgccgcgcggccccgggggccgtggaaatattcgtgaatccaggtgtcgtccgtttccgagacgacatcgatggcatcggccaccagcactttcttctgcgccagcaccgccacgcggtcggtgatggtgtagagcgtgtcgaggtcgtgggtgaccaggaacacactcaggcccagcgcatcgcgcaaggtcaggatcagttggtcaaattgcgccgcgccaatcgggtcgaggccggcggtgggttcgtcgagaaacaggatgtccgggtccagcgccaatgcccgcgccagggcggcgcgcttgatcatgccgccggacagcgacgccgggtatttatccgccgccgacaggggcagcccggccaacgccagtttgaccgccgccaggtgctcggcatcgcggcggctaaggccggcgtgttcgatcaatggcagggcaacgttttcggtgacggtcagcgaggaaaacagcgcgcccttctggaacagcacaccaaagcggcgttccaccagcgagcgttcatgttccgagaggttcggcaggtttttgccgaacacccgcacttcgccttcgctgggccggcgcagcccgacgatgctgcgcaacagcaccgatttgccgctgccggagccgccgaccaccgccaggatctcgcctttatacaaatccaggtcgaggttctcgtgcacgctctggctgccaaagcggttgcacagcccgcgcacttcgatcaccgcctcagtgggcgcacggtgtagacgactcaccagcccatctccataaagaacaacgccgcgaccgcatccagcacgatcaccacaaagatcgattgcaccacgctggaggtggtgtgggcgccgaccgactcggcgctgccgctgaccttgaagccttcaagacagccgatcgcggcaatcaggaaggcgaagatcggggctttcaccatgcccaccagaaaatgttgcacgccgatgtccgattgcagcagcgagagaaacatcgccggcgaaatatccagcgccacggcgcacaccacgccgccgccgacaatgcccgagagcatcgccaggaaggtcagcatcggcagcgacaccagcagcgccatcacgcgtggcagcaccaacagctccatcgggtccaggcccagggtgcggatggcgtcgatttcttcgttggccttcattgagccgatttgtgcggtaaaggcactggcggtgcggccggcgatcaggatcgcggtgagcaatacgccgaattcacgtaggaaagagaacgccaccaggtccacggtaaaaatggtcgcgccgaaactcttgagcaccgtggcgccgagaaacgctaccacggcgccgaccaggaaggtcagcagcgccacgatgggcgcagcgtcgaggccggtttgttcgatatgcgcgaccatcggcgtgaggcgccagcgcttggggcggaaaatgccacgggcgaaggtttcgaggatcaggccaataaaaccgagcagcttcttgctgtcctgccaaaccgtgtccaccgcgcggccgatacgcgcgagcacctgaatgcctgcggcttcttccggcgctttgtccggcacacaaaagtcattcagggagcggtagacggtcttgagcagcgcgcggtcggcggcggacaggctgcaatcggtctgctcggcggattgctcgatgcgctccgggcccagcagctcaaccagcagcgaagcaccggccgtgtccagggcgccgaggccgttgaggtcgatgcgggcgccggcgtcgtactggccgtcgagcctgtccgacagctttttaaggtttgcgtagtgggcaagcgtccagtcgcccgtaatcctcagtaacgggggaacggaagaggtatcgaggtgggcagcgccggccgtagtacgggtggtcataagctccgagcttgtttgtctatccagaattcctacgtaatagcacgatacggcctactttggcgtgtccgtttgtgctgtgtcagtgactttgaagcgcagcacaccgatgacctggccgtcttccgtcagcacccgtacttgccagcggcctaccgcatcggccgggaagttctgcttgtgggtccaggcgcggtagccttccttgcgtccgccgtggatatccagggcgatgcggtcgacttctttgccgttgaatttccacacgtggtaaatccgttcatccagcccgcgcggcgcgttgatcgcggtgtaggcgtacagcccgccgctgcgcagttgggcggcagtgacttccttgaggtcgtcgcccggcgtgcggtcttgcaactgggtgctgatcgccacttcggtcatccacaacgtggcgggcggcacccaactgcgcaggaaccagccggcgcagccaatcgcggcggtcacccccagcaacatcgcccagcccttgatgctgcgcagcggcaggctcaccgccaggctcgggatcgacagcgccatggccacgccgagggccagtttgtaactctcggcggtggtcaggtgcaggatgatcggcagcgcagtgagcagcgcggcaaacaaggtcagggtgtgcagcgccaggaacagcgagcgtttcggcgccagccacttgtagtacagcgggtcggtgatcgacaccagcgccgcggcgccgagcaagccggtgaacaccgattggccgctgttccaggcggtggtgacaaaaaagaacggcaacacaaagaacagactttcctggtggatcatctgggtggcgtagcgcagcagcggttcggggatttcgcgtttgaagactttggtgaatagccgggtaaagctgttttccagcatcagccacagccagctcaccagcatgatcaccgcgatccagctggccatgccttgctggcgatccaccaggatgaagctgcacacacccgaaataaaaccgccgagcgcgatcaccccagggtagcgcttgatcagtacgagaatgcgctggatgagaggcggcaggtttgtcatgggcggttcacagtgtgtgtaggaaaaagccgagacagaataacgtcttagccctgtgttcggtgcgtcattgcgtgatccgtttgcgataaagccgcaggccgcccaacacaatggcgatcagcccgagtaggccggcgcccagccaagtcaggctgtcgtagctcagcagcggtttttcaatgcgccaatagcccggctggtcgaacacttggcgcatggcctggttggcctgtttcaggctgacggccttgatgcgtttgaccgggtcgctgaaatggccatcggcgtaatcgccggcggcactccagtaataatccgccagcgcgctgttaccttgcacggcccaggcttggcgggcgatggcggcttgttgcaggcgggcgaaggtggccgcgtcgagcccgtccttgcgcagttgcgccttgaggtcctgcaatacctgttcggcttcgggcaggttgtctcgctcaaggtcggcattcaggctcaggaagccgacgccgccgagtacttcgcgctcgctccacgggccgtaggacaaaccgtgcttgaggcgcagttggcgatagagcgcccagtcgaggtagtccttgagcaggtcgtaggtttcatcatgctggtcgtccagcaccggctcggggaacagccagtgcagcttggcgctgtcaccgacccagccgtgaatcaggtcgcgatggctggcggcggcgtgctggatttccggcagcggcagatgctcgctcggctcgaccgggtcgagttggccataggtgcgttccaggtaagccggcagcagcttgtcgaggtcgccaacgatgatcagggtcatgttgtttggcgcgtaccagtttttgcgcatcgtctccaactgctcgcgggtcaggtggtcggcctcggcgcgttcggcgcacttgagccccagttctacggccaattggttgctggcggtgtggcccaggtcttggcggtcgagcaggcgttgcaggtgcgagtaatggccgccgtcttcgcgttcgaccacgtgtttggcggcctggatgttggcgtcggtcagctcggtgcgggtgatgatcgccagcagcaggtcgagcaccttgcgctggttttgcgcgggcgcttcgatcacaaaggtggtgtcggcgttgctggtgtaggcgttccactcgccgcccagggcttgcatgcggtcttcgaggtcgccttcaccgccgccatcgatgccgctgaacagcaagtgttcgagcaagtgcggcagttctttctcttcgcaagggaagtcgtccaggccaacgcctaccaccaggcggatggccacatgcccgcgctcggtgccgggtttgagcagcaattgcaggccgttgggcagggtgtagccctcgacttgcaggcggtcaaaggcaaaggcgtgtgcagagcccataagcaggcaggcgaataacaggcgacgcataacagcttcctggcgagtgaggtccattgttaactgacttcactcgccgtcgtacgttcagggtgaatgggtgatgtcggcaatatcttcggccgaaagtgcgccggtgtcggaggtttccagcaccacataggcgctgctgcagaacagcgagttgagacgtttcatgtcggcaatcagctccaggtgcaaggagctggtttccaggctctgtacgatcttgcgctgcaggcggctgacgtgggcgtgggccaagcggcgctcctgggcgcggaagcgacgcttctcgcgcagcagctggcgggcgctttccgggtcggcactgaggaacaccgacaggcccagacgcaggttggcaatcagctgggtatgcaggccggccaactcttccaggccgacctcggagaactggcggcgctgcgaggttttctgctgctggaccttgcgcagcatgcgctcgatcaggtcgccggccagtttcaggttgatcgacaactcaatgatctcggcccagcggcggctgtcctgttcgctgaggtcttcgcgcggcatttgcgccaggtaaagtttgatcgcgctgtagagggcttcgacgtcatcactgaggctgcgcatttcctgggtgatagcggtttgcttgccgcgcagcacttcgagcatggcggtgagcatattgtcgatcaggtcacccaggcgcagggtttcgcgggcggcattggccaaggccaggcttggagtggcgagggcggcgaggtcgaggtggcggggtttggctttgccattggtctcggcctgttccggcagcaaccaggcgcacaggcgtgccatcgggccgatggtcggcagcaggatcaggcagcggctgacgttgtagagcaggtggaaggtaatcaccatgccttgggcgctgtagtccaaaccgtccatccagccgaccagagggtcgagcactggaatgatcagcagcaagccaatcagcttgtacagcaagctgcccagcgccacttgccgaccggcggcgttctgcatgctggtgctgaggaaggccagcacgccactgccgatgttggcgccgatcaccaggccgatggccacgtgcaggccaatcactccggcgccggccagggttgcggtgagcagcacggcggccaggctggagtaggaaatcatggcgaagagtgcgccgaccaaggcatccagcaagatgtcgccggtcagcgaggcgaacagcactttcacgccttgggcatgggtaatcggcccggcggcttcgacgatcagttgcaatgccagaatgatcaggcccaggccgatcccgacgcggcccatctgccctgcccgcgtttgtttgcgcgacaggaagaagatgacgccgaggaagatcagcagtggcgacagccaggacaagtcaaacgtcagcacccgcgccatcaacgccgtaccgacgtcggcaccgagcatggtcgccagggcgggcatcaggcccatcaggccctggccaacaaacgaggtgaccagcatcgccgtggcgttactgctctgcaccatggccgtcaccaggataccggcgacaaatgccagccagcgtttggacatgttctgcccgatgacttggcgcaagttggaaccgtagacccgcaagatgccggtacggacgatgtgcgtgccccagataagaagggtcacggcggaaagcagattgagcaaggtcagcatgctcggccccccgtgtgggttagctcaaagaagagcaaataagaattgccgcgtgccgctctacgtcttgtatttaagctgtagttggcgatcgggctgcacgccagcatcgcatagctaaagtcgggtttgaaataaaactgtcatgaaatcatgaagatcgttcccgcgctctgcgtggaaatgaaccccgtgacgctctgcgtcgcatagagggcggacgcggagcgtccgtagtcgacattcccacgcgaagcacgggaacgatcaaggggctcgaaagccccttgtcagcagcgggtcaaggttattgacccggaatgtccttgcgcagtttcacaggatcctgctgtttcttctttttcgcgatggcggtgcgcatcttgatgttgaccgcttcaactgccagcgagaacgccatggcgaagtagacgtagccttttggcacgtgcacatcgaaggattcggcgatcagcaccgtacccaccaccagcaggaacgacagcgcgagcattttcagcgacgggtgcttgtcgatgaattcgctgatggtgccggcagccagcatcatcaccagtaccgccaccacgatcgccgccaccatgaccggtacgtgggagaccataccgaccgcggtgatcaccgagtcgagggagaacacgatgtcgatgatcgcgatctggatgatggtgtagatgaacttgccacccttgccgccgggctcgtcgtgggtttcgtcttcaccttccagcgcgtggtacatctcctgggagcttttccatagcaggaacaggccaccgaagaagaggatcaggtcgcgaccggaaatgccttggccgaagaccacaaacaggtcggcggtcagttgcatcacccacgtgatcgacagcagcaacaggattcgcgtgaccatggccagggccaggccgaagatccgggtgcgcgcctgcatatgcttgggcatgcggctgaccaggatcgaaatcatgataatgttatcgatgcccaggacgatctcgagggccgtcagggtgaagaaggcaatccagatttccggattggtcagccattccatgtgtattcctttgagcaaatgttaaaccgcgcaagctgcagcgccgcgcggttgggtggatacgattatagagtgctgaacagcggaaaaatccccatcagcaaagcggcgaacattatgcacaggcacaccagtactgcccacttgagggtaaaacgttggtgatcgccaaattcgataccggccagggcgaccagcaggtaggtggagggcaccagcgggctgagcaagtgtacgggctggccgacgatggacgcacgcgccatttccacggcggtgatgccgtagtggctggccgcctcggcaagtacgggcagtacgccgtagtagaacgcatcgttggacatgaagaaggtaaacggcatgctcaccagcgcggtgatcaccgccaggtaagggccgagcgcatccgggataaccgccagcaggctcttggacatggcatcgaccatgccggtgcccgagaggatgccggtgaaaatgcccgcagcgaaaatcaggccagtcaccgccagtacgctgccggcgtgggcggcgacgcggtctttctgcatttgcaggcatgggtagttgacgatcatcgcgatactgaacgccaccatgaacagcaccggcagcggcaacaggccggcgatcagggtgcacatcagggcgaaggtcaatgcgccgttgaaccagatcagcttaggacggcgggcatccgggaattgcgaaacgctgatctcgctgtggtcgatttcatccccttgcaggtgcagttcaccgaggcgcgcacgttcacgtttgccgtacatgtaggcgatcaccagaatcgccaccacgccgacggccatggccgggatcatcggtacgaaaatgtccgaggggtccacatgcaatgcactggcggcgcgggcggtcgggccgccccaaggggtcatgttcatcacaccaccggcgaggatgatcaggccggccatgatccgtgggctcataccaatgcgcttgtacagcggcagcatggcggcaacgcagatcatgtaggtggtggctccgtcaccgtcgagggacacaaccagggccaataccgcggtgcccaccgacactttcagcgggtcgcccttgaccatcttgaggatcttgcgcacggccgggtcaaacaggccggagtcgatcatcaaggcaaaatagaggatagcgaacatcagcatcacgccggtcggcgcgagcttggtgatgccctcgagcatcatcgggccgatcttcggtgcgaaaccgccgaacagcgcgaacaggataggcacgatgatcagggcgatcagcgcagacaggcgcttggtcatgatcaggaacatgaacgtgatgaccatggcaaagccaaggaaagtcagcataggaatactccaggcgtggcgcggctagggaatggcgaaccgggttggggtcagcgcagtacgaaaggcacgtagcgtacgggtggagttggagcgaagaggcaaggacgggcggacatcaggaatcaccattgttgttgttaacagccggtctgttgccggcagtggggcgatcctagacggggaagctttcagccagctttcgctgcgtaaccggatgatgagaggtttttcctctttttttgtaggataggtcagcgtgcgtgtggcgaatcagggaatttccaagccgcccgcggctttatgcagcgctctcagatgctcgccgacctgcttgaggttggcttcgcaggcggcaatctcggcggcgcgagaaggctccagcagcaccctcacctctttatccagatcgccggtcaaggattgaagctgcttctggcgttcggcgctttccgattccaggcgtttggactccgagggttgcggcaggccgtagccgccactgccgagcagttccgccgggcggctgaggaagccgctgttggcgaggatctgttgcagcgttttattggctttttccatgccgccgtttttcagctcgcgggcaccgaggtagcgttgcttgacttcgtcctgtgccagcatcagctgtctgcgatagctcgcctgttccagcagcaacagtgcggcgctggtgcgcaggtcggcctggctgaaccattggcggcgttcttctgcgctgagggacagccagtcttcgacctgggtctgtttgatcggcaagtgtttgcgcagcacatcgaacatcgcctggtagcgctcgcggaacgagtcgaagtgataacccaggcgcaatgcttcacgtttgtcgttgagtacgctggtgtcggccaggccgcgggcgctgagcacttccagcaagccgttgggggtgatgttgtccaggccggtcagttgtgggttggcgctgccactgcgtaatagcttcaggctctcgaccgcacagttgttggaaatgaagaagtagttgccgtcgtagctccagtgcatttcggcggcatgctcgacggtgtcttcgatttcctggcgcgtcagcttcagcggaacggatgccagcccgcgcagttcggtcttggtgtattcgtcgatcacctgggccagtggtaatacaaacagccgcgacgggtatttgccgaccaggccatcccagctcgacaactgcacgtcactgacgaaggcgcggtaggacagcaccaggtgttggtccaaatccagccgacaatccggcccgcgcgggcggccgggtgcacagatcaccaggcgcaacatgctgtggccccagcggctgaccagattctggttggcttcggccagcaagtagtcgatttcatacacccgctcagggtcgacctggcccagcggcgtcttggcgaaatcgttgccggcgttcaggaaggcgtaggttttggcgcaggtgtcttgctcgggcggcgcccagccgaagtgctccttgtaatagcgaaacagcgcggggcggcggcaggcgtagctcgggtcgaggagaaagtactccatgttgaccgccacgaattccagcgggctggtggtttcgtagatgtccgggctgcgggcgacctgatggttgtgctgttcacgttcgccgcgacggccgacgtattgcggccagccggcaaggtccaagaggcgcgggtcgtcacttaaggtaaagcggcggtcattctggccacggcattggtcgggcaggccgatcaggccggtgatgttgttctggcggctgcaccgttggatcagtgtgcggtcttctttggaccacaggcgcgcacggtcataaatgtgagtcagttcatgcagcacggtggcgagcatttcgcggcgcacggtgccgtgggggcggttggtcttctgggtggcggcgctgccgtcggtcaggctgtcgagcaggttttggttgaggtccagttcggacaccaaggaggcctgaccataggcattttcaggcattttgtcggtccagccgacatcaatgcgccggtccagctgctcgataaagcgcggcggcaaggcgcgcatcgcttcatcaagcaatgcctggctggcctgctgttgggccgggctcaagccatcggtcttgagccgcagttgcaggctggcctgggctgcgcctgcacaaagcagcacagtcccggccaatagccaggcgaccaggcgcctcacagagcgagaatagcttcggcgagggtctggtcactggcatcgcgggcttccggcacgcgggttcgcagcgtattgaacgctgcttccaactgcgcaccgcggatttcgccattggtggcgacgaagctggcggcgtcatcgtgggcttcgcgcacgactttggaatcgcggatggatgtggtggtgtccgaggtgaaatcaatggtgcgggccgaggcgcgaacgatgatgttactggtggccttcaacgtttgcgcgtgggcgacatcggccaacaacagcaggccgagagcggcggcgatcagcgggctacgcatggaataactccaaaacaaagatagaaaatacagatgattattggacgagaattgcttgcgccagttcaaggtcgcttgcatgaagttttggctgggtgcggcgcagataatccagcgcggattccagcctggcgccccgccattggccgtcagtggcgataaaagcggctgcgtcatcctgggcagccactaccaactttctgtcaaagggcgcagaggtcaccttgctggtggcatacgcgcttatcacagtgctctgcgtggtcacatcaaaggccgaagccattggcgaccagcaagcggaaaacaacacgggaaccattaacaggcggtatgaaaaagccatgggactcgacaactgaaagcgagcgccaaggctagcgcaatgcccgggcgagagccagcgctgacatatttggtagcggctggcgttctctacgggctagctgcttatcagatggccagaatcgcctgggccaactgtgcgtcagtggcggtgttcagttgcggtgcttgttgacggatctgagccaaggcgctttccagcttcaccccgcggatagcgccttcactggcgacaaagctggcggcatcgtcacgagctgcccgcacgactttgttgtcacgcagcgaggacgtggcatccgacgtggcatcggaagtggctttcagcgcgccgacaatcgagtcggtggtgacgatgaggctgctcgcgtgggcattggcggccacggccaacagggcggcggcactcagcaggcgaagacgggacatggaatcactcctgtagatgaacgaataaagcggcgcaaagcggccactgtgaaaccgacattgctgcgattgagcatcagacgtcggttctacaaggttcgccacgtgatgactggatcttaagctgccgtttgtccgttcggaagtctcctggcggtctaatcacgccagaacggtttggacagctcggccattcggtcgccttggctgatgccggcatcggacaattcacgcgggtcgagttgagccagttggtgccgctcgtgggtttggcgcgcccatctggctaatgcgtgggcagtgcgaaggatcagtcgtttagcgggcgaggtttgcgtgttcatggcaagcgccttccttgggtgtggagctccatgttgggcgtctccccgctaccgatacagatacaccaaagctaaattgtaccgcttaactgttgtattttattaactgtactggtcgctgcgaaccgcttctgtttgcccctgtaaaagaccaaatcccagaaacaacaaagcccgcctccggtttcccggggcgggctttgctttgacaaatcagggtgctggctgtggacccggcgggtcagggccagcgggcgccaattagcgccagaacggcttgctcagctcttcgtagcgttgagcttcgctgataccggcgtcagccagcagacgcgaatccagacgagccagttggtggcggctggagatgcggcgctgccacaacatcaggttggcgagaacgcgcaaaggcagggaagcctgggtgtttacagctttttcttcgaagaacagatcggaactgagtgtacgttccatgatgacatccttccgcttgtggcgggattaggtagtggtttaactgatgccaatgatcctcctccgacgcaagactctctagatacagttcacctgtattgtgaggggccagttaactgtttatagcggctgtactgtacggaaatggggcaactgtacctgtctgcactgaaacagggcgaaataggcaaattcgcagatggttgtgggatatttcagtaggaaatcaccggtacagcagtacagttttttacggaaatgccattggcactgccgggctgatgcaactgtgtttgcatcagcccgaatctgtatcaatcaagccttgagcatatgcccggtttcttccaggttaatgtgccaactcagtgcttcgcgcaggatatgcggggtgtgcccgccgatggcgcaggcagcgttgaagtaactgttcagggcgtcgcggtacgccgggtgtacacagttgtcgatgatcacccgggctcgttcccgtggcgccaggccgcgcaggtcggcaaggcccacttcggtcaccaggatgtcgacgtcgtgctctgtgtggtccacatggctgaccatcggcactacgctggaaatcgcgccgcctttggcaatcgacttggtaacaaagatcgccaggtgcgcgttgcgcgcgaaatcccctgagccgccaatgccgttcatcatccgcgtgccgcagacgtgggtggagttgacgttgccgtagatgtcgaattccagcgcggtattgatgccgataatgcccaggcgccgcaccacttcagggtggttggagatttcctgcgggcgcagtaccagcttgtccttgtagtgttccaaattgccgaacacgtcggcattgcgccgttcagacaaggtaatcgagctgcccgaggcgaagctcagcttgcccgcgtcgatcaggtcgaacgtcgaatcctgcaacacttccgaatacatggtcaggtcttcgaacggcgattcgatcagtccacacatcaccgcgttggcgatgttgccgataccggcctgcagcgggccgagtttgttggtcatgcgcccggcgtccacttcctgcttgaggaagttgatcaggtggttggcgatgccttgggtgtcggcgtccggtggcgtcacggtcgaggcggaatcggcctggttggtgaccacgatggcgacgatcttttccggcgggatcggaatggcggtgctgccaatgcggtcgtcgacttttaccagcgggatcggtgtgcgagtcggccggtaggtcgggatatagatgtcgtgcagcccttccaggttagggttgtgcgcgaggttgatctcgacgatcacttgcttggcaaaaatcgcaaagctggccgagttgcccactgaggtggtcggcacgatatggccttgctcggtgattgcgacggcttcgattaccgcaatgtccggcagcttgagctggttgttgcgcagttgctcaacggtttccgacagatgctggtcgataaacatcacttcgccggcgttgattgccttgcgcagggtgctgtccacttggaagggcatgcggcgggacagcacgccggcttcggtcagttgcttgtccaggtcattgcccaggctggcgcctgtcatcagggtgattttcagcggggatgtcttggcgcgttcggccagggcgtgtgggacggccttggcttcaccggcgcgggtgaagccgctcatgccgacggtcatgccgtcctcgatcagtgctgcggcatctgccgcgctcatgaccttgttcaacaacgaaggcaagcggatacgatcacggtacatggattgttatctcgggctacggaagcaaggtgggcagtttagtgatttcaaaaaatttcggcccgctaccatggtcgaatgccgggtagcgatttagagcctttggtcgggtttcaggcgtgtgcagagcgggacgcagagcatcccgggatgctttcccacgcagagcatgggaacgatcataaaaaaaccccagcctacgggaggccagggtttagggtattgcgctggcgcagttttattcgacggctttgaccatatcttcgatgaccttcttggcatcaccgaagaccatcatggtcttgtccaggtagaacaattcgttgtccaggcccgcatagccgctggccatcgagcgcttgttgacgatgatggtcttggctttgaatgcctccaggatcggcatgccggcaatcggcgagttcgggtcgttcttggcggccgggttgaccacgtcgttcgcgcccaacaccagcaccacgtcggcctggccgaactctgagttgatgtcctccatctcgaacacctggtcgtaaggcacttcggcctctgccagcagcacgttcatgtggcctggcatgcgccccgctaccggatggatcgcatacttcacggttacgccacggtgggtcagcttttcggtcagctctttaagcgcatgttgcgcgcgcgccactgccaagccatagcccggcacgatgatcacggtgtcggcgttggtcagcaggaaggtggcatcgtcggcagagccagacttcaccgggcgtgcttctttagaaccggccgggccggctgcgtccgccgtgttaccgaaaccgccgagcagcacattaaagaaggaacggttcatcgctttgcacatgatgtacgagaggatcgcaccgctggagcccaccagtgagccggcgatgatcagcatcgagttgttcagcgagaagccgatgcctgctgctgcccagccggaatagctgttgagcatcgacacgacgaccggcatgtcggcgccgccgatcgggatgatgatcagcacgccaagcacgaacgccagggccagcatcaatgcgaaggcgctgaggttgccggtgaacatgaacgtcaggcccagacctagagtcagcaggcctaataccaggttcagtttgtgctggccaccgaactgtaccggtgcgccctggaacaggcggaacttgtacttgcctgacagcttgccgaaggcaatcaccgaaccggagaaggtaatagcaccaatggcggcgccgaggaacagctccaaacggttgccggcggggatcgagtcgcccaggtgtttgacgatgcccagcgattgcggctcgaccacagcggcgatggcaataaatactgcagccaggccgatcatgctgtgcatgaacgccaccagctcgggcattttggtcatttccacgcgcttggccatgatcgagccggcagtaccgccgatcagcaggccgacgattacgtagccaataccagcagtcgcaagctcagcgccgagcttatagatgaggcccacggtggtcagcaccgccagcgccatgccgagcatgccgaacaggttgccgcgtcgcgatgtcgttgggtgcgacaggcctttgagggcctggataaagcagatcgacgcgatcaggtagagcgtcgtaaccagattcatgctcatgacgatggcgcctcttcttttactttcggggctttcttcttgaacatctcgagcatcctgcgcgtgaccaggaagccaccgaacacgttgactgcggcgagcgctacagccagtgtgcccatggttttacccagcggtgtaacggtgagcgctgcggcgagcatggcgccgacgatcacaattgcggagatcgcgttggtcactgccatcaacggcgtgtgcagcgcgggggttacgttccagaccacgtggtaaccgacataaatcgccagcacaaagatgatcaggttgtagataccgggggagataagctcttccatcgtctgaatccctgcttaggcgtttttgcggatgacttggccgtcgcggcacatcaggcacgcggcgacgatgtcgtcttcgaggttgatttcaaactgcccttccttggtgaagaccagcttcaggaagtccagcaggttgcgcgcatataaagccgaagcatcggcggctacggcgccggccaggttggtcgggccacagatggtcacgccgttttccaccacgacttggtcggcgacagtcagcgggcagttgccaccttgagcggcggcgaggtcaatgaccaccgagcctggtttcatttgtgcgacggtctcggcactgagcagagtcggcgccttgcggcccgggatcagcgcggtggtgatgacgatgtcggcttgcttggcgcgttcgtgtacggccagggcctggcgctgcatccagcttgaaggcatagggcgagcgtaaccgccgacaccgacggcgcattcgcgctcttcatcggtttcgtagggcacatcgacgaacttggcaccgagggattcgatctgctccttaacggcagggcgcacgtcagacgcttcgatcactgcacccaggcgtttcgccgtggcgatggcctgcaagccggcaacgcctgcaccgagaatcagcacgcgggcggcttttacagtgccggcagcggtcatcagcatcggcatgaagcgcgggtagtgatgagccgccagcaacacggctttgtaacccgcgatgttggcctgcgacgacagtacgtcgaggctttgggcccgtgaagtgcgcggcgccgcttcgagcgcgaaggcagtgatgccacgctcggccagcttggcaatggtttcgttgctgaacggattgagcatgcccaccaacacggtgccgctgttgatcagcgccagttcgctgtcgctgggggcaaccaccttgagaatcagctctgcaccaaacgcatcgctggcgctgccaatggttgcgcctgccgtttcataggcactgtcgacgacgctggcgttaataccggcgccactttgaacagtgaccttatggccctggccgatcagcttcttgatggtttccggggtggcagccacccgcgtttcaccggtctgggtttcgagaggaacaccaatgtgcacgtcaaatctcctgcatgatctttttgcttttgatctttttgtaaaaaggccagtgcaccgtgagtggcgcagctggggcggccgatcagcacgatcccgctgaaatgacagcggggcgcggcattttgcaggcgaactttacggccttcaagggattatgacgggtgacgaaaaattaactacaagtcaccctgtgactgattgtcgcaatacactcaaataacctctttaaatacaggtgtttaaagggttgcgggcggttttcgtactatttccaatcgtcggtgtgaatagtcggctattggccggccattgtcgctacaagccctatgaatcatggctttaagccttattttatgtggatgggtacagtctgcttaaatgcgacatatccgtacatctgtaggtttaatatttaattgactacaaagtcagcaagtggggtttggcctttaaatacttgggttgtagcgctgtgactggtcaatcaaccaatcccgaaatgcgtgcagtgaggcagattcgacttttcgttcgggaatcatcaggtaataagcctttgagctactgagtgcttcggggctcgcgattaaaagtcggcgctcctccagctcgcgctggatgaggaatggtggaatgagcgcaacccccatgtcatgcatggcggcctgggacaacatcgagaatagctcgtaacgagggcctgtcatgtcgcggggtatgttcagttgttgcgcgttgaaccattggcgccaggcgtaaggccgggtggtttgctgcagcagcggtagttccgcgatttcctgggggctgaagtaggtgcggttgcccagtaaccgtgggctgcacaccgggaccgggtcttctcccatcagccgatgggattcggtgccggaccagtcagcatcgccaaagtagattgccgcatcgaaatcggtatcggcgaacagaaaggggcgcgtgcggttggtgaggttgacggtcacttccggatgttggcgttggaaatctttgaggcgcgggatcagccattgggtgccgaaggttggcaccacggcgagctcgatgacgttagcaccctgctgccccataactgacagggtgtcgcgctccactgcgtccagttgcatggcgacgcgacggctataggacagccctgcttcggtcagttttaccccgcgtcgggagcgccgaaacagctcgacacttaaaaactcctcaaggctggcgatctgtcgacagatggcgccctgggtgatggaaagctcatgtgcggccttggtaaagctctcgtggcgggctgcggcttcaaaactgaccagggcggtcgtgctgggaatttttctgcgcatgtacgttgtactcacttataaagcgcatctgcgcccttctcagtcatttcgaagtgagaaattagcacaaccctatgcgtaaacctcgtttgccctctgctcatgcccggcctaggctgcatccacgacttctgatttttcccgcgaggacttattcatggctggcaaggcaagcttcaactggatcgatccactgctgctggatcaacagctcaccgaagaagagcgcatggtgcgcgacagtgctgagcaattcgctcgggacaagctggcgccgcgtgtacttgaagccttccgccatgaaaagactgaccctgcaatcttccgcgagatgggtgaaaccgggctgctgggcgcgatgatccctgagcagtacggtggcagtggtttgaactacgtcagctatgggctgatcgcccgtgaggtcgagcgtgtcgactccggctatcgctcgatgatgagtgtgcagtcatcactggtcatggtgtctatcaatgaatttggcaccgaagcgcaaaagcagaagtacctgccaaagctcgcttctggcgaatggatcggctgcttcggcctgacggagcccaatcacggctcggacccgggcgcgatgattacgcgagcacgtaaggtggagggtggctacagcctgactggggccaagatgtggatcaccaatagcccgatcgcggatgtgtttgttgtttggggcaaggacgatgcgggcgacatccgtggctttgtcctggagaaaggctggaaaggcctgagtgcgccggcgattcatggcaaggtcggcctgcgggcgtccatcaccggtgaaatcgttatggataacgtgttcgttccggaagaaaacatcttcccggatgtgcgtgggttgaaagggcccttcacctgccttaactcagcgcggtatggcatctcctggggggcgctgggtgctgcggagttctgctggcacaccgctcgccagtacacgctggatcgtcatcagttcgggcgtccattggcagccacgcagctgatccagaagaaacttgccgatatgcagaccgagatcacgatggcattgcaaggctgcctgcgcttggggcgtatgaaagatgaaggcaccgcggcggttgagattacttcgatcatgaagcgcaattcgtgcggcaagtccctggatattgcacgtatggcgcgggacatgctcggtggcaacggtatttccgatgagttcggggtggcgcgccacttggtcaatctggaggtggttaacacctatgaagggactcatgacgtgcacgccttgattcttgggcgcgcgcaaaccggtcttcaggcgttctattaataggagcacggcatgggcgcgctttcacatctgcgggtactggacttatccagagtgctggcgggcccttggtccgggcagatcctggcggaccttggggctgaggtgatcaaggttgaacggccaggtaatggcgatgacacgcgtgcgtgggggccgccgttccttaaggacgcgtatggcgagaacaccagtgaagcggcgtattacctgtcggccaaccgtaataaggagtcggtgaccatcgacttcacgcgaccagagggtcagaagctggtgcgtgacctagcggcgaagtccgacatcctgatcgagaacttcaaggtgggcggtcttgcggcgtatgggctggactatgagtcgctgaaggagatcaatccggagttgatctactgctcgatcacgggctttggccagacggggccttatgcgacgcgcgcgggctatgactttatgatccagggcttgggcggtctgatgagcctgaccggtcggccagaaggtgatgacggggccgggccggtcaaggttggtgtggcgctgacggacatccttacgggtctgtactcgaccgtggcgatcctggctgcgctggctcaccgggaccatgacggtggcgggcagcatattgatatggcgctgctggatgtgcaggtagcgtgcctggctaatcaggcgatgaattacctgacgacgggtgtggcgccaaagcgcctgggtaatgctcacccgaatattgtgccttaccaggatttccctactgccgatggcgacttcatcctgactgtgggcaatgacgggcagtttcgtaagttcgccgaggtggctgggcaaccgcagtgggcggatgatccgcgctttgcgactaataaggtgcgggtggctaaccgtgcgcagttgattccgctgattcgccaggccacggttttcaagacgacggctgagtgggtgtcgcaactggagcgagtgggtgtgccttgcgggcctattaatgacctggcgcaggtgtttgccgacccgcaagtcaaggcgcgtgggttggcgatggcgctgcctcatgcgttggcggggatggtgcctcaggtggccagccccatacggctgtccaagacgcctgtggaataccgtagtgcgcctcctctattaggtgaacacacagtacaggtgctgcagagtgtgctggggttgggggcggcgaacctggcggcattaaaggaagcgggcgttatttgagcctgcccttctatatagtcagtgtgcaggcgcgttatagattgttttttaatcaatcttaactaattgatagaaaagcaaaattaagggttgacggcagaatcaggaagtctataattcgccccacttccggcgcagtcgaaacggaaaactccttggtaaacaaagagttacgcagaattcggcagcgagttgcttcagttcatcgaagcccagaaggagttggtagagcggtgttgtttggctctattaacgtttcgatcttctcggtcgaaagcggagaaaaagaggtgttgacagcagcgtgtaacgctgtagaattcgcctcccgctaacgagagatcggaagcgcaagtggttgaagttgttgaagaaatcttcgaaaacttctgaaaataatcacttgacagcaaatgaggctgctgtagaatgcgcgcctcggttgagacgaaagatcttaaccaaccgctctttaacaactgaatcaagcaattcgtgtgggtgcttgtggagtcagactgatagtcaacaagattatcagcatcacaagttactccgcgagaaatcaaagatgtaaccaacgattgctgagccaagtttagggtttcttaaaaacccaaagatgtttgaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtaattgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcgacgacatcagctgctccataagttcccacacgaattgcttgattcattgaagaagacgata

SEQ ID NO: 25 - DNA, 311569 bp, Pseudomonas poae FL10F
cgttcaactgttcgggctcaatgaccagagtggagaggtgagtggcagcatgggctcccacacgtgctttaagcaccccgggcattcagcttgccactcaccgctctcaacctcagtttaaacctggctcaagacacaagcgggcttgctcgcgaatacggtgggtcagtgacacatgagctggctgatacaccgccttcgcgagcaagcccgctcccacaattagaccgagttcggccgccagaccactgtgctctgcttttgtgtgggagctggcttgcctgcgatgcaggcacctcggtgtatcaggcagaaccagtcgatgccatcgcaggcaagccagctcccacatttgattgagtacagtttcaatgaaaaggtcggctgccaggccgcctctgccttgcttttgatccaaccactcaggtcggctactaggccgccgcgctcttgcttttgatcttgcttttgattttgatcttaggcgccccatcaaccacgctggccgaacgcaggctttggagcgggggtaaaccggcaggacgccggtttagccgcgctgggccaaggatggcccatcgcggcggcccccgctccaaagccggagtgagggcacaccgagcctaggcgaggtgccgagtggtggggcaagagcccttttggttacttttggggctcttttccaaaagtgacccgccgtaagggcggaacccatatccgccaccccccaaataacggatatacaccccgttagccctagccaccacgccaacgcgcgccctacactgacccgccacgtgtttttcaaaggatgaaacacaatgcacacacctgacccccaaatcgtcatccagcgcttcaccgaggcccacgttgaaggcgtcgctgcgctctataacgacccggccgtatgccgtcaggtgctgcaaatgcctttccagtccgtgcaggcctggcgcaacaagctggagctggataacgagcggcgcctacagctggtagccgtgcacgccggtgaagtaatcggccagcttggcctggaacaaaccctgcgtgtacgccgcagccatgtcggctcgttcggcatgggcgtggcgaccgcctggcaaggcaaaggcgtaggttccaaactgttgaccgccgcgttggacgtggccgacaactggatgaacctgcgccgcgtcgaactcacggtgtacgccgacaacgaagccgcgcacaacctctaccgcaagttcggcttcgaagtcgaaggccggatgcgcgattacgccctgcgtgacggcgtattcgtcgacaccctgagcatggcccgcctgcgccagtcggcttaatccgccagcgcaaacgccaccgcagcctgcgcatgcagctcggtggtgtccagcagcggcaagtcgctgtgctccggcttgatcagcaggccgatttccgtacagcccaagatgatggcctcggcgccacgcgcggccagtgacgcgatcacccgctgataaacctcgcgtgatgcatcgctgatcacaccgacacacaactcctcatagataatccggtgcacggcctggcgctcgtctgcgtcgggcaccagcacgttcaagccttgggcagccaggcgcgacttgagaaagtcctgttccatggtaaatgccgtgcccagcaaaccaaccgtcagcgtgccggcttttacggcggcagcacccgccgcatcggcgatatgcagaaagggtatcgacaccgccgcctcgatacgcggtgccaccaaatgcatggtgttggtacacagcaccacacagtcggccccgccagcctgcaagcggcgtgcggcatcctcgagaatcagcgcggcgtcatcccagcgcccggcatgctgggcctgttccaccgggccgaagtccacgctgtacatcaacagctgcgccgagcgcagtgggcccaactggtcgcgcacgcgctggttgatgatgcggtaatactcagcgctggactcccagctcatgccgccgataaggccgatggtgcgcatgcgatgctcctgacaaggaatgtcgcctcaccttacccatcggccgccgtttagtcatacgcagttgcctgcagaatcaccggtgcagtttcatctctgaacgcgcgcgctgttgcgcaggcgttaatcatacggccaaccgccgcatctgccatgatcactgttcgcaacctggctcacccaaggaattttgcaatggacgatgtacagcaactgggcgagatgcttcgtcattacgccgacagcgaagcgcacaaaaaacagcaattcgacctgcagtcggcgcgctgggcgcaaaagctcggcgagctgttcgggcagatcgagcagtggctggaaccggtcaagaccgttggtttactggaagtccagcgtgaagcctatgtggccagcggcccgagcctgccggttgaggcgtcgagcttcaagaccgagaagctgacggtgcagatcaccggcaagaccgtggagttcgtgccggaagtcatgggcgccggcggcgcaattgccgtgtcggtgatgggcctgaccgccgcgcggcacggcagtgtgtcgctggtgctgccggcggataaaaacgactggctgtggaagaaaaccaacggcctgaaagacccggacacctacgccttcgacgccaacttcctggccacgcagttacagagcctgattccgcgcgaacgcggctgagcaaattaacgcggcgttggctatacctaaggctcgatggttcgatgatgccccccagggagttcaatgatgaaaccaaggctaatggtcagcgcgctatgcatcgcgtcaatcacactggcaggctgtgccagtaaagtcccgcagccggacgagtactccggctttttgtcggactacagccaactcaaggaagccaagtcaccttcgggggccgaggtgatgcgttgggtcgatcccgacttggacctgagccgctacaccgcggcgtttatcgaaccgacccagttctatcccaagccccaggccaccgcgaaaatacccgacagcaccctgaacggcatcaacagttactacaaccaggcgctcaagcgtgaactggccaagtcgctgccgattgccaacgcacccgggccgggtgtggtcgtggtgcgcgcagccattacggcggtcagcagcaagaccgaaagcctcaagccttacgaatatgtgcctgtggcgctggtcgcggcggcagtcagtaccggcaccggcattcgtgaccaggaaacgaccttgggcaccgaagcgcagttcctcgacggtgccagtggcaaggtgattgcccaggtggtgcgcaaaggcaccggtaagccgctgtccaacgacgcgcaggtgatgagggccgatgacgtcaaaggcgttatcgatggctgggcctcggacctgcatcagtcctacgtgaagctgaaaaaacactaagggctaaaacgcattccttgccggccggttgtagtagctgagcagggcgtcgtagcggcgggtgacgaggtagtaatcgtcactcagttgctgcggcggcgcgtgttcgagccagtcttgaagcatgctttgcaaggccttgaggtaatcatcggcgggagctctgagggtgtaccagaggtgcagggtttcgtcggtcagatctttatccgggatgcgttccacaaacgcggcactgcgctcattggcgcgctgtaccgcagcggtcaatgccgccagggccttgggggtgaggctggcgtcgcgtacgccgctgtcaatctgctcgactgcccggcgcgcggtaatcatgtaatcgagcaactgccagggcaggtcctgacccaggcgcgcttccagcaagtcccgctgtgcagggcgcaggcgttgctcttcgagcgccagtgcgttgcgcaattgggtggagagggcgatgtaggctgcgccatttctgctcagttcttcctcgtagcgttgccgcattacctcgccgaacacccgcagtcgagacgaagcgctcaacgtcgaggtgattttttccaggctcgacaggtactcggcggtcatgccgatcaaggggctatcaggttgctgatgctcaagtttggcggtgatggtcggcgcacatacgtctttcaggatcagccgtgcctgcggctcgttattgtcgccaaactcttcgcgtacgcgcgcatagcggcccaccggcaacgacgtttgcacttcaggttcggcatcggcctgtggcgggtgagcggcgcgctggtaggtcagccgtgtgtcacggtcgacgcggttcatgcaatcgatgatcggcgccaacgcactggcagtggccgtttgcgggctgtcgagctggtcgacccataactcgatcacctgaatgtgtttgccggcgccggccaggccgaacaccatcaacataaaaaccacaccaatcggcaataacagtcccggattcattgcgtggcctcctggccgtaccattgcgcgtgtgtggccggggcctggcaggcctcggcgtttcgcggcatgcggctgcacacgcgctcggtccattgttgcaaaccctggttgcgactgacctgatgacggctgtcgaggtatttgagcgcgccgaacaccagcgcaaaagcaatcgcgcccaggccgatggcacccatggccttgcgtggaaaaatcgccgcccattccttcacgctcaggcgtgcacggcgtttgcccgcaccgactgccgccaataccgccaccagcgtcaggccggcggcggggccgaactgcaggctgatggcgatgctcatggcggcacccgggatcaggtcgcgcaccggcaacagcggcagacgagtagggctcaaccagcgcggcagttttgccgccaggcgttcatccagcacgcgcagccgatgtgccagcgggcgccacacctgccaggccagcgcgccaccggccatataagcaattgaccacgcgaacgcgtcaccggcggtgctcaccaatacgcccgcctgccagggcgcctggaacaaggcaccggccaggcagcccactacaatcgccaacagcagcggcagggtgtcgaaggcggtttcccagtcttgccaaaaatacggtgtgcctcccggcatggcgaatgccacctcgggatggtcagctttcagggttgcggccaaggttcggcaggcgtcccagtctggctcactcaagcgctgggcaaaggcgcggcgttggcccagggacatcggcgccagcaataaccgcgcggcgcgctgttgtggggtgtccggcgccgtggccgccaacgcacgctgatgggccatgaacaccgggccttgctggcgccgtaacaaatgctgccattcgtcttcagggcacccgtgctcgctgccatgccagccctggccggcgcgcacggcttcaaacaccgcaggcgaccagaaatggctttcggtcagcatcgtcgccaacatctggttaaaccactgggtatgtgccggctgcttgagccacggctgatcaaagcgcgccgcataggccgcgagaaaccccgcttcgtcccgctgggccatggccagcgccaatgaatattggagtgctttcttgcagcggttggccagggcgtcgatcaagtcttgcggcaattccaggcgttgccaggcgctgagccactggaacgtctcgaacgcccagcggcgatcttcttcgctgacctcgtcgtcagcgatacagcgcttgagcagcgccacttcgaattccaacccaagccctgcggccatcgcctgctggtagtgcgcctgcaaggtatcggcggcgaccggcgccacgaccgttgacgccacaacctcggtcacggtggccgtgtcctgctcttgcgcccattgctgccaattcaacgcttcttcgtaggcttcacgcagccgctggaacccctcggggtcatcatccggtcgggttttcttcaacaacgtcgcgtattggcgcttgatcgtacggccatcggcatccgagggcaggccgaggacatcccagcaagtcatgtgcggtacaactccataaaatcaccgcgcgcaccttactcgttttattggccgataaaccagcataagtcagcgaaggcagtgcccgaccgaatcctgttgcggccgggcgcctggtattacttgagaggcgtcaacggcggcagtttccattggcccacttcaggtttgggcaggtagatccgcagtacggcgtaaaacggaccgggcggggctggcagccagttgctctgttcggctttcggcggctcatggtgctgcaatgccagggtcaggccgccgtcggcgtccagcttgagattgggcagcatctgcgaattgatctggtagcgttttttcaggttgggtgccagaagtttggtcttggcgtcgtacatggtcagcgaccagaacgcctcggcaggcggcaactggtccttggcaaagtgcacggtatagctgtggcgcgcaccattggcgggtttgccttcactgtcgacgcggtagctcaggtagacggcttcatcgggggagttgccgaaaatgcccaggtcagcacccgcgtagcggtaaaggtagttgtttttgaggcggtcacggctgccaaacagctcgccgctggacacttggtgagtgtcgatcttgtctttcttgaaggcggcaaactcagccctggcgtcggcaatcccgtcttccagggctttgcgttgttcagcggtcaacgctttaagcttgaacggcgctcccggggcgatgccgatcttggcaaagcgcgcgagcaggtctttttcgctgtcttgcggcgcggcgaaggacaacatgaagttcaagtaccggaacagctgcgggccttcagtcatggtggccatcggcttgggccagacgattttcggcaccggggccggagcgggctgttttacatagctgctcagcggctggactttgtaaccggcctggatctgcttgaccttgttcaggtccttttcatcaaacagctgcgtgcggtacagggcgtaggcgatattgctttcgctgtagaccacgcggtcgatgtcgaccggctgctgacctttccagtcggggccggcgatcatgtagtggccgccgttgttgccagtgctgcgcgtgcccaaatacgccatgttctgcgtgtagaggtcgatcaactgcaccgagtagtaacggttgtcttcgattttcggcagggtcagcaccaacggctctttgcgcaggtccatccacacgaaggagtagggcgtgtccgagttcggggtgacgaacgccgtgtccttgggggtgaacacctgggcggtattgccgatatggttgaacggagccttgaagttggcaccgcccttgtcgacggcctgggtgtagagcgtcttgtacatcgccacaaccgggtagccgtacaggtaggcttccttggcaatggcccgggcttcggcagggggtgccgtgaagtcagccaaggcgccggtactcatgagtatcgagaggctcgccaacagcaggcgcgtcggttttccaatcatgttgttgcgtccttccagagttcttttagagggcggggagatcaaagcgccgagtttccagttttatttgccggacgtcacgttaatccctgcaaacaacgtgaacggcggcagaccgccacccttgcacgccaacgtccactgcggttcgaggtagtgaggtaatcggtgcggggcggtttcacaaaggttatggggtatgccgtttgaaactagcagctatattcatccgcgccagccattcgactgaagagcgttcagctgcgggagtaacaactcatgttgcacccagtgcgaggggctgacataccgctccagcggagcggcagcaaaggctgggagacgatcaggccgaaagcatggctttgactttgtcgcgcaattgatcgatggagaacggcttgccgattacctgcatgccagctggcacatcgatgttttcggcatagccgctggcaaacagaatcggcagggaagggcgcaactcacgcaccttggttgccagctgtttaccgtccatatcgggcaggcccacgtcggtcatcatcaggtcgatgaccaggccggtattttcgacgatcttcagcgcctcttcagcatctgcagcttcaaccaccgtgaactccagttcttcgagtacatcgacgatcagcatgcgcacgatggcgtcgtcttcgactacaaggatggtggagggagtggcaggcataatgaaaattcccgagaaatggaggggcaggtctttagcggttgaaagactattctctaatgagtcgtgtcaatctcggcaagttccgttggatgaggcattgtgaagcgaatggccgcaaaagtcgcgtgcaagaacatgcgtagcttcggcgcgccagcgcgtcaatggctgacgatttctgacagccattgacgcacgcgactcgaacgagggctagagcgtggtgttgaacagggcgtatggattgttgtaaggcaccgtcattataaaatcaccgtcactgaaggtgctgactttatagttggggaccccgccggtgagggaaatcgggtcaagtgtaccggcggactttccactgttcagagtggcctccaagcctcggcgcattgaagcggcgtccggaaaggtcgcgaacccaaagtttggatcaaagaaaaaaaactccctgggatttttgtggaagtcgacccccgcgagcagcccatgattttgggtgctgatctttatcattgtggtgttcgttgcagtctccaggcggttgataacgccggtgtagggttccagggaagtgcgttgaatgccgtgaaactcatcgcgaagaacctgatgcatgctattgagttctttacgaaatgctttgatgggagaggtctcaacatccgaggccgccttgatgaagttgctgatgaactcatccctgcggccatgttgaatcgccagcgccatcgtgttcaccaacgcggcacattcgccatttgaagcaaggtcggtttggctaaggtagaaattttgcggcatgggcgtggctttccccccccgcggcaacgacttctgcctggaaaactttgaaactctcaagactgttcctcaccatgcgtttttcaatttccctggccaaggtgcccaccgcttcgggattgccaaccttggtgacggccaaatcttttatttccgacaccttcattgtcgggtggtagccagggatatcctcgacatcccccaatttaaccccttggttgtaagcctcaatatcgcttttctttgcagcgtccaaggcgtctctaaacgcatcgggggaggccttggggcttggcgcaacatatttgcccaaccagtcaagaagattactgtttatttgcccattggcggcaacaacgtccggcttgaaatctgcccccacggcgccaaagcgctcttgcctgatcgggtcatagccacaccatttgccttcgtggaacacggcactgccttgaacggtctgctcgccgactttgaaggtaccaacggctacaacctcatgggttttactggctgccttcaagccgtcgtagctaccggtgagacccttgagcgtattgacggcgtcggtacctttggacaatagaaaccggccgccgctgcctaaaagcctgacgccgcctgtggccaagtcgcccaaaccgctcacagggttgagtgcgccgattgtggcggcaccgataacttttgccgccttgactgctttggcactgctcgaaagcgcagaactgccgatcttgatcagctttcctgccgtcgcggcgccagcggtgagaaaaccgaatatatccagggtgagatcaaatgcggcctcgccgtagttgcccttctgaaaattgacaatggccgaccggaacggaaccaggttgagcaggaagtcgctcagtggtttaggcccgcctcgtaatttgtccagggtggtctgcccgcgtgcttgttccttgatactcggatcatcaaggtcaaggtgctgaacaaatgcatcggcaatcgcccgggagcggtcgctggtgaaactattgaagggggcgtcattcaccgggcgttcacgcgccagttcggccgcgttacgaggcttgaacggagtgattgttgaaacatatttgcctgcccgggtgtttctggcttccacgctgtagggagacatcgattcaattgtttctttgttcatgtccattttgtaagcatgggactcgccatccagctcaatgttgaacaacagccacggcttgttcgtgtcataggtattgtgaaaaacccctgtcagttcgtatgagccttcttgcaatacgctgattttgccgtactcgaatattttttggtcctcgggtgaaagctgcgagagcatgtgccggatcgtcgtattcacggcggcctttttctcgtccatgacgcttttaaactgttggtcgaacgcctccgttacgccaaacctggggttggcgttcaatgcctctaatgggaagttcgggtcagtcgacttgaagggcctgggattcggcaaatccatcatggccacatccagcagcgaatgcaggccacccagccccagttgatccgccgtcccccggtactgatcagtccccagcactttttcttcgagaaagttgccgaaaattgcccccttctcggcgattttgccccgtgcgacgccctctcgcgtcggtatctctttgtccagggctttggaggcagtgagccgctcgccaagttgttggttgaaggcggttctgactttatcgagctgctcgggggtgtaggtgtcactggcactttttacgatttcgccgttgatcaccccccactccaccagcgcgttgatttgtgcgtattcggtggcctgtgaccggccctcaagggtgcttgcatgggccatgacttcggcgaacgtcatggtggcgactgcccctggccgctcagcctctacagccgctgccgcaatcgacagattgacccatgccacgctgccaatcgtcacactcttgggaatgtctttgatcaggtactgcggggctaccctgcccaggaggaggtgagtggccagtttagcggtgtctgctgtggctcggccggtctcgacaaggtaaccgctgaggcacttaacaacggtcgagggggattgctttgcatgcgtaggatcgttcagcgcccagcctgcaatgtggtcgcgttgaggaagccaagccgattcccggtccagccctagctgaagggcgctcaatacataatcgtaaacgctggtacttgaggacacgccattgaggtgcgcttgcagggcttgccccagcgcctgagctttgggtgagtcgagcagtttttgcagggccagggcggggtcttgcaggtcggcagacgtcaccgaactgccactcaacaagtaattgagtacaccattttcatatttcggcaacggcaagccaggtagagcgttgggggtcttgaacagaaattcgagaatgccctgctgatcggcctgtgacatcggaatgggccatgaaagcccgccgcccatattccccaggggagacactgcgcctttttgctccaacttgtgtgccagggccgtgacttcagcagccgtacgcggcagttcaaagccaaggtcagtgatgacggtggccaaggcctgaggtgtggatcgcgttgcggcgtaggacgaattcggacgaggcgccagggtggcagtactcagctgggcagacacctggtccggggtgacgggcttgccatccacttcggtggcgatgtttctaagcgttgcggccaggtcgcgcagattgttctggtctgccaacagttgccgcataggtaaggtcggcgtcgtctgaggtgtaccgacactgttcggggtgagtgaagttgtgactgtgcctgggctgccttgggcacttggcacagcgggttcatgggcttggacggtatgaagggggtggacgctgacggcgggctgtactgcgttggtaatgctcatctaatgtaccttttgatgggtaaaaaaagacgccttcccaaaagatcttccgtgttcccgaggcgtagttctgagtgccccaaccttgcgggtacgttccgctccacgcccaggcatctgtattcaggtgtgttggcacgtgaagaagtcggcctgaatcggcgcgaaatacctgcgcagtgcgtaggcatacgccctgaattgacgcagaaacatagccttgggccgtgttattcgggcaaactccctgtttttccgtacctggccaaggcatgcccatgactcccgcgtcgactgtcgatgaaaagagctttcgtaaactcctgagccgtaacgtggccctgccgttaggcgtgggtgtgctcagcgcagcatttttcgtcgtgctgatcacgtacttgttgtcggtgatccagtgggtggagcacaccgaccgggtcatcaataacctcaacgagtcgtccaagttgacggtggacctggaaaccgggctgcgtggtttcctgatcaccggcgacgagcatttcctcgacccgtatgaagtcgccaagccccggatcattggcgatttgcataatttgcaggagctggtggcggataacccgcaacaggtggaccgtcttaaacgcctggaggcgatgcaagacgagtggaacaagtacgcgcaatcgatgatcgatctgcagcgcagcagcggtgactaccgtgcagcggtgaaggcgggccggggcaagagcctgaccgacgccattcgccaggaatatgtgaacgcggttgatatggagcagcagttccgggtaacccgtaacgcggatgtcactcgcaccacggtgatcagcgttaccctgtacctggtctttgtgctcggtttgagcggctttcttgcatacagcggaagaagaaatttagtttctttatcaaacagttacagcgcaaacctcgcgtcacaacagaagattgcgcggcgccttgagcagcaagcctggctgcgtaatggccagaccgagctggccgaacaagtactcggccaactcagtttgaacatgctgggccgcaacatcctgcagttctttgcccagtacatgggctccgtggttgcggcgctgtatgtacgagaagaacacggcggtctgaagcgtgtggccacctatggtttctcccgcgaacaggagcagcaggaacagtcgatctacagcgacgaaggcatcgtcggccaggccgcccagcttgatcgcctgattcgcctggacgacgtgccggtggattacttcaaggtcagctcgggccttggcgagggctcgccccgcagtgtgctggtgatgcccaccagcgatgacgaccgcgtcaacggggtgatcgaactgggcctgctacgcccgctggaagagcgtgacgtcgaactgctggagctgattgccggcaatatcggcacctccatcgaggccgcgcgttatcgccagcgcctgcaggaagtgctggccgaaacccagcagctcaacgaagaactgcaagtgcagcaggaagagctcaagaccgccaacgaagagctcgaagagcagtcgcgcatcctcaaggaatcccaggctcacctggaaacccagcaggccgaacttgagcagaccaacgagcagttggccgagcagacgcaaaccctggccgagcagcgcgacgccatggaccgcaaaaacgtcgaactcaaccaggcccaactcgcgctggaagaccgcgccgacgaattgcagcgctccagcaaatacaagtccgaattcctcgccaatatgtcccacgaactgcgcacgccgctgaacagctcgttgatcctggccaagttgctggcggaaaacccccaggaaaacctcagcgccgagcaggtcaagtttgccgagtcgatttactcggccggcaatgacttgctcaacctgatcaacgacatcctggatatctccaaggtggaggccggcaagcttgaagtgcggccggagaactccagtgtcgtgcgcctggtggacggcctgcgcggcatgttcgaaccgctggccgccgaccgcaagctgggcttccaggtcgaggtgcaggagggtgcgccgactttgctgtttaccgaccgccagcgcctggagcagatcctcaagaacctgctgtccaacgcgatcaagttcactgagcagggcgaagtcagcctgtcggtgtcccgtgcgccgggcgagggcatcgccttcaccgtgcgtgactccggcatcggtatcgccccggatcagcaggaaagcatctttgaggccttccgtcaggccgacggcaccaccaaccgccgttacggcggcacgggccttggcctgtcgatttcccgcgacctggcgacgttgctcggcggctctatcagcgtgaccagcgaaccgggtaaaggcagtgtgtttaccttggtcttgcccgagcagtacgtcgagcgcgaggagggcgccgcagcggttgagccgccgcgccaagtggtggccgcgccggcacccaagccggttgcgatctcgccgctgccggtggtggatgtgcagcagattccgcgctttgccgatgaccgcgacaaggccccgttcaccacccgttgcattctggtggtggaagacgagccgaattttgcgcggatcctcttcgacctggcccatgaactgggctacaactgcctggtcgcccatggcgcggacgaaggctacagcctggcggaggaattcgtcccggacgcgatcctgctggacatgcgcctgccggaccattccgggctgaccgtgctgcaacgcctgaaagaacacgccagcacccgccacattcccgtgcacgtgatttccgtggaagaccgcgtcgaagccgccatgcacatgggcgccatcgggtatgccgtgaaaccgaccacccgcgaggagctaaaagacgtgtttgcgcgcctggaagccaagctgacccagaaggtcaagcgcgtattgctggtggaagacgatgacctgcagcgtgacagcattgcccgcctgatcggcgacgatgacattgaaatcaccgatgtcggctacgcccaggccgccctggacctgctgcgcaccaatatctacgactgcatgattatcgacctcaagctgccggacatgctcggcaatgagctgctcaagcgcatggccaccgaggacatctgttcgttcccgccggtcatcgtctacaccgggcgcaacctgacccgtgatgaagaggccgagctgcgcaagtactcgcgttcgatcatcatcaagggcgcgcgctcacctgaacgcttgctggacgaagtgacactctttctgcacaaagtcgaatcgcagctgtcccatgaccgccagaagatgctcaagactgcgcgcagccgcgacaaggtcttcgaggggcgcaaaatcctgctggtggacgacgatgtgcgtaacatcttcgccctgaccagcgccctggagcacaaaggggcggtggtggtgatcggccgtaatggccgtgaagccatcgacaaactcaatgaagtcgacgatatcgatctggtgctgatggacgtgatgatgccggagatggacggttacgaggccaccgccttgattcgccaggacccgcgctggaagaagctgccgattattgcggtgacggccaaggccatgaaggacgaccaggaacgctgcctagcggcgggctccaacgattacctggccaagccgattgacctggaccgcctgttctcgctgattcgcgtatggctgccgaagatggaacgcatttaagtggagcgaagttttttggataaaagcagcgacattgagctgcgcctgctgatcgaggcgatttacctcaagtacagctatgactttcgcgactattccggtgcgtcggtcaaacgccgcgtggcccatgcgctgcgccagtttgactgcgcgaccatttccgcgttgcaggagcgggtgttgcacgaccctgccgcgttcatgcagttactgcagtttctgacgatcccggtcagcgagatgtttcgcgacccctcgcacttcctggcgatccgccaggaagtggtgccgttgctcaagacctacccgtcgatcaagatctggatcgccggctgcagcacgggcgaggaggtgtactccatggccatcctgctgcgtgaagagggcttgctggaacgcacgatcatttacgcgacggacatcaaccccgcgtccctggacaaagccaagcaggggattttttccctggagaatgtgcgcgcctacacggccaactatcagcaggccggcggccaacgttcatttgccgactactacacggcggcctacgattacgcgatcttcgacaagagcctgcgcgaaaacgtcaccttcgccgaccacagcctggcgaccgacagtgtattctcagaaactcaattaatttcatgtcgtaatgtattgatttacttcaataaaaaattgcaggatcgagcgttcgggttgtttcatgagtcgctgtgtcatcgcggcttcctggtgctgggcagtaaggaaaccctggatttctctgcctacagcaagcaattcgagcccttggtcaagcaggaacggatctaccgaaaatcatgagcgaggcgcaagcgcaacctatttgcgggattgaggccatcgtcgtcggcgcgtccgccggcggcgtggaggcgttgctgaagatttttggcgagttgccggcaggctacggcctgccgattattgccgtgctgcacctgccggatgagcgtcgcagccagttggcggaagtgtttgcacggcgtctgcgggtgccggtgaaggaagcgcaggacaagcaagtgatcgaggcgggcacggtgtacttcgccgggccgggttatcacctgtcggtcgagcatgatcgcagcctgtccctgagccaggaagaccgcgtgcatcattcccggccagccattgattacctgtttgcgtccgccgccgacgcctacggcaaagggctgctcgccattcttctgaccggcgccaaccaggatggcgcccgtggcctggtccacgtccaacaatcgggcggcactaccatcgtacaagaccccacggaagcacggattgccgtgatgccgttggcggccctggcgttgcatacacccgaccatattctgaccttgagccgcattgcctcattgctggcttccctggaatcctccccatgttaagtaatatccaggccaaactgctgatcgtcgacgatctgccggaaaacctgttggccctcgaagcgctgatcaagcgtgaggatcgccaggtctacaaggccttgagcgccgacgaggccttgtcactgttgctggagcacgagttcgccatggcgattctcgacgtgcagatgcccggcatgaatggcttcgagctcgccgaactgatgcgcggcaccgaaaaaaccaagaacatcccgattgtgttcgtcagcgccgccggccgcgaactcaactacgccttcaagggctatgaaagcggcgccgtcgacttcctgcacaagccgctggatatccacgcggtgaagagcaaggtcaatgtgttcgtcgacctgtaccgtcagagcaaggccatgaagctgcaagtggaagccctggagcgcagccgtcgtgagcaggagctgctgctgacgcgcttgcaagccacccaggccgagctggagcaagcggtgcgcatgcgtgatgacttcatgtcgatcgtcgcccacgaagtgcgtacgccgctgaacggcctgatcctcgaaacccagctgcgcaagatgcacctggcccgggataacgctgcagcgtttaccctggacaaaatgcacgccatggtcgaccgcgatgagcgccagatcaaaagcctgatacggctgatcgaagacatgctcgacgtgtcgcgcatccgcaccggcaaactgtcgattcgcccggcgcgcttcgacctcagccagttggtgcacaacctggtggaaaacttcgcaccgcaagtggccgctgccgagtcatcgatgcacttggagacccaaggcccggtggagggcaattgggacgagttccgcatcgaacaagtggtgtccaacctgctgaccaacgccttgcgctacggggccaagagcccagtggaagtgcgggtgtacaccgagcatggcgaagcgcgcgtggaagtacgtgaccatggcatcggtatcagcgaggacaaccagaagcgtattttccaacagttcgaacgcgtgtccgccagccatgtggcggcgggcctgggcctgggattgttcatttccgagcagatcgtggcggcccacggcggcacgatcgaagtgcaaagccagataggcgagggcgcgctgttccgggtgtgcctgccgcttgaggcgtcgacatgaaatcaatcgtcacttcgacgcaacctctgcgtgaccccatggtcgtaattccagctattgaccggacaaaggcttcccatgagtgaagatgcacaagatgtcgttctgatcgtcgaggacgacgaatccattatgtttgtgttgggtgaatacctggcaggcttgggctaccgggtcttgaaggctattgatggggagcaggctttcgagatcctcgcgaccaagccgcacctggacctgatggtcaccgactatcgcctgccgggcgggatttccggggtgcagatcgctgagcctgcgatcaagctgcgtccggaattgaaagtgatctttatcagcggttacccgcaggaaattctcgactgcaacagcccgatcacgcgcaacgcgccgatcctggccaagccgtttgatctggatacgctgcaagagcatatccagcgcttgctggcctgaagcgcaagggggctgcgtccgtgcagccctagtttttaatcatctcgcgcacttttgccgtcaacagatcaaacgtgaacggcttggtgatcagttgcatccccgggtcaagaaaaccaccgcgcactgccgcgtgttcggcataaccggtgataaacaacaccttgaggtccggccgcagctgccggccgatttccgccatttgccggccattcatgccgggcaggcccacgtcgctgatcagcaggtcgatacgctgttcggactcgataatcggcagcgccgtattggcatcccccgcctcgacgaaggcataccccagctctttgagcactgcacacaccaacacccgcactgccgggtcatcctcgacaatcaatacggtttcaccggcattggcggatggcagcaaggtcgggttaatgggcgcctgcgtctgtatttcgcccaggaaacgcggcaggaacagactgacagtggtgccggtgccgacttcgctgtggatcgtcacatggccgtgggactggcgggcaaaaccataaatcatcgacaaaccaaggccggtgccctggccaatgggcttggtggtgaaaaacggatcaaacacacggcccatcaagtgttccgggataccgcaaccggtgtcactgacgctcagctcgacgtaatcgccgggcttcaacgtgccgtaggcggcggtgaacacgctgtccaggtggcgattggtggtctcaaccaccagtttgccgccgccaggcatggcgtcgcgcgcgttgatcaccagattgagcagggcgctttccagctggttggggtcggcttcggcggtccacagttgctcggtcaggcgcatgtcgagggcgatgctttcgttgatgctgcgttgcagcagctcgcccatggacgtcaccagctggttgatttccaccggctttgagtccagcgactggcgccgtgaaaacgccagcaaccggtgggtcaggcctgcggcgcggttcgccgacgtcacgccgaggtcgatcaggctgtcgagatcgtcgagttttccgcgtgacacgcgtcggcgcaatagctcaaggctgccgataatgccggtgagcatattgttgaaatcatgggcgatgccgccggtcaattggcccacggcttccattttctgtgactggcgcagcgcctcttcgttgctgcgcagttgcgccgtgcgctcttcgacttgctgctccagggtctccagcgtgcgttgcaggcgcagctcgctctcgctcaagtcgatcaagcggtcgcgggcctcatattgccggcgtcggccgcgcagggcggcgctgaccaggctgatcagcgtcaccgggtggaaagggcgttccaggaacgtcacgttgcccagcagaccgctcaaatgcgaagaaccgttatggtcgctgccgccatggtgggtcatcagcacgatcggcagatccgaccacgccggctgttgatgcaggtgctccagcagtggctcgatatccacgccgcgcagggcttcggcggcaatcaccagcaagccggccccttgctccagggcttcgcataaactcgccaggctggtggcaacgataccgctgtaaccggcttcgttgagcatcttcagcgccagagagccgtcacggcccagcggcgccaggatgattgcacgctcggattcgggagaaatgcgcgccactagccctcatccttgagcagaggcgagccggcgcccatgtaggtcggaatgccgcgcagtacgccctggaagttatcgaggggttcgccgacggtcatgccacggttgctgatgcggtattcgcgaatggtcgactcgtgggcgccggtgcgtttcttgatgatcgaaatggcccggcgtaccttgcccaaggcttcgaaataacgcagcagaatcacggtgtcggccaggtaagtgatgtcgaccggcgcctgcatgtcaccgaccagcccatgctgggcgacggtcatgaaggtcgcggcgccgcgacggttcaggtacagcagcaattcatgcatgtgcaggatcagcgcgttttcttccggcatcgcggcctggtaaccgttaatgctgtcgataaccacggttttgatcccgccttcgtcgacgcaacggcgtacccggtgcgaaaactcgccgggtgacagctcggcggcgtccacctgttcgatcagcaggttgccggtggcttgcagcgcaacgaggtcgatgcccatgttgcccatgcgctcgaacagcaaaccgagttcttcgtcgaagataaacaacgcggctttttcgccacgggagaccgcagcggcggcaaagatcatcgagatcagcgatttgcccgtaccggccgggccgaggatcaagctgctggaaccggtctcgacgccgccacccatcagggcgtccagttcggcgatgccgctgctcagggtctggcgcacataaccgccgcgatgctcggcggcgaccaggcgcgggaacacatggataccgtcgcccacgatggtgaagtcgtggaaacccccgcggtatttctgcccgcggtatttcaccacccgcacgcggcggcgttcggcgccgtagttgggggtcagctcttccaggcgaatcacgccgtgggccacgctgtgcacggttttatccagggattcggtggtcaggtcgtcaagcagcagcaccgtggcgtcgtagcgcacgaagtagtgcttgatcgccaggatctggcggcgataacgcagcgagctttgcgccagcaggcggatttccgaaaggctgtcgataaccacgcgggtcggcttgacccgttcgaccacttcaaagatctggcgggtggcttcgcccagttccaggtcggaggaatacagcaggctctgctggtggtcggcgttgagcaagctctctggcggggtgagctcgaagatatggatattgtcatccaggtcccagccgtgggatttggcaccctggcgcagttcgcgctcggtctcggacagggtgatgtacagggatcgctcaccgttttttgcgccggcctgcaaaaagtgcagcgctacggtggttttaccggtgccaggttcgccttccagcaagaacaggtggctgcgtgatagccctccggcaagaatgtcatcaagaccttcgatgccggtggctgccttttcactgaacagctctttggatgtagacaagaagtgccctcgggtcacgtacaagtagaggaacgcgccgcccggggcgcgccatatttacttgaccgtagtggcacgtagcggttcaacgtctggtgatatttgtacaaaacggcgggggattaacggttctttccaacaggttacaggccttgctgcagcgcagggtcgtcggggttctgctgctcaagttgggcgagcaagacttgcacgttctgcaattggccggtttctttccagtagttcacgagcaacacgcgggctttgcggttggcggggtgacgttgaacgatgtcttccaactggcgctgggccgcttccaattcttcctgggcgtgcagggtagtggccaagtcgtaacggtagtcttgattgtccggctccagctccaccgccttggacaggccgagcaaagcgtaagggcgttcgccatggtgcagcagccacatgcccagcgcgtgctgcaagtaggcggattccgggtgcgccgccagttgccgcgccagcagttggcgggattcatcggttttgccctgcttatccagcaactcgatctgcgcgacgaccgcttgcaggttgtccggctgcaaacgcatggcctgttccaacgcattttgcgcgtccggcagcagggcgctgtggatgtacaggcgcgccagttgaatccagctttcagcggtttcgggctgccccttgagctgtttcacgaattcatcgagtacttgctgcaacggcccgaagtacaagccgagggtgtccggcgacaggccgagcaaggcattggcggcggcaaagcgcacttcttgctcgggatcatccagcaccggccccagcaacagcacgcgttggccgttgggcaccaggccgacgatgctgtgaatcgccgcctcgcgcaccagtggcgaatcattggccaagtctttatcggcgagtttcagcgcctgggggcttgggtagttgggcaattcggcgtgcaaagcagcgcgccgctcaggcgagaggtccgggcgcccgagttgttgatacagcacacgggcggcccccggctcaccgttatgcgcctgcttcaaggctttggcgtaaccatgggcaatcgccggcggcacattcaccggggtagagcgtgagaaaaaccaggtgagcaacacgattaacaacagggcgcacaggccgatgatggagtaacggcgtgactttgacatgcaggcgtccaaaagctggggcagctattgcaaagccatcagcttcggtcagaccacggcgagtgtcaaacccgcatcaggtcaacacgtactcaatcggctccaacgcaggcggcaagtcgactgcgccgagcgccgcaagaatctctcgctccagggtgcgcacgagggcattgcacggcaggtcgttttcatcgaaaccgaacgggtcttcgaggtcgtcgccgatttcatccaggccaaagaaggtgtagctgacaatggcggtgaacaccggcgtcagccagcccaaaggttcggccatggcgaacggcaacaagatgcagaacaggtagatggtgcggtgcagcagcagtgtgtaagggaagggcagtggcgtgtgcttgatccgctcacacgaagcctgcacctggctcaggctgaccagtcgggtttccaactgggtgtagcgccattcactgattacgccctgttcggccaactgcgaaaaccgtgcgcccaactgctgcaatacctggtcgggaaggttgggatgcgcttgatcgactccgatccagggtgttatcgccccagcctcatcctcatggcgcagccgcgcaatcaaaccgtgggcaaagccgcaaaggccacgcagcaaccccgcacgctcaaccgggtcacccagcacctgggtttcgcgaataagcgagcgcacctcaatgatcatttgccccagttgcttgcggccttcccaccagcggtcgtagcaggcgttgttgcgaaagctcatgaagatcgacagcgataaccccagcaaggtgaagggcgtagcgttgaccttggaaaagtaggccgggtgcagggtttcgaccagcacgatcaccgaggccagcagcgtgaccagcaggctgcgcaaggcaatgcgcttggcaatcgaacccttgagggaaaacaggatacccaggaggttgggtttgggacggacgatcatcgcggggaggcttcttcgatggcgcaggccatcaggttagaaggccgggcccaaagcgtccaatcacttgggctgaccaactgatcagcgggatcaatgattggccaaaccagtcagccaagttgaaggctttgaccattgccgctgcagcgctctagagcgactatttccacgatttacatgctgaaaaacgtcctgaaaataaaaaccacaaggatttgaagcgatgcgtgagtatttggctgccaccaccgagtttgattaccagcacaccgtcgacgccgcactggccggcaacctgcaggcactgaatgcctgcgtggaatgctgcgaccggcatgctttgccggggcgcatcgcgttgttctgggagggcaaggacggacaaagcgcgacgtcgacctttactcaattgcaggaccaggcagcccgcttcgccaacttcctcttggcccagggcgtcaagcgcggtgacaaggtcgcgggcctgctgccacgcacggcggaattgctggtggtggtgttcgccacctggcgcattggtgcggtttaccagccgctgttcactgcgttcggcccaaaagccatcgagcaccggctgagcagttccggcgcggccttggtggtcactgatgcggtgaaccggcccaagctggccgaagtcgagggctgcccgaccatcgtcacggtcgccggcgccaagggcgaaggcatcgtgcgcggcgattacagcttctgggccgagttgcccaactattcaaatgcctgcgagccggtgttgctgggcgcagacgaccccttcctgttgatgttcacttcgggcaccaccggcccgtcgaaagcgctgtcggtgccgctcaaggcgattgtcgcgttccagagctacacccgcgacgccgtggacctgcgccccgaagacgcgttctggaacgtggccgatccgggctgggcctatggcatttatttcggcgtcaccgggccgttgtccatgggccacccgatcaccttctacgatgggccgttcaccctggaaagcacctgccgggtgatcaacaaatatgcaattaccaacctcaccggttcgccgaccgcttaccgcctgctgattgccggtggcgagcagttcgcgcggtcgatcaagggcaagctgcgcattgtcagcagcgccggcgagccattgaacccggaggttatccgctggtttgccgacaacctcggcgtgaccatccacgaccactacggccagaccgaattgggcatggtgctgtgcaaccatcacggccttgagcatccggtgcatgtcggctcggccggctttgcctcgccggggcaccgtattgtggtgctggatgacgataatcaggagctgcctgccggccagccgggcatcctcgccatcgaccgtgaacagtcgccgatgtgctggttcgccggctacgacggcgttaagaccaaggcgtttgtcggcaagtactacctcagcggtgacaccgtggagctgaacccggacggcagcatcagctttgtcgggcgcagtgacgatgtgatcaccacctccggctaccgcgtcggcccgttcgacgtggagagcgcgctggtcgaacacccggccgtgatcgaggccgccgtggtcggcaagcccgacccggagcgcaccgaactggtcaaggccttcgtggtgatcaacgcgcaataccgcgccaccccggaactcgccgaagaactgcgcctgcacgtgcgcaagcgtcttgccgcgcatgcttacccgcgagaaatcgaatttgtcagcgacttgcccaagaccccaagcggcaagttgcagcgttttattttgcgtaatcaggaaatcgccaaagctcaagcgacaacggcgtgatccccttcaaaggaaatcatgatgcagattgaaaacaaggtattcctggtcagcggcggcgcgtcgggcctcggcgcggccaccgctgaaatgctggtagccgccggtgccaaggtgatgctggtggacctgaatgccgaggctgtcgaggccaaggccaggcagctcggcgctaacgcccgcagcgccgtcgcggatatcagccaggaagccgctgccgaagcggccgtgcaagcagccgttgctgcctttggcggattgcatgggctggtgaactgcgccggcgtggtgcgcggcgagaagatcctcggcaaaagcggcccgcacgccttggccagctttgcccaggtgatcaacgtcaacctgatcggcagcttcaacctgctgcgcctggccgctgcggccatcgccgaaaccgaagcgaatgccgatggcgagcgcggcgtgatcatcaacaccgcctcggtggccgcctttgacgggcagattggccaggcggcgtatgcggcgtccaagggcgcaatcgccagcctgacgctgccggccgcccgtgaactggcgcgcttcggcattcgggtcatgaccatcgccccgggcattttcgaaacgccgatgatggccggcatgacccccgaagtgcgcgattcgctggccgccggggtgccattcccgccgcgcctgggcaagcccgccgagtacgccgcgctggtacgccacatcattgaaaacagcatgctcaacggcgaggtcatccgtctcgacggcgccttgcgcatggccgccaagtaaggaggattttttatgaacgatcccatcgtaatcgtcagtgccgtgcgtacgcccatgggcggtttccagggcgaccttaaagggctgaccgcgccgcaactgggcgctgccgcgattcgcgccgccgtcgaacgcgccggcattgccaccgatgccgtggatgaagtgctgttcggctgcgtgttgcccgcaggcctcggccaggcgccggcgcgtcaggcggccttgggcgccgggttggacaagggcacccgctgcaccacgctcaacaagatgtgcggctcgggcatggaagctacgattcttgcccacgactcgctgctggccggcagtgtcgacgtggtggtcgccggtggcatggaaagcatgtccaacgcgccgtatttgcttgaccgcgcgcgcagcggctaccgcatgggccacggcaaggtgctcgaccacatgttcctcgacggcctcgaagacgcctacgacaagggccgcctgatgggcacctttgccgaagactgcgccgagcacaacggcttcagccgtgaggcccaggacgccttcgccatcgcctcgctgacccgtgcccaagaggcgatcacccacggcagtttcgccgccgagatcgtgccggtgcaggtcaccgtgggcaaagagcaaaaaaccatcctgcatgacgagcaacctcccaaggccaagctcgacaagatcgccagccttaaaccggcgttccgcgaaggcggcacggtgacggcggccaactccagctcgatttccgacggcgcggcggcgttgctgctgatgcgccagtccgaagcggacaagcgcggcctcaaaccgctggcggtgatccatggccacgcggcgtttgccgatgagccggggctgttcccggtggcgccggtcggcgcgattcacaagctgatgagcaagaccggctggaacctcggcgacgtcgacctgttcgagatcaacgaagcctttgcggtggtcagcctcgtgaccatgagcaagctggaaatccctcacagcaaggtcaatgtccacggtggcgcctgtgccttgggccatccgattggcgcatcgggcgcgcgaattctggtgacgttgctctcggccctgcgccagaaaggcctcaagcgcggcgtcgctgcgatctgtatcggcggtggtgaagccacggccatggccgttgaatgcgtgtattaaggaccgtttatgctgcccaatgacgaacaactgcaaatcagcgacgcggcccggcaattcgctcaggagcgcttgaagcccttcgccgccgaatgggaccgcgagcatcgctttcccaaggaagccatcggcgaaatggccgagctgggctttttcggcatgctggtgccggaacagtggggcggttgcgacaccggctacctcgcctatgcgatggccctggaggagatcgccgccggtgacggcgcctgctcgaccatcatgagcgtgcacaactcggtgggctgcgtgccgattcttaagttcggcaacgatcagcagaaagaacagttcctcaagcccctggccagcggcgccatgctcggcgcctttgcactgaccgaaccgcaggctggttccgacgccagcagcctgaaaacccgcgcacgcctggacggcgatcactatgtattgaacggctgcaaacagttcatcacctccgggcagaacgccgggatcgtgattgtgttcgcggtcaccgacccggcagccggcaagcgtgggatcagcgcgtttatcgtgcccaccgactcaccgggctataccgtcgcgcgggtcgaagacaaacttggccagcatgcgtccgacacctgccagattctgtttgaagacgtgaaggtgccagtggccaatcggcttggggaggagggcgaaggctacaagatcgccctggccaacctcgaaggtgggcgcgtgggcatcgcctcgcagtcggtgggcatggcccgcgccgcgtttgaagccgcccgcgactatgcccgtgagcgcgaaagttttggcaaagccttgatcgaacaccaggccgtggcgttccgcctggccgacatggccacgcaaatcgcggtcgcccggcagatggtgcactacgccgccgctctgcgcgacagcggcaagccggccctggtcgaagcctcgatggctaagttgttcgcctcggaaatggctgaaaaagtctgctcggccgccttgcaaaccttgggcggttacggttacctgagcgacttccccttggagcggatctaccgcgatgtgcgggtctgccagatttacgaaggcaccagcgatatccagcgcatggtcatctcacgcaatctttaaggagccgatacatgagttacgaaaccattttgcttgaagtgcagggccgcgtcgggctgattacccttaatcgcccgcaagccctgaacgccttgaatgcgcagctggtcagcgagttaaaccaggcgctggacggcctggaagccaacccggaaatcggctgcatcgtgctgaccggctcgaaaaaagcctttgccgccggtgccgacatcaaggaaatggccgaactgacctacccgcagatctatttggacgacttgttcagcgacagcgaccgcgtggccaaccgccgcaagccgatcattgccgccgtcaacggcttcgccctgggtggcggctgcgaactggcgttgatgtgcgacttcatcctggcgggcgatggcgccaagttcggccagccggaaatcaacctcggcgtactgccgggcatgggtggcacccaacgccttacgcgtgcagtgggcaaagccaaagccatggaaatgtgcctgaccgggcgctttatcgatgcggtggaagctgaacgctgcgggatcgtggcgcgcatcgtgccggcggatgagctgctggaagaagcgttgaaagtcgcgaccttgatcgccggcaaatcggtgccgatcagcatgatggtcaaggaaagcgtgaaccgcgcgtttgaagtcagcctgtccgaaggcgtgcgctttgaacgccgagtgttccatgccgcgtttgcgacacaggatcagaaagaaggcatggccgcattcgtggccaagcgtgcgcctgagttcaaggacaagtaacccggtctcaagaaccctcgagatgcaaaatgtgggagcgggcttgcccgcgaatgcggtgtgtcagtcaatacatctggtgactgacacaccgcattcgcaggcaagccagctcccacattggttttgcgatgtattcaccaatctcaagaaccctggggatcaaactgtgggagcgggcttgctcgcgaatgcgcagtgtcagtcgatacatctggtgactgacacaccgcattcgcaggcaagccagctcccacattggttttgtggtgtattggctagcgtgtttccagatcaccgcacatcaaactgtgggagctggcttgcctgcgatagcatcaccccggtctgtcagattaaccaaggtttccgcagcgcaggcaagccagcgcctacagggaacccgtgtgggttttagagttgatagttcttcaattcccgcgcaatcaccatccgctgaatctcgctggtgccctcgtaaatctgggtgattcgcgcatcccggtagtaacgctccaccgggtaatcctccagatacccatacccgccatgaatctgcatcgctgacgagcagaccttttcggccatttccgaggcgaacagcttggcctgggatgcttccgacaggcagggcttgccggcgctgcgcaggcgcgcggcgtgcaatatcagcaagcgtgccgcattcaagcgggtttgcatgtcggccagcaggttggcaacgctctggtgctcgataatcgcctgtttgaactgcactcggtcgcgggcgtacaccagcgccgcttcaaacgccgcgcgggcgatgcccagggcctgggcggcaatgccgatgcgcccgccttcgaggttggacagtgcaatggccaggcctttgccgcgctcacccagcaggttggcttcgggcaccgtgcattcgttgagggtgaccgcgcaggtgtccgaggcgcgaatgcccatcttgtgttccgtgcgatcgaccacaaaccccggcgtggcggtgggcaccagaaacgcggaaatgcctttcttgcccaagtccgggtcggtcaccgcaaacacaatcgccagcttggcgcgcttgccgttgctcacgaactgcttggcaccattaatcacccactggccatcgcgcagctcggcgcgcgtacgcaggttgtgcgcctcggaaccggcctggggttcggtcaggcaaaaacagccgatggcttggccactggcgaggtcaggcagccaggtttgcttctgttcgtgtgtgccgtagttgaggatgggcccgcaaccgactgaattatggatactcatcagtgcgccagtggcgccatcgccggcggaaatctcttcgaccgccagggcataggcgacgtaatcgacataggtgccgccccattcctcgggcactaccatgcccagcagccccagttcacccatcttggcgaccagggcatcatcgatccagccggctttttcccaggcttgggcgtgaggggcaatttcgccacgggcgaagtcacgcgccatgtcgcgaatcatcacttgttcttcagtgtattcaatgtcttgcatggcttatctcccaacctgcttgaagttgtggaagaaactctcgacatggctggcgtccagcccgtggatcgcgggcgggttccaacgcggggttttgtccttgtcgatgatcaacgcgcgcacgccttcgatcagatcgccgcgctcgaaccattggcggtccaggtgcagttccagcgcgaagcactgctccaacggcaggcggcgaccacgacggagcatttcgagagtgacggccatcgccaatggcgagcgggtctgcatcaggttcgcggtcgtcaaggcccacgcatgggtgtcggccacggtgacttgctgcaactgctcaacgatgctcggcacgtccggcagggcgaagaaatggtcaatggctgggcgcaaagccgccagcggtgggtcgggcaattgctgcacggccaatttggccagtacgccttgcaggtccttgagcggcgagtcctgccattgcaggcggtcgagcttgtggtccaagtcgatgagtttggcgctgtcgatgcaccagtccgcaagcccgcagtacagcgcgtcggcagcgcgaatttgcacgccggtcacgccgaggtaaattcccagctcaccggggatgcgcggcaggaagtagctgccgcccacatcgggaaaataaccaatcgccacttccggcatcgccaggcggctgcgctcggtgactacgcgcaggtcggcgccttgtaccaggcccatgccgccgcccaggacaaacccgtccatcagcgccagtacgggcttgcggtagtgatggatggccaggtcgagggcgtactcctcgacgaagaagtcttcgtgcaggcgctcgccgttcttgaagctgtcgtagagggagcgaatgtcgccaccggcgcagaaggctttttcgccagcgccgcgcaataccacggcatagacctgcgggtcgtccgcccaggcctgcagttgggtggtcaggctgcggaccatgtccagggtaatggcgttcaagccggcggggcgattgagggtgaggtggccgatgtggttgcggacgtcggccaacacttctccctgaagaatttcggcacggcttgcttcggatgaaacctgagcagtcatctgtaactccctgcttttattgttctttatcaagatgttcgcggacgaaccatctcgcgatcgtaccagtgcaaatttgcccagtacaacccggaatcatgcaggtcgtttttgcatttatgcagcagggcggctggccagtacttcgccgatgctgcggcgtcgcgcatggccttctgccgcgtggatcagttgttcaagctccgtcggcgccacgtcgtagaactgctccatttcagccagcgcctgcttcaagtcggccgcggtgatcgacgggtccgtaagcggcgcagcctggcccatgacgacgctctgcgcctcaagcgtgcccttggggtaacgcgtgcgggtggcgttgttataggccagcgcgcacgccagcagtgcccctgcgccgagcatgaccggcgcgagttcctgccagccgagggcaatcgaggccgggtcggcgagcaccagggtcatggccaggccgcctgctggcgggtgcaggcaacgtagccagcagatcaggataaccgtcatgccggccgccaggcaggcgctgcccaacgtgcgccccaatacccgggcgaccaatagcgccacaacgcctgcgcacaggtaactgccgataatcgaccaaggctgggccagcgcaccggacgacaccgcaaacagcagcacggccgaagcaccgagcgggccgagcaggtgcaaggccacctccatgccaaacacttgggcacacacccacacgctgagcagcgtgcccaaggccatgccgatggcggcgcggctccattcggcggggcgggtattgatggcggagggtaaccagcgagcgagcatcgagcggatccataaaaaagcggcaaaaaaaaggctcacctggttgcccggaaaagccctttgaaggttccaacatttgggggaaggaacccgcgcagtgtgccgagcttgatgcttaagcgccagtgcatattaatgaggtttgaatgcaaaaatagtgcagttaatttgctgcactgaaaggcgcagggcggtcctagtgtgccggtgcggtgctcaaatgacccagtacacgtgtatccgcttcttcgctgaatagttgcctttgcaggctttcctgtagcgcagggtcgttggatagcggccctttcaacgccaccagggcgtcacgcagtgccatcaaccgatccagcctcggcggaggaataaacaacagatcttcctgcacggcattgccctcataagaagtaggccacggtatgtgtgtggcccacagcgtccttgtcgttatgcagcatgcacttaccccagacggttgagatcgtggtggtagatagttaatgcgctgggcaacgagtctacatttgggttccaggcgcaggaagacaaagcgcgccagccgttacgcatagcgatgtaggtgttttcttggtggttatgacgaaaaacgcccactcttcacagagtgggcgttgtttattaaacagctgctgtaaacgcgatcagggcgaagcgggcttggccagatgcagcaacacataagggtctttatcgaactcgccggtcagcgtcggcgtgagcgagcgcaagcgcgggtcctgcaaccgattgaagtcctgtgcactcatcaccagccaggcaggcgcttgcagcggcgccaggtcagcggatgactgggtaaacagcggcaccttatcgcagtcgaagttgaccatgaacttgatggctttagcgtctttacccaagccatgcaggaccaccggtgccggttgctgcatgatctgcgctttaaccgcgaggctgaaggagcgggtgtcgtagagcgagcgttccaaaggttcgaccaccacgatataggtcgaccacagcgcaagcaccgccgcgaatgccggcgccagtggccgccaccgaggtttcactaccgccagcaacgccagtacctgcaaaacgcccagtaccgcgaagatcaacccaaggctgctgagctggtccgggtaacgccgccgcgccaccaccaggccgatcatcagcagcgccggcaacagcgtccagatgcccagcatcaagccgcgcaaccacgcaaacagtcgcccctgggtgacctggaacggataggccgcgatgatcgccgccatcggcagcatcggcagaatgtagcgggcttttttcgcctgcggtaccgacaaacccagcatcaccagcaaaccggccgccgcgcagtacaacaccaactgcaacgccgggtccggcgcgcgacgcccgcccgctgccacggccagcagcaccaacaacgccaacggataggccagggcgtaattgcccatggaactggtgaagtaatacagcacgccgccggagccttcggtgccgtccatacgccccaggaactgcatgcggattacgtcctgcatgaagtcctcgccgccactgagcttggccagcaataacagcaggccgacacacgccgccagcaacgccagggcgatcaggccgaaggtgaacagttggcgccattgccggttaagcgcgtagtagctgcatagcacacccgttggaatcaccaggccgatcggcccacggatggcgaagccgagaatcagcagcaggaacaaccagtgcaagcgtttggcggcgccgaagtgatcgtgcgcgtaccccaggtagaacaccgtcaaagcaacggcggcaagcatctggtccagtgacactgcgcgggtttcgctgataaaggtgctgctgagcagcaacatcgcgatgctcagcaggccccaacgggtggagtagggcgccgtcaggcgatacaccagcgtaacgatcagcgccgaggcaatggaggtgggcagccacgcggtaaagctggtgacctggccaaacggcaacgacaacacccacgtcagcagcgtcgaggtcgccaggtaatcggcgtagggctggccgtaggtggtggggaagaaactcggcccgtggcgcagcatttcctgggcaaacaccacgaagcgcgagtcgaacccgataatcgcctggtgccagttacccaggataaacagcaccagtgccaggagcccaagtcccagcgactggtgccggaccgttgcggtgagcaagggcggatgagctttgttcacgtatcaggcttccttgacctgctgcacccagttttgctgagggatcggcagttcgcaggagtcacctcggcccatggggaaatacttgaagcctttgcgtgccaggcgctcaccgtcgtacaggttgcggccgtcgaagatcaccgggtttttcaggcgctggtggatcaggtcgaaatccggggccttgaactgctgccattcggtgcagacgatcagcgcatcggcgccgctcagtgccgattccggcgtgcccagcagcgtcaggcgcgactcgtcaccgtagatgcgctgggtttcctgcatggcctcggggtcaaacgcacgcacattggcgcccgccgcccacagcgcttccatcagcacacggctgggcgcatcgcgcatgtcatcggtgttgggcttgaaggccaggccccacaaggcgaaggttttgccctgcagattgcccttgaagtacgcgttgatgcgttcgaacagcttgcttttctggcgctggttgatggcttccacggcttccagcaggtcgctggagcaattggcctctttggcgctgtggatcaaggcgcgcatgtccttggggaaacacgagccgccgtagccgcaaccggggtaaatgaaatggtagccaatgcgcgagtcggcgccgatgcccaggcgcacggcttcgatatccgcgcccaagtgctcggccagctcggcgatctggttgataaagctgatcttggtggccagcatgcagttggcggcgtacttggtcagttcggcgctgcgcaggtccatgaaaatgatgcggtcgtggttgcggttgaacggcgcgtagaggtcgcgcatcacttcacgcacttcttcacgctcgcagccgatgatgatgcggtccgggcggcggcagtcggcaacggccgagccttccttgaggaattccgggttggagacgatatcgaactccaggtggcggccggccacacgcaggttcttttcgatatgggcgcgcaaggtgtcgccggtgccgacgggtacggtggatttttccaccagaatcaccggctcgatgcgatggcgggacaccgcatcacccaccgacagtacatatttgaggtcggccgagccgtcttcatccgacggcgtgcccacggcgataaacagcacttcaccgtgctcaaccgcgagtttttcatcgaaggtgaagtgcaggcgtccgctttccaggttttccttgaccatggccgccagccccggctcgaaaatggtcacgtggcctttttgcagcgactcgaccttgctcttgtcaacgtccatgcagatgacatcgtgaccgacttcggccaataccgtggcctgcaccagaccgacgtaaccactaccaaatacactgattttcatggggcattcctggggcttgcaacgctagcacgacgagagttaataaccagtactccgaggatgaccaaggccacccccagggtttttgaaagcgaaaaatgttcgttgaacaccggcaggctggcggccagcaagtacaccagcgcgtagctgatgctgagcagcgaataggcgcggcccaggggcaaatgcttgagtgcgccgagccagcagagcatcgacagcgcgtaggcgatgatcgccaggaccactacgcccaaggcgctcacgtcgatgctgttgctgttgaacgcgttcaaccactcggcaggcagcggcaggcgcgtcatgctccagcgcatgcccagctgggcggcgctgaccaggccgacactgcccaacgccagggcaaagccttgaacccggctcatacgtgacgccccagcaacaccacaccgccgatcaccaacgcgacacccagccagtgacggccatcgatgtgctcatgaaagacgaaacgcgccatcagcgtgaccagtacaaaattcaggctgagcatggggtaggcgatgcccacttccaggcgctgcaacaccaacagccacaccagcaagcccaggcccaggcacaccaacgccgcccacagccagggcgaacgcagtttgggcgcccaaccgtcgggctggtcgcgccagctttctacggcaaacttctgcgagacctggcccatgcacgtgagcaggcacgcacccaataacagcaggagggtgatcattgcgcggcctgcgggaagatcaggatcaccaggttgccgcgctcgtagcgcttgccgtcctggggcagcaggttcacttcagccacttcatcgtcgcctttgacccgcatgaccacgccgactggcccttgtttgcgcgcatcagccatccattgctggacctggcgggtgtcgatcttgcggtgggcggtgtccgcgtaggcgatgccatatttcacttcaccgacggtgttgtagagcgcgacatccgggcggcccaggcgccaggacaaggccgacgccgcgcccaggtcattgctgagcaaggcggtggtggtttgcagctcctgctggtggtcgatgatgaattgatccggaatcttgttgtaaaccaccgagtgcggcagcgcggccggcaccagcagcaccagcaagccgctgccgatcagcggcgcggcccacagtttcaacgggcgcgcggcgtgcagcaggttgacgaggacccagccgaacaagcagacgaacaccagcaccaggctgaaggtttccacgccgtgttcatacaccggcttcttcatctggaaccaactgagcgccagcaaggccagcacgccgaacgccaggttcagccagccgttgatgcgcaatgcgcggccatggcccagtgcaagtttgttactcagggtcgagcccatcagcaaggccaagggcagcaggcacggcatgatgtacgacggcagcttgcccttggccaggctgaagaaagccaggggcatcaacagccacaacagcaggaacgcagtcttgggcaggcgtttttccagccacgcgtgtttaatcgtggacggcagcagggcaatccacggcaacgagaacgcgaccatcaacggcaggtaataccagaatggttcggcatgctgggcgtcgtcgccggcaaagcgttggatgtgctcgtgccagaagaagaagttccagtagtccggctcttgcaggtgcaccgccagcgcccatggcaggctgacgacaatagcgacgacaaccgccaccacaccgtaaccgagcagttcacgaaagcgtttctgccagatcgcatagggcagggcgatcagcaccggcagcaaccaggcaagaaagcccttggtcatgaagcccatgccgcaggcaaagccgagcaaggcccaggaccacaaacggccacggcgcgtggtgctgtcgaagcaaaaccacagtgcaacgccggtcaggttgacccaaaaggtgaactgcggatcgaggttggcataaccgccgagcaacgccacgctgacaaagctcatgtacagcacggtgctgaccaggcttttttgcgggtcattccacaaccggcgcgacaccaggtaaaccaggaggatgctcagcccggtgctcaaggccgaggcaaagcgcacgccgaacaggttctgcccgaagatcgcctggcccagcgcgatcatccagtagccggcggcgggcttctcgaagtagcggatgcccatgaagtgcggcgacgcccacttgccggtcagcagcatttcctggctgatttgcgcgtaacgggtttcatccggaatccacagaccgtgcgtggccagcggtaacaggtaaaacacgccgaacgccaacaggagcaggggcaatgcccagcgccggatcatgcctgctgcactccgagccaaccctcgcggccgctcagggcgccgcgcaccaggtgttgctggggcagggtggtcacgtccgcgggcaacagctcgcccaggggtttgaagtcgatgccgcgctgcccggcctgggccagcaactggcgaaaatcttcagccatcagaatcccttctacttctgcgtggatcgtatagacgttcagcttcgactcggtaaaccggtcaaggatgaagctgttgaagtctttggcagccaccaccggcccgacgacttcgtcgaaggtcggcaggtctaccggaatttgtggggtgcccgcgctgccatcggccagggttggacgaaacaggctggtgccccggcaatcgctgttgtagcgaaaattgaagccttgcttggcttgcaccacgcgttcatcggcgcgccaaccggcagccgcggaacaatcgatgcgctcaccgaggatgtcgctcaaggtgtcgacgccacggcggatctgttcgaccagctgtgcatcgctccagcgcccggtgttggcctgccagccgtggtgatcccacgcgtgcaggccgacttcatggccggcggccttggcctggcgcatcaagtgccccaggtcgcggccaatcggcttgccgggccaggcggtgccggccagcaagatgtcccagccatacagcccggcggcattggaacgcagcatcttccacagaaattgcgggcggatgaggcgccacaagtggcgccccatgttgtccggcccaacgctgaagaagaacgtcgcttttacccctgcttcatccagggattcgagcaaccgcggcacaccttcacgggtgccacggtaggtgtcgacgtcgatgcgaaggccagcctgcattacttcttgtccgctatttcgagcatggcttcacgcaggaagaaatccagggtgttgccgatggtttcgctcatctctacggtcggctcccagttcagcaggcgcttggcgttttcgatgctcggtttgcggtgtgccacgtcctggtaaccggtgccgtagaacgccttgctttctacgtcgcggaaaccggcgaacggcgggaagttgctgcgcagcgggtgcgcttcgaactgacgcagcagttcttcgcccagttggcggatgctggcttcgttttccgggttgccgatgttgatgatctggccgttgcagacatcgttgtcgttatcaatgatgcgtgccagggcttcgatgccgtcggcgatgtcagtgaagcaacgcttctgctcaccaccgtcgaacaggcggatcggcgtaccttccaccaggttcaggatcaactgggtgatggcgcgagagctgccgatacgggctgagtccagacggtccaggcgcgggcccatccagttgaatggacggaacagcgtgaagttcaggcctttgtcgccgtaagcccagatcacgcggtccagcagttgcttggaaaccgagtagatccagcgctgcttgttgaccgggccgaccaccaggttggaggtgtcttcgtcgaagtactggtcctggcacatgccatagacttcggaggtcgacgggaagatcacgcgcttgttgtacttgacgcagtagcgaaccagtttcaggttctcttcgaagtcgagttcgaacacgcgcagcgggttacgggtgtattcgatcggcgtggcaatggccaccagcggcaggaccacgtcgcacttcttgatgtggtactcgatccactcggagtgaatgctgatatcgccttccacgtagtggaagttggggtggctgcgcaggcgctcgatggcgtcggagccgatgtccaggccgtagatttcgtaacggtcgtcacgcagcaggcgctcggacaagtggttaccgataaagccgttcacgcccaggatcagcacgcgggtacgacgtggcttgcggccggactcggcgccgcgcagtacggagccgtccaccaggcccagttcatcagccagggaagggccggccaggtacaggccgttggcgttacgctggccgaacttgaccaccagggaatcctcaccgcaggcgatgcgcagcgggttgacgctgatcacacggcctggcgccaggccttcgttgcccttgaccacttcggcttgccaaacgatcagcttgtgctcgccgacggcgcagaaggcgcccgggtacggttgggtcacggcgcgaaccaggttgaacagttcttcagccggctttttccagtccagcttgccatcggcggcgttgcggcggccgaagtaggtggcttggctttcgtcctgggcgatttctgccagcttgccttgggccagttgcggcagggcgtcacgcagcaggttggtggcggcgtcacgcagtttggcgtgcagggtcaggccggtgtcggtgcggtcgatcacgactttctgctgggccaggatcgcgccggcatcggcacgcttgaccatgcggtgcagggtcacgccggtttcggtttcgccgttgaccagcacccagttggccggtgcgcggccacggtatttgggcagcagcgagccgtgcaggttgaacgcgccttttttggcggtggccagcagggcttcgctcagcaggttgcggtagtagaacgagaagatgtaatccgggttcagcttggcaatgcgctcgatccacagtgggtggttggcgtcttccggtgcatgcaccgggatgccgttgcgggcgcacagttgggcgacggagccgtagaaattgttttccttggggtcgtcggcatgtgtgaacacggcagcaatttcgtaacccgcattgagcagggcttcaataccagcacagccaatatcgtggtaagcgaagacaacagcttttgaattcatgacgaaacctgatcggaaggagaagtagaggtggtggtatgggaggacaccaggccgtcaacgacgaccactggagccggtgctgccggttggttgcgcagcactttttcaatgaagaaacggggacgggcgcgcacatcgctgtacatgcgccccaggtattcacccaagaggcccatgccgatgaactggccaccggtgaacacgaagagcacggcgaacaacacgaacatgccgtcgccggcccactgggcaccaaaggccaggcgcaggatgatcaacgccagggcgaacagtacgcccagggcggccaggctgaagccgacaatcgacaacaggcgcagcggcgtggtggtcatgcaggtcagcaggtcgaacatcagactgatcaaacgcatggcgctgtatttggactcgccatgttcacgctcggcgtgatgcaccaggatttccgtggtgtggcgggcaaagccgttggccaggatcgggataaaggtgctgcgctcgcggcaggcgagcatggcgtcgacgatggtgcggcggtaggcgcgcagcatgcagccgtagtcggtcatggccacgccggtggagcgttgcacggccaggttgatcaggcgcgaaggccagcggcgaaacgctgaatcctggcggttgttgcgtacggtggcaaccacgtcgtagcccaaggcggcttgttcgaccaggcgcgggatttcttccggtgggttttgcaggtcggcgtcaagcgtgatcaccacctcgccccggcactgctcgaagccggccatgatcgccgcatgctggccgtagttacggttgaggatcaccgccactacgttgctgccgtcttctgcggcggcgtcttccagtaattgggcggaattgtcgcgactaccatcatccaccaggatgatttcgtattcgtaggccagttgcttgcaggctgccgtcgtgcgacgcagcaattcaggcaggctctcttgttcgttgtagaccgggataacgatcgacacgcaatgaatagggtagggtttcaaagattcatgacctcggggctagagcaggttggagcgtgaaaacagcagtcatcagcggctgagcgttcagaaaactgatagaacctggcatgggttggcggtgtgcattcgacgttcctgggactggcaatggtttcttccttgggcaactgcagtaaagacgaaaagtcgcaaaggtaaagcgtaatcaacaggttagtcgcaggacacacggttcgttctcaagtcctgcggtcaagattaagcggaaaattgttgaacgaatatgaaaggcggatgaaaaactcgtttatttgacaggtagacagctagggttcagctaagtaatagagccgccggcggtctcctttgatgggtaaaaccagggcgttttttcgacagtactgtgtgccgccggttttattcaacaaacttctctgcattggccctcaagtgccggtaaagtaagccatctcttgccagggtactcggatgaatagcgtgcagcttttacgcggccagttgcggcccgcgttgatgggattgttgatggctgtggcctgtgtcacgaccgtacgggccgatgacggggttgcgctcaccactgtcgatcaagttccggaaggcgttgaagtgcgcggtaaacaggtcgcggcctacacctgggacgaccgccaaggcaagaacctgctggtgctcgccgagcaggtcagcgagcgtgacgatgacggcacccagtcggcatttgtctacgcggcccagtatttgttgggcggcgaccatcccaagcgcgtgtggatgctctacgacgatgtgcagcattgccaatttgacgcggcgctgcgcttcgacatggcggcgaccaaggtcactgaccttgcgggggatggcatcacccaggccaccgtgggctattcgcgtacgtgcaccagtgatgtcagccccaacgaattcaagttgatcatgcatgtcggcaagtcccagaagtaccgcctgcgcggcgtcgaccgcgtcggcgcaagctggtgggacgaggaagccggcgcgttgcgtggcatgccgttgcccaaggattgcagcgtggcggcgcagcaggcactggtcagccagtacaaggaacagggcaccgaattgcctttgccgggctgctatggcgatgaaaaagacttcgccaaggccccggacagctacctggcattcatgcgccagcactggttcgccttgatgcaaaagcaagacaccgagtggagccaatcccagacccagccgcagcccgaagacccgaccgaggatgacgaatcggccccgtgattttgtgccagggccggtcctgcgttagactcggtcctcgccaattcactaaatacctcgattaaacaatggcttgcttgaggtatttaatccaaaggctgatctaccttgactgagtctattcgcaacccgctgaccctctacctcacccgcctggccccctccagccaactgaccatgcgctatgtgctgcaggatgccgccgaccgcctgggcttcgaagacatcaacctcgaagacatcgactggcacctgctgcaacccgaacacgtgattgccctggtcgccgcgctgcgcgaagacggctatgcgccgaacacctcatcgctgtacgtgaatgcggtgcgcggggtcatgaacgaagcctggcgcatgagcctgatcagccaggatcacctgctgaagatgcgctcggtcaaagccgcccccggcacgcgcctggggcaggggcgcaacctgcggcgtacgctgatccgcgagatgatggacgtgtgcgccgccgacccacggccccagggcctgcgggacgcggcggttatcggcattctgtatggttcgggcatgcgcaagtccgagtcggtgaacctggacctggcgcagatcaacttcgctgagcgcagtttgcgtgtgaccggcaagggcaataaggagttgatcaagtacgcgccggcctgggcctttgacaagctgacggcgtggctggaatttcgccgcgaacagctcaaggagggcgagcaggacgacgccttcctgttcaatcgcatccgccggggcagccacatcacccgcgaacgcatcaccaagcacgcgatttactacatcgcccgtcagcgcggcgaacaggtgggcgtgaagatcatgccgcatgacttccggcgttcgttcatcacccgcgtgattgaagagcatgacctgtcgatcgcgcagaaactggcgcaccacaccaatatccagaccaccgccagctatgacgtacgcgacgacaatgagcggcggcgggcggtggatcggtttgatttgtagcttcgactaaaactgtggtagccggctttcgtggcgagcaagcttgcttgcgctggggtgcgaagcgcccctgaaaagcctgcgagcgctgcgcactcgagcgggagcaagctccctcgccacagaagccagctccagcgagtagagcttatagaatgggcttgccgccggtcaccgcgtagcgcgaaccggagatgtagctggcttcatccgaagccagcaacacgtagatcggcgccacttccaccggctggccggggcggcccagtggggtttcgctgccgaagcttttcacgtcttcatcggtcatggtcgagacgatcagcggtgtccagatcgggcccggcgccacgctgttgacgcgaatgcccttgctgcccagcaactgcgccaggccaccggtgaagttggcgatggcgcccttggtcgcggcataggccagcagcgtcggcttgggcatgtccgaattgaccgagctggtattgatgatcgagctgccggctttcatgtggggcagggcggccttgcagatccgaaacatcgcagtgatgttgatatcgaaggtcttgacccattcctcatcctcgatctcttcgagggtttcgtgggtcatctggaacgccgcgttgttgaccagcacgtcgatacggccgaactgttcgacggttttgtcgaccagtgcctggcagttggccttttgcgcaatatcacccggcagcagcaggcactggcgcccggcttcttcgacccagcgtgcggtttcctgggcgtcttcatgctcgtccagataggaaatggccacgtcagcgccttctcgggcgaacgcgatggccaccgcacgaccgatgccgctgtcggcaccggtgatcaaggcaatcttgttagccagccgaccggagcctgtgtagctctgctcgccgcaatcagggtaggggtccatttttttctgcgaaccgggcacggattgggcttgcggggcgaagggtgggcgagggtagtcagtcatgtgtgtctccatagaacttgaagggtgctatggggttagtagttttaccggcggcgatagttgtgatggatgtggggcacgcccgacgaatggtttcgctgacgcgcaacgggattcagccgaagctgaccccgccggcgtagggttcagcgcacgggcggcgtgtgcgccaagtgggtgggtaaacgacgcagcgtccacagggtgaccaacatcgcggcaaccgcacacagggcaatgccaatcaacatcggcgccggcgtgtggtcggcgaacacgcccaccagggtcatggacaccgccgcggtgatcatctggatcgcccccagcagcgccgacgccgaaccggccacggcgccgtgatcctccatggacaacacaccggccgccggcagcaacaggccgagaaaaccaaagccgataaacagcaaggccatcatcaaggccaggttgtcgctccacacggtggtggcggccagcaaggtcatgaccacggccacgcccaccaccgaccagcgaatcagcggtgccaggccaaagcgtgcgctcaggcgggcggtcaactggctcatcgcgaaaaacgacgcggcgttcagcgcgaaacacaggctgaactgcgtgggcgtgaggccgaagtattcgatgtagacgaatggcgcactgccgataaacacaaagaaggtcgccaggccaaaaccgcagaccacggacaggccggtgaataccggatcgcgcagcaatgcgccgtagctgccgattgcactgcccagggtcttgcccaggcggcgctcggcgggatgggtttcgggcaattgcacgatggtcatgatcaggcacagcacggccactaccgccagcaccgcgaacacttcacgccaactccagagcgaaatcaccacgctgccggccagcggcgccaggatcggtgaaacactcatcaccagcatcagcaacgccatcaagcgtgcggcttcatggccggtatacagatcgcgaacaatcgcgcgtggaatcaccatgccggcgcacgcgccaaacgcttgcagggcacgaaaaccgatgaggacctcaatggtcggggccaacgcgcaaccgacactggccacggcgaaaatcaccaaaccggcatagatcggtggcttgcgaccgaacacgtcgctgatcggcccgtaaaacaactggcacacaccgatgatcatgaagaacaccgtgaggctcatctgcaccgccgccggcgacgcctgcaggctggcccccagggtcggtagcgcgggcaagtagctgtcgatggcgaacggaccaatggcggtgatcaaccccagcagcaaggcgaggtgggcaatacttcgaggcatggggttttccgggtcacagcaaaagatcggccagcttagagagcgccccttgggtgcacaaggtggtgattacacagacgctacattttcctgccttcgcagtttttctcccgcagcgaatgcgacgttgatcgcccatcgtgaaaaatagattgaatattcacacctaatgttatttaaataacaaaacaagagcgcctcgacctgcctggtcgtgccgcaacaaggtggagtagcaatgagcaagatcgcagtcatcggcagcaatatggtggatctgattacctacatcgaccgcatgccggcccagggcgaaaccctggaagcgccgggctttgccctgggttgcggtggcaaaggcgccaaccaggcagtggcggccgccaaactgggcgccgaggtagtgatgttgagcaaggtcggcgacgacatgttcgccgacaacaccctggccaacttccagcgctttggcatcgacacccgctatgtgcagcgggtgcccggcgtctccagcggcgtggcgccgatttttgtacaggccgactcccacaacagcatcttgatcgtcaaaggcgccaacgcgcatttgttgccggcggatatcgacgcggcggccgccgacctgcgtgagtgcacgctgattgtgctgcaactggagatcaacctggagacggtttattacgccatcgaattcgcgcaccgccatggcatcgcggtgctgctcaacccggcaccggccctggccgggctgagtgccgagcatctatcacagctggatttcttgatccccaacgaatcggaactggcgttgatcaccgggctggtggtggactcgccggactcagcccgcagcgccgcacgcaccctggtcgccagcggcattcgtcacgtgatcgtcaccctcggcgagcagggcgcgctgtacgtgggggaggagggcgagtttcaggtgccgggccagcgggttgtcgcccgtgacaccaccggcgccggtgacgcatttatcggttgcttcattcaacactggaatcaccaccgcaacattcgccaggccatggagcaggcggtggcttattccgcgtgctcggtaatggcgctgggtacgcagacttcctaccccgacagtgcagcgttcgcacgcttccagcaacaacgctaaggccttccattcagcccggagaacaataatgaacaaacctgcgctgcaacagacacccgatggtttttacctgaaccgcacgccgtggttcgcctttatcctgctgtgcagcatttttgcgttgtgggctgcggcggcgagcatgaacgacgtgctgatcgcacacttcaagaaggcgtttttgctcagtgatttccagactgcctttgtgcaatcggcgttttacctgggctacttttttgtggcgattccggccgcgatggtggtgcgccgcttgagctacaaaagcacgatcctgatcggcttgttgctgtacatgctgggctgcctgctgtttttccctgcggcgtcgtcagccaagtacgggatgttcctgctggcgctgtttgtgattgcagctggcttgtcgtttctggaaaccgcctgcaacacctactcgacgctgatgggcccacgggaaaccggcacacggcgcttgaatatctcgcagacctttcacccgttcggcgcgatggccggggtgtacgtgggcagcttcgtgatgttcaaggacaccgacgccaccacggcacaactgcagcagatgagcgccactgaggcggcggtgcagcaactgcaaatgatccagtccacgctgctgccgtataagtggatgatcgccgtgctggtgctgatgtttattctgatcgccattactcgcttccctgcctgcaaaggcaacaaagttgtcggcagcaagccgggcagcattcgtcaaagtctgggacggttgtggcgtaacccgcgtttcaccttcggcgtgctgacgcagtttctgtatgtgggcgcgcaggtgggcgtgtggagtttcaccattcgcctggccatgcaaatgggcggcatgaatgagcgcagcgcttcgtggtttttaatgacgaccttcgccgcttactttgtcggcaagctgatcgccaacctgttgatgcggcgcctgcacccggccaaggtgttggcgatctacggcgtgctgtgcattgtgctgctggcctacaccattctggtgccgaacatttcggcggtgtatgccgcggtcggcgtgagtatatttctcggcccgtgctggccgactatctacggcctgaccatcgatgggttgggtgaagacaccggcgtcggcggttcattgctggtgatgagtattgtcggtggcggcgtgattccgatcttccagggcctgttgtccgacgccagcggcggcaacatgcagctggcctacagcgtgccgttgctgtgctttatcgtgattgtgatgtacgcgctcaagtgcctgcgccaatcggacgctgtgccgtcgggcgcagcagtggtggcctcatgaatacgcgtatcccgctgtatcgtgaggtgtttgccgagccggaaaagatccttttgcagtctgaggacttcaaggtcagcgcctggacttacccgtccggcgtgctggccgtgagcctggaaaacagccgtgggcgcctggtggtgttgccttaccagggccagatgatctggtcggcagtgttcgaaggttgcgacctgaccatgacccacttgttcaagcagcccaggcccagcccgacgattatcgatacctatggctgcttcatgtttcacagcggcctgctgcgcaacggctgcccggcgccggatgacacacatgccttgcacggcgaaatgccctgcgcgccgatggacacggcctggctggaaatcggcgagggttttgtgcgcctgggcggctcatatgaatatgccaagggctttggtgaccgctaccgggcgagcccgagtgtgacattgcgcgccgattcggcgctgttcgatatcgacatggacgtgacgaacctggccggcaaacccatggagctgatgtacatggcgcacatgaactacgcctatgtggacggtgcgcggttcgtcgagccgctgggcatgcagcgcttgcgcttgcgcaccagcgtgccggaccacgtcaagccgacaccggactggagtgcctacatggcgcgcctggccgagcatcccgcccaactggcgagcctcgacgcgccggtattgtacgaccctgaaatcgtatttttcttcgatggcgtgggcacagatgctacgggccacgcgcactttttgctcgaccaccctgatggtgcggcgttctacacgcgttatcagccggagcagttcgagcacgctgcgcgctggatcctgcacacgccggaccagcaagtggcggcgttcgtgttgccgtcgacctgtgagcccgaaggctataacgccgaaaaagccaaaggccacgtgcgcgcgctggcggctggggccagtgcgtcgttcagtgtgaccaccggctacttgaacgcgcgggaacgccggaagttgctgggttaaaccagcaattgcgcgccgttggcctggatggcgtctttgtagacgcggggtattttcttgtcgctgaccacgtagtgaaagtcttccagtgcggcgaagtgagcggtgcgcaccgtgtcgaacttgctgaaatcggccagcaacacacgctgctgggcctggcgcagaaccttttgcttgacctcgacttcattgaagttgaagcacgtcacgccgaattcctggctgacaccggcggcggttacaaaggcccaggtcaggcgcacgctgtcgaggatgctgctttcggcgctgctttcaaacacctggttcttgcggtgaaaggtgccgccacacaacacgatgtggcaattgggtttgttctgcagcttgagcagcacgttcaacgagctgcacaccgcggtgaactccagctcatcagggatgaaatcaatgacaaagggcgaggtggtgccgcagtcgaaaaacaccgtgtcaccgggctgtatcaagcgtgcagcgagtttgccaatacggcgtttttcctcgacgtggcgcgtgtcctggtcggcgacgcggtaatcgctggcctcattgccaacccgggtgatgtagccaccgagcagacgcaagtgctcggtgaagtggttgagatcacggcgcagggtcatctcggaaacgtccagcagcgccgccatttcccgcaggtgaatggcgttctgatcctgcaaggcttgttgaataagcttgagtcgctcggcttttttactgtccacgcgtattccagggcttgattgtttgtgttagataagtaacattaagtgataatattgtaacgcattaatgtgggcagcatgacaattggcccgcgatcattggcaacatacaggcaagggcacgttaaatgaatacgcttcaacccgcagcattggccaagtacatcgatcacaccttactggcgcccgaggcctcccgtgaacagattcgcaccttgtgcgaggaagcccgggagcatggcttctattcggtgtgcctgaactccgggcaagtgccttacgccgcgtcgtgcctggtcgacgcgggcgtggtgatttgtgcggtggtgggctttccactgggcgccggcttgagcgacaccaaggcgtttgaagctgagcgggcgattgccgccggggcaggggagatcgacatggtgctcaacatcggctggctgaaggacgggttgttggacgcagtacgtgaagacatcgccttggtccacaaagcctgtggtgccgtgccgttgaaagtgatcctggagacctgcctgctcaccgacgcacagaaagttcaggcgtgtgagatctgccgggacttgggtgtggccttcgtgaaaacctcaacggggttcagcaaaagtggcgctacagtcgaggacgttgcactgatgcgcaaaaccgtgggcacaggcgttggggtcaaggcgtccggtggcgtgcgtgattatccgacggcggtgaagatgatcgaggccggcgcgacgcgtttgggcagcagttcgggtattgcgattgtgggcggagcgatgacggcggcgagcggttattgatcggttttatataactcaactaaatagacatttagttgagttatagtttttgtgcatataaataagcctcaagacgaggcgagggcggctgttcgacgcgcgctgatacgttcaacggtttgcatgtgctccgtgccccaagtgcacaacgcacccagcgccatggccaaggaatgaccgaacggcgtgagtgagtattccaccttcggcggcatttcctggtagtcgatgcgcgaaatgatttcatcgcgctccagctcttttagttgctggatcagcaccttgtcggtcacgccacctattgcgcggcgcagttcgccatatcggtgtacatcctgcgccagatgataaaggaccaacggcttccatttaccgccaatcaccgccaggacggcgcccagaccgcagttgaacgtgttattcgacatggcttcgctcactgaattgggtacttaccaaaaggtgcatactattcaaaataatagcgtggatctacagtcgggcctcacattctcgggagttcatcatgagcaggctcaacggcaaaattgcagtgatcaccggcggcaacagcggcattggcctggccaccgccattcgtttcgcagccgaaggcgcacaggtggtgattgtggggcgccggcaggaagaactggataaggcgctacggctaatcggccctgaagccatggccattcagggcgacatttcaaacctgggcgacctggaacgcatcttcacgcaaatcaaagcggataaaggccgaattgacgtgctgttcgccaatgcaggcttgggtgacttccagccaatcggctcaatcactgaagaatcctttgatcgcacattcggtatcaacgtcaaaggcacgttgttcaccgtacaaaaagccttggcgctgatgagtacgggcggttcggtgatcctgaccggctcaaccacaggcaccatgggcacaccagcgttcagcgtctacagcgcgacaaaggccgcactgcgtaatttcgccagaagctgggcgctggacctgaaaggcaccggcattcgcgtcaatgtactttcacccggaccaatctcgacaccgggccttgacctggcgttgtcaggtactggccagaaagatgcgatcatcgacgacatgacgggacagatcccactgggccgaattggccaggcagaagaagttgcggcagcagcgttgttcctggcgtcggatgagagcagcttcatgaccggcagtgaaatgtttgtggatggcgggtttgcgcaggtgtgaggtttaaaggggttttgcccgttgaaatctgatgggtacagcccctgattacgtaacacgacattacgcataatgtatattatgttaaattatgtgtctggttatggatgttcatgaggctcgtaaggcgctgattcgacgaacccgcttctggcatccattctctcaatgggccatgtccttcgtgttcatggcgagtccttgaataaggtgactgacgattaagccgaacgcgatagatcgcttgtacctgcatttgacagcccgccatacggatccggtttaagttgaacctctgttactcaggtggactcccaagtctaaatccaggagaaacgtatgacagtgctctgaagtaacaatagccctagattccctctcaagcgccgaatctggacgatgtacgccttaaacaccgattccttcaaatctccgacagcttttccctctctgtacgctctaggttgcatttacttccaaacctcgcagatctatccatttggatgagagaaagcgtgaaatctcgttggcctacacgtctacgcaaccatacagccgacgatacttgtaaaaagtatagtccatggctgatgcttgcgatccccgcgtgagggctcaagttacatgtatgcccagacctgagttttacgtcaaaaactcaagctttagcatcaggattccttcaaagtcacatgccgtagcaccaaacttccttcaaatcgtatgccgtagccttcgtttctcttcaaaaccgcatgccttagcatcaatttctcttccggtaaggattatcaaattagtacttctggtcggaagtttggtgagattttcaacccagcgggctctcccgacagcgatccctcaagtctctattgccgaggccagcaagcgaaacccgttcagcagcgtgccgaagtccaccaaatggatcccgttgtattgcctagccgcttctcggtaacctatgtaggcagccgcttcatccacgttcgccggcatgagcccggcaaccacgacgcaccgcggtttttggatctgtcccggaatatcaggccgcagctttcgaccttcctctatcgcagatgccaactcgggatggggtatcaaccttcctggcggctccccagaaccttgtaggtcagaatcaccaatacgacctgagctgtcacgtatcatgagcgtcgcatgaggcgacctcacagtcagcaccaacgcttcatgcccgtaaatgattgggctcccgacagcggatttgggttgcgcacccagcggcggatccagcacgccgcagtccggatgctgcaagcatttgacgaccaaatcgatgttatggctcaggaacgattgccactcggttgcgctgaggttttgcgccagcattatttgataatggtggatcatgcggtatagctcgccccgatccatcgattcccgcattgccttgaagtcttctggcatccccagaggcaagtcccgaatgtatgcttgcagtgtcgctagataatctcgctcggcttcactaaacccgctgagataatgacccccacggtcaccagaatgtttgagaacaggagctagcttttccacaatttcttcgtaaatgtatgacctgcgtgacccctctttttgacgattccaaaaatcatcgccagtgttgaacgccgtcctgagatcattgagggtggcttccgaaacgcacaccacgttctcgcgtctgaacaggtcgccttcgaaatgtatttcaatggtatcgacactcttgtcgatctgaagcgcgctaagtaccgcgttgaaggatgccttgaaccctagccccttggcgcaggtattgaaaatcccggagtcgaatacgcgttcgatgtgagacaccaccgagctagtttcgcttggcagttgcccagcaaagggttttggaagccgatatacgatgcgagggtaaggcttcctctgccgcgtatattctgagatgaagcgggggttgatgactgttggccacgtctcgattcggtctgcaaaaatcctcgcaagcacatgcgagtctgcgcccgatgagctatttgtagggtgttcgccggccgtcgaagacggcactgatagctcgacgtaaaaagctcgattcacgaccccttttcggatactaggctctggcaagctcttcgcccgttctcgctgttgcttcttcgtttgggaagactcatcactgccatctttcacgcgccgctcccttagcctggaaggctgactaagcatcatcacggcaccaagcgccggatatctcaaatattgcgcgagtagctaataactttcagcgcctcataacgggggatcggatcgtgtcgccgaaccgccacgtaccttaatcgagctgtttcacggttacctgaaagtaaatttgtcgaaacgatttcgtatatagctgccccatggattggccattggggagtagaattatgaggatagttctcagcagtgctccgtcaagttagagcgatgaaaaagttatgaatccctgctcgccactgaccaagttctcggatctcgctagttagtaaactcagtgtactattcttgaaatggagtcaataaggcaggcaaactaatcgccactgcaggtttgtagatttcttctgcaacgcatcgagggtgaaatatcatctttctgatcaaaagtttcgctttgaagcctgcggctggacttccttggtcggcgttgaggacaaatgccagactgtaaaaaccctaaaacggttatcttccagttacagatcacaagcgcttcatcagcgcatccagctttctctttactccaatcttcgaattcagtcgcagcgcctcctcataacacccgatagcctcgcgagcttgcccaagcgcctcatgggctaacccttgcaccttcaacgctgtcggcttccacgctgggttatcgtccgcccccaacgctcgagatccaatcaccgcggccaaaatcctttccaattcggacacggagcatgcaaccttcagcatggcctcggcagttaaaatcacgtccgtatagttggttgagctcagcaaggctgcatccgcggcgtcttcatccaccaaagccccgtcagcaccgtaacggtactcgcctcctcctgagaccttgaccaccaactggatcaacttctcatcaaacccaatacgctcaaaggcacggtgcggcgtcacggcgaaaagctccacgccttctttgaggtcaaacagagcgagcttacgcccatcctcagtagggctgtttgcggtgaggcaatacgcaaggaggccattgcgcgaaatcccactctgcagaatattcgcggtcagcgctttggtaattatcggtagcccctgagaagtgaagacgtgaaatgtgccggacagcgtgctcccgaagtgccagtcctccaagcagaagctgccgttgtccgcgactgcgccattgttcggacggggcatgcgggcattaaccacgatggcgttgttgatgaggtcgaccaggatgtacctgccctctccctcctctcgatgcccgccacgccggccatctggcgtcgcgtcattccaggaaagcacccaagccttccccggcgactgcttacacagaccgtggtagttaatggatggcgccgtaaggaagccgccagcgatttccacaggcttttgatcatgcgtcctagccatcgaggcgttggctttcgcataggcgtgtttaccagttagccaggcccatatccccattttgattcgctccatgagcccaggcattacccgggcgtgtcccttaacaagagctgtcaggatgcgtcagagggtaggactgatcaagccaagtcgatcgcggtggtcggtagcttcttcaacttaaatgcgacgagcagcgcggccagaagaaatgcccccatgaacgcgcccaccccattccacccgcctgcgtggtaagcaaagccaccaaggctaccgacgacgctcgatccgacatagtaggaaaagagatacagagacgaggcctgccctttcgcgcgcacagtgcgtcggccgatccagctgcttgcaactgaatgagccccgaagaagccaaatgtgaatacaaccatccctggtaaaatcacggccaccggcgacgccatggtcagcccaagtcccgcggccatgaccagaatcgataccatgaacatcgagcgtcgcccgtatttatcggctagggatccgaccttggcggagctgtagatgccggccaagtaggccgcggagagcaaccctaccaacgcttggctcatgtgataaggctcggccaatagccgatagccaatgtagttgaacattgtcacgaagcttcccatcagcaggaacgcttcgagaaacaaccatggcagccctgcatccttgaaatgcacagaaaatccatcggtcaatgctttagggttcaggcggatcgggcggaaattacgcgatgcaggtaagaacttggcgaataggatggctgaggctagcgcgatcccgccgatgatcagcacggctacgcgccaagtggtgaaatcgaccaatacgccactgatgagtcggccgctcatgccgcctacggcgttccccgcgatatacaaacccatcgccaatccagtgtgcttgggatggatttcttcaccgaggtaggtcatcccaaccgccgccagtcccgatagcgacagcccgaccagcgctctcataatcaaaatttctgtccaggtaggcacaacggcgctgagcagcgtgcacaaggccgcgctgaagagtgcggcgaccatcactggcttgcgcccgaccgcatcggaaatcggcccggtcactagcatgccgatcgccatgagccccgtggagatggaaagtgaaaggctcgcctgggcggcgttgagtgaaaaatcgtgggacaagatcggcatcaggggttgcacacagtagagcagtgcgaaggttgcgaatccgccggcaaacaatgccaaagccgtgcgcataaactcagctgtccctttttcgatgaacgatgcagatgagtccccgaatgttgaggttgcgggtttcaatggggtacctcggaagtttcaggctcaagatgccctgaagggtaaaggggatgaaacgtttaatccaatatactattcgacctgattgatatctagcgcgtatcgtttgctattgccaatggcagcgttcgagatatacaaactcacgactctaaaaaacatcgcctagatagaaaggccaactgattaaaagctagtaacagcccttactcccttcatatactgataagaataaaacagcaaaaacaataataagaaggacgcacaagatggcccagacaacattcagttttcgcaccgtaacgtccagaaagggcgactatgaagtcgcggatcattcgattgagagaaaagaaagccgcaagctcagcagatttcaggcgctcggctatctactgtgttgggtagacgcgctcgcggaagatgaatcagatccaggtcgctcaatcagcgcgatatttggttttgatggcgaggttgcagccttgggtttcgaccgctatgacccggttcacattctcacggccccgaactggaaaactcgaatgcttgccgcttggtgcgttatcggggccgatgagcgagctattgccaaacagcttgattacggcgatctgcacaactactggcccaacaccgagttctgtagcccgggttttgatgaggaagccacgcaatgggcttctagcgctagcgcctacgacgattccgctgagttcaacatctgtgcttatgtcggcagccctgaccggccccagttgattttcaaacccgagagcgctgaccactcgcccgcctaaaactcgaaggagccgccgcacgcaaacgggccgcggcggccctagccccctgagcgctcaagcacctacagtaatcacattatccacagtgagccgtgcacgttcaaaggcaggacggagccgatcagcgcagcccaaaccccatccgcttcagctcctcaaccagctcttcccgcccgtgcaggttcgagacactgcgaagccgattgaccacctgctccgaccacccggaagccttcatgccctcacgctggtagaaagcgcccaagcgctcatcgtattcagccaccgcttccacatctgccgctgccgagtaggtctcgtggtgaagcactgcgccttgaggcagccgtggttttacctgcgctggtcgctcggtagatggataacctacgcagagaccgaaaaccggatagacctgcggagacagaccaagctccttggccacgccttcaatgtcgtttcggatggcgccgatgtacacactgccaagtcccagagactccagagcgaccacggcgttctgagcagccaaggccgcgtcgatcgtaccgagcaacaggctttccaagtaaggcactgcttcgagctctacaccctgctgctcagcaacgcgggtgaccctggacaggtcggcgagccatacaaagaacagaggcgcctgccggatgtaggcctggtttcctgccagtgccgagaggcgcgctttccgatcgctgtcctgaacagcgacaacgctccagacctgcaggtttgaagaggtcgaagctgattgcgccgcggcaaccagggtctctatggtgccgtcaggcagtggctgatcagtgaaagcacgaacgctgcgatgatcgagcaactgatcaatcgtctcgttccagggcatgagaggcgagatgtccgcggcgccgtagcgggaagccagttttgattgtacgttgactgtcattctagatctccaaatagagtccgaggctaccaaatcgacggcagtgcgacacgcttcgcgcgcgaagtttcatataccatggggcccacacagtcccacaaaggcacgtttcgattgtcagcaaaaccgcttactgcccgcgaggcctatcaggtgcttcgcgacatcgctttgggcgttcgcaccatgcgccgcttgggtgagaagtcatggactgaaatgtacagcggcatgatgaccgttgaaaccgatggctgggtcatcaagttctacaacgattgcgaaactctggattactgcgatagctgctatcgcccagacggtcgtgcgtacacttttgactcatcgcagcaatttggtactgacccggtcgagctactgagcacgtgggaacatggccaactagagaagctgctcgccgatctttaataggccgcagcgctccctcgaggacatcttctttcaagatcgcgtccggccatatcttcagaaaatatctgggaggtcggccggagctgcgggcgtcaggtgctgggccagcatccgcagcttgcctagcagctcatcaaaggtaacgacctcgacatctttgcaggcgttgcggaatatctcgaagctgcgccggcggccttcctctgttggcttggtaccggcaatgacaacgcacctcgctgtgtctggattcaagtctcgcatcgttggatctcgaaggtgcgacagccagttggagcgcatcaggccttgctgatatagcacctgcgtaattgctccactgagctgcaaattcgggccgaagacatcctggttgcgatacggtcggctttgcatcaaaggggtggaaggtttcttgatttccacgatggccagttcgcgtccttgtgagaaaagcagatcgccaatatgagcgccagccccattgatcgtggagccttgggcatggaactgggtatgcagaagcgcaacagggcgcgagaacaccatcgctaggatgaacaggttggcctcgaaaaaatgctgccagtggccctcgctgaggttctggctcagcatgctctcgaacttttcgatcattacggccaaggtgaccctctcgatctccgcgtgcaattcgaatagttcgcgaggcgcttccttcgccaacatctcagcgccgaccttcacttctctgagctgatgacgccgcgcccgcacagccgcctgcgcaacttgattactgactctgcgaggggtcgtatcgctcgccagcactggacggctgccttcaaagaccacattgggcatcagcgtcggaaacacttggctcagcacccaatgcatctgggctgacgtctcactcttttttcgagcccgagtgatccgcatgcatgttctacggcattcatccacccgtgcctcgctgacaaagacgacgtcgtctgtgatcgaggtgtcaccatcatccgatatgactagggttttcaggctgggagcgaatcgcagccctcgccagagcggcgtaagctgtttagccagccccaatccttcctcacagggatcaaacagttttcgagggaggctgacgtcgatgtagagcacggcgtcctctggagtgtctggaagatcgcgcgtcggctgatggctgtacaagatgcagcccacgtttccgttcttcgggctccgatagcgctgagtatgggggttggtgtagatgggatacatcgtgatccaacccggctcgatcgtggctagccgatgccatctgtcttcgggcaatgactgccatttatctgaggagattttgtcaaaaacctgaaggtacaagtcaatgcaaaagcccgcttccactggccgccggatgatgctgaaactaggctccaacacgtcctccccgttccatgtgtcctgcaaggtctgctgagtcccttccatagtgctctccatgccaaatgttgttgaaattattgatcgctcggtcttggaagtacgcgcggggtcgaccacagatatccccctattgccccttcttgaatcaaacggcgcgcaccaggctcgcatactcacggcgctacggaaggcgatgacgccgtgactcaatgaccaactgcgcaaattgaaccaaatcccgcacgccccccctgcccgacctgcccaaatgaaacccaagcatccctactgccctgggcccatcttgatcgcacttcagcgaatcgcccaccatcgcgacctgctcactcttagcgccgaacagatgccctggcttcacctctagagccctgcagatggactgatagatcaaggcgtccggcttcatagcgccaacctggtagctgaaagcgtacccatcgagatcaggaaacgcttggagcaccgcagccccataaggctcgcaaaggttggagcatatccccactcgcacgccctctgtgcgcagcaaagccaccgcttcaattccatcctcgaacggagtgatagatgcgacttcgcgatccagatcgtcttgcaacgcttgcagtcgagcgagtgatacgcggatacccagttgatccgcagcatccttcagcgaccatgggttgctcatcagcacccgcaaatcctccgggctggctcggcggccaccgacgatcccttccttaagtaattgcctgaaaggatggcgcttgcttcggaggtcaaccagggtgccaaaggcgtcaaagacaacagctgaaatcatggatttacctaatgggttcgcacaggccaaaccgtcggaagcacgtaccgtggactggcatatgaccataccttccccacagcatttgtcgagcggcggcaatcaataggatttcaccggcctacaacactgttagcgcgtaacaggcgtcgcaagtatgctgcgtcgttgtgagaatggcggtacgagcggtattgccggcgcaggccgctgtacatcaatcaaaggagtacaaatgtactccatctcggctttaccacatttttctgccattcaaatggacgacagccgggcacgttcccgatccacaaggagagtttgagccggctctcccactcgaatacttcaaaaacagcagcagaaatttcaagcgcagcttcacgactcagcagcctttccgctccggaatcattggttcatatcagaattgcagcgcgttagctccggcagaacctgtctttggcactgtcagacttcagagtcgcgaccaccccttacacaaacgagccccctcaggcaggtcgtccagccgtcgttcgaaactggctgatagccatttttccatgtactgtatatatatccagtatcacaagaaatactccaatgaacctcatttccctacgccaaatcaccgaatctgaactgcccaccctcctccaagttctttcgggccgagcctcgggcggctttcccagcccagcggccgatcactacgaagccccgatctccctggacgaccttgtagacctcagagccccgcacgtctggctgggtgaaaccgagggggacagcatgtcgccggcgggcattttgaacggtaccaagctcgtcatcgacagagcacggacgccgcaggttgggaatgtggtcgtcgcctacatcgacaatcaacccgtggtcaaacgtctggatcgacagctcaatggtggctggatgctgagctccgacaaccccaagtaccctccgatccagggcctcgaggaaatcgaagtctttggagtggttacttggagcctgaccgtccatgtcccgtaagcggcccacctatgcactggtggactgcaacagcttttactgctcgtgtgagcgcctgttccgtcccgagcttcggcaagtcccggtcgtggtactcagcaacaatgacggttgcgtgattgcccgaacacccgaggcaaaggcgctcggaatcaagatgggcgatccgttcttcaggatccgggatgctttgaaagcaaaaggtgtggtcgctttctccagcaactatgagttgtacggtgatatctcctcacgcgtgcagcgcaccattgaatccttggccccgcgggtcgaggtatattcaatcgatgagagctttgcggatctcactggcattgccgagccgcttggggatttcgcgcggcagatccaggcgcgtgtccggagctggacgggtatgccagtgggcatcgggattggccacaccaagaccctggccaaggcggcgcaacacgcgagcaaactgtacaaagaacgcaccggcggcgtggtcgacttgcgcgcagaccatgcggtcgaatggctcctcaaacggatgccgacgcaagaggtctggggcgttgggagacggatctcggtgaggctcgaggctgatggggtcacgacagcttggcagcttgcgaacaccgatcccaagacgattcgccagcggtatggcgtcgtgctcgagcgcacggtacgcgagctcactggtgagccgtgcatcgagctgcaagaggcggagcctgatcgacaggccatctgcacgtcccgaatgtttggtgagcgtgtgacgtcccttgaggctatgcgagaagcggtggctagctacatgcaccgggcgacccagaagcttcgcaagcaatcgtcactgactgccgtgttccgcgttgctgtgctcacatcaccgtttggctacgggccgaagtacgcgaactcggtgatgtgctatccgccctacccgactgatgacgtgcttctactgacccgcgccgcgatggagggtttggaggtcatctggcgtgatgggtatcgatacagcaaggcagagattttgctgatggatctgcgtaagcgtgacgagttcacaggagacctgtttaccccttcacagccagccaggtcggacgagctgatgcgcgtcttggatcgtatcaacgtgaagtttggcaagaatgctctgcactctgggcggatgccgatcgaagcggcgtgggccatgaagcgcgagatgatgagcagaagctacacgactagtatcgaccagctcatgcggtttcaggctacctaaccagtctgccgtcggtaccgctgagacagtcgagagccgagcgtctctatggtttggtcaaccagcgacgttacttttgacgggcgatgtcagtcgcatcttcatcgtggtaagaataccgatggacgtactacagggatgcccatgcaaaaatccattgaagccgttttctaccagtgcgaacacacaggggcttttctcaaaggccccgcggctgtcgtgaacattttgaaatcccattacggtgagagctgtggagccgcgccctacaccctgagtcatttcagctcgattttgggctacaggtttatcagggagggtgtcacctgtttcataccgcagagcaagacccctccctcttctgatggcccacttccgtttgcgcctctgctggcaagcaaggatctgattgttccgccgctgctgatgccccgccacatgatgctgatttgcgacgcgatcagggcgaacgagagaaatcccggcggcttaaccgtggatttctgcctggccgtcatctacacgcccagcaacatgggcagatacttcgagtcgctattcagcgagatcgattcattcaggccctacatgcaacatattgacgaatgcatccgcgcgtatcttttcggctatgtgtccgttgcggtttccggacttatcctagcctccgaaggcatattgcgagagatcggcgcgaagatcgacagcagatttgaagggatcaccagcaaggatcaattcataaacgtcctgacgaaaatcgaagacatactgatggcaaaggcttacccaggtgttgaggtgccagggttcatgcggctcaaagagtacatgctgggctttgacgaacagctttgcttagttgataacttcagagagtatttcactacccggctttacgaaaagacctctgaggtcgaaggggcaatcgatatgaaccggcatagcgttctgcatggtttgtccatggatttcaacaagccgatcaacttctaccggctgttcatcatgctggtattccttgccttcgtgagcgtgctcctgggacacagccgggcttcgtcatttgttccagaaacagagcgctccaaactcaaaagcgattgctatgacaagctcgcggcgttgggtgcgtcaatgaaagtgcgttttcctatatgacatccccaagccctgacgcgctgttcgccagcaatcgggaaagacgttccgagctacggccaccgaaccaagcccagttccttgagccgtaacgccatggccgagtcagacaccccaaactgcgctgcgagcgaaacaacattcagattattgaaacgctggcatcgggctagtgcgagctcccgctccagggagtctgcagaggcgtacagcaatccctcgatattgtggggatcaaggtggtaggcgaccgtatcgttaaagtgcaggcggtcaccgcacaggaattggcgtctgaaacgatcagcaactagcttcgccggcatcaggaaacaggcagcgaaaaaatctgcctcgcgctcctcacggttgcgcggcccgctcacagggcggccatctagagcccgatccctatgcatgacttcaccctgatgcaggacgaggtgcccgatttcatgtgctcctgtgaagagctttaccgtaggcgagaattcctgagagatggcaatgcgattggcctggcgatcaatcaaaccggcaattttggggcctgaaccacctcggatgaacttgggatcaccgagatcgggaaactcacgatactcaaagccgtaggctagtgctgccttccttggatcacgcgcctgaagtggggtaatttcccgatccccccacagatggtatcggtcgcgccacagcatgcgcagcagctcggatgcttctttttcgatattcgtcatgtccatgcaaatcaccgcatgtagtggctacgacttaatcataaccctagatgtggtgtttacaagcattttctgaccctattgccgagagcaatccgtgcgcaccagctcgtcacctttatacccgctgggctcagcggatgcctgccgtcgcccatctgctcgagtgcgccttgtacaaagcgtcaacgctagcgaaaatttgccgtttgccagcatccccgccagttgctggtgtgcgtctttcaaggttgagccttccacgcttttgagattggacgcgtatacgctcatggtcactttctcggctttctgggggggttaacgcttgattttgaaagcggagatgcaggcgcggctgctacatggctttccgcgagctcactctcaatagcccgctcacgccgcagttgctgattctcggcctgagcagaggtcagcaacagcctaatctcaacttcgcgctcgctacttttggctgcagcctcattgagagcctttgcgtcctgccttagcgcagcaatctgttcctggagctgctctgagatgccgacggatttcgcttcggccagcttcaagccttgaatctctccagtctgagcctgaatgcgggcctcatgggcatgcagcgttttgacctgctgacgggactctcccagcaaccgctcgttgtcacggttcaggcgtgtcaggtcatcctgtttcagcaccagggtttcctgaagcttgcgctgctccacttgggactcatgtagctgggattcatggcgtcgttgatcttgatcgcgctgttccttcacggactcccggtaatgctccagggcgccacgcgcatgaacatgcttctcctcgagggattggatctgtttatccctgtcaccgaccaaagcttcaagatcagtacagcgttggctgatcccggcgttgcgcgtcagctcagcctgaagcgaagactgcgtggtttgaaggtcagctgtttgagcttcgatagctgcttgttgagcgtccagctgccgacgtgcagcggtcaactcagattgtaggccagcgatctgcgcctcaagccccacgcgctgtaaatcgaaagctgatcgagcctgttcgatcgactcatccccctcctccatcagccgatccagaaggcttccaaccatcgctgaaagctcttctcccattcgctcccgggacgacggcgggcgcgggtcaaaggactcgatctccttcagatagcgggaaatagtggtttttgaacccgtatttccaagctcaacacgcacagagtcaatgctcgggtacatgcccttggcgagcaacgactgccgagctttttgtacaactgccttgtttatgccgccgcgcgccatgagacatcctacgatttcgtggtgtattacgtgtcatgtatctacgtagcacgttatcacaaaattggcttctttatcatgctcatcttgaaaagctataataatgtcttatggcttcttcacagtcgaaaaggcctttaggtgccgctaaaagcgtggaatgctgggatcacgcagattctgaaggcgaaacgtgatgggcaagaatcacaagtacctaaaggcaggtacacgtgagaacacccgcaaaagctatcgagctgcgatcgagcacttcgaagtgatgtggggaggctacctgctcactggaatggcactgttcgttgcttttagactaagcgggtgacgtgccaaactttcgctaatcgtgaacggtgggtagttcgttggaaaattacctagcatctgaccacccatttccattcacgctgaccattcatttgcattcgcgctgaccactcaattgcattcgacctgaccagctatcctgccagtacgcttagcgtactgaatccaaaatcgctttcagcgagcacccattcgaacttcaaacctccgtccgcgcgctgaggcgaacgctaacccctccgtgtcgttgccccgtgatttgaccgatgagcatgatccccatcgttaatcccgtcataggcatttgtacaagcaggctgagtgtggttacatctgtatattcgattatccacatattcagagctatagcttatgagcctagcaccacacacattcttcaaatgcctgggggacgagacccgcgctcggatcatgctcatgctttcggctgagggtgagctgtgcgtgtgcgagttgatctgggcactggacgataaccagtcgaaggtttcgaggcacttggcccagctgcgtgcctgcggattactagcggatcgcaggcagggtcagtgggtttactaccgcctgcatcccgagcttgaacagtgggcactggatgttctgaacgtcactacgcaggcacaccagtcctgggttaacgaccatcaaggacggctggcctccatggaagacagacccgtgcgccaagcctcctgctgctgacctcctgacctggaacatacccatgctcatcgctgcgtcgattttcgtagttacgctcgtctttgttatctggcaacccaaggggttaggtgtcggctggagcgcggcagcgggtgccgttctggcactgctgactggcgtagtaagtctaggggatgtgccggttgtgtggcacatcgtctggaacgctaccgcgaccttcattgctgtgatcatcatcagtttgttgctcgatgaagcgggattcttcaaatgggcagcgctgcatgttgctcgctggggcgctgggaaaggcggacgcctgtttgcgctgatgatcctgctcggtgcagccgtctcggcactgttcgccaatgatggagccgcactgattctgaccccaatcgtcatcgcgatgctgacggcgcttcgtttcagcccggcatccaccttggcattcgtgatggccgcaggcttcatcgctgataccgccagtctgcccatggtggtgtccaatttggtgaacatcgtttcggcagatttttttggcgtgggtttcggtgaatacgcttctgtcatgtggccagtgaacctagtggccgtggccgcgacactgctcatgctctggatgttctatcgcaaggacattccaacccagtacgacgctaatcagcttgaagccccagatgcagtgattcgtgaccgggcgacattcattgctggctggtgggtgcttggcctgctgctggttggactgttcgcactggagccgttaggtatccccatcagcgccgttgcagctgcgtgtgcagtgatcctcctggtcatcgcagggaaaggccaaatcatctcgacgaggaaagtcatcaagcacgcaccatggcagattgtggtgttctcgctgggcatgtatctggtggtctacggcctgcgcaatgccgggctcaccgactcgctctcggcgctactgaacatatttgccgagtatggactgtgggccgctaccttgggcacgggtatcaccgctgcgctgctgtcctcgatcatgaacaacatgccgagtgtgctcatcggcgctttgtctatccagggcagcgacgctacaggactgctacgtgaggccatgatctacgccaacgtcatcggttgcgatctcggccccaagatcacgccaatcggaagcctggccacgttgctgtggctgcatgtgctggcgcaaaaaaacatccgcatcacctggggctactacttcaaagtcggcagcatcctcacccttcctatcttgctggtaacgctggtggcactggcgttgcggctgagcatccctgtctaggagaaacccatgaaagtactatttatgtgtacggcaaacagctgccggagcgttctctcggagggtctgttcaaccacgtggccccgagcggctttaccgccgtcagttcaggcagcttccctagtggacagctgaatccgcgcgccgtcagcacgctgcaagcgctgggcatcgatacctcagacctctacagcaaaggttcagaagtgttttctgattcgccgccagatgttgtgataaccgtgtgtgacaaggctggaggcgaaccatgcccggtctattttgggcctgctgtcaaaagccactggggcctcgccgatccttctgacgtggaaggatcagacaacgacgtacaggcagcatttgacgcgacagtcgtccagatcaaagagcgtttccaagcattcttcagcctggatcattcggcgcttacgccgcaagaactgaagcgcgagctagatcgaataggtgaactgtgatggacgaattccctacggatatcagttcggatcttccaaatctggatctgtcattggttgatatccccacactggatctgcttcaggggcacgatcaaccagcccacaagccgcgtattttgttgttgtatggttcgacccgtgagcgctctttcagcaggctactgacccaggaggccgcgcgcatcctgaccctaatgggagctgaggccgttatttttgatccctcgggcctgcctctccctgatgacgctccggaagaccatccaaaggtcaaagagctgcgggatctggttctgtggtcagagggacaggtgtggtgttcgccagagcgtcacggtgcaatgtctgctgtattcaaagcccagatcgactggattcctctcacgatgggcgctgtccggcctagccagggcaagacgctcgccgtcatgcaggtctgcggtggatcacagtcctttaacacggtaaaccagctgcggatactcgggcgctggatgcggatgatcaccatcccaaaccagtcgtcagtacccaaagccttcctggagttcgacgacgcagggcgtatgaagccatctgcctactacgaccgtgtggtggacgtgatggaggaactgatgaagttcacgctgatggttcggggccgggaaacgtatctggtagaccgctactcggagcgcaaggaaagcgccgagtcactctcgaaacgagtgaatcaaagatcgatttgagcgaccaaggggatagaggatgagcaataccacagtaaggattacgcagatttcggacgctcaagccatccaggcaatttacgcaccgatggttgagcgcaccgcgatttcgtttgagcttgagccgcctacagtcgaagagatggccaagcggattgggtcgactttgccgagttacccgtatctggtagcggagcgagacggcaaggtcatcggctatgcatatgccagtcagcaccgggctcgtgaggcctatcgctggtcggtcgacgttaccgtttatatatcgcaagaagcgcgccgtagcggcgtcggtcgggcactgtatgacgtgttgctgccgacgttgaagaggcaaggatttcacgcagcctatgccgggatcgctctgcccaatgatggcagcgtaggtctgcacgaagcactaggctttgctcacatcgggacgtatccagaagtaggattcaagcatggcgcttggcatgatgttggatattggcgtatcgcgctggattcaacgaatccgccaaaactgcccgtgcttttcagtgagatcagtctcttctgaatgagccacgaccagcagatcaagtgcgcttgacccctcaaaaagaaaacccctcagctagctggaacagcatctcttcaacctggcgagttccaacggtgctggtaagcatcgatagtgggcttttacccgagaagcgttctttcggtttggttagccaacgcaccgctttatctgcgtcaccgaagaatgcctcggccatggccgtaatgtgcgcgaaccggtaaagccggtcactttcatgggccgtgaggcgctgtcctcgctccacccttgttttgagcgtcttcagggtgacaatctggtttcgctctctcggttttaaattggcagcatcgcagaagccccagacagcctcagcagggaaacccagctcaatcagctcatgggtgcgctgatcagatgcgtcttcaggtatttggagaaatacatgcaggcgggccctgtacgcaattcgcgttgtttcgcggcggttttccgtaagcatgcgtcacctcggggttaagaacagcaacctgatcgagttccagcggcaggctcgaacaatgactcaacaatcgtgcaatctgaagtggttgacccccagttgcggggatgcgagtgaggacttcccttttggctcatgcgttggaagagatgaagatgacattacaggaggcgtccaatgatgaaatagagtaaagcgcaggatgaccatattcagcgcttaactgcttccgccaaaccaatgcttcggcacaccccctagataacacagttattctttagaagaaaagagcttgattttccattcaaactcagatctatcattggtaaagctgcgtatataaggacgcagttccaaataggtgtatttatcccgctcgtacacaccagagttggaaaccaaaattatttcaactaggtggggctgattgaagatattattaatttttaatcttagccggccatccctcagcatcgcggatattgcgtctaagttggaaacatgaacaactatcacccctggatttaccttggttaattgcttttttgcggcatccttacaggttttttcaaactcccgccaggaggcgttcgtgctgattgtggtaattcgtaagcacgttacactatcatcgccggtggtctgaggcatcatgcacagtaattccatatccgaggacttaacaggaataatacttggtgcgccgtttggaatatccgggacatcaaaatgtacttcagtagtcacggagtatttttcacgttggatattttggccagatgatatgtgctcacagatctcagtgcatactttagcaagcattacaggattttgcggtagcttttcgatcacttttatggtgacgatgctgagttgttttttgctttgctcgtaagtggctgtgaagttgttcaatattccacttgctagcttttgagcctccccagaacttataactaaccctttatcataggaaaaggatttgcattcaacttctactcgattttcatctcggcaagccaggtagtcatatgtctctcccgcatctctgtcatctttgcaatctacattccaaccgtaatgaacaagcgtaaaatatacaaaggtttcaaacgccaatgcgcgcatgtcattagaggcctcaaaggcagctttaaatctggccttgtagtgagccttcttacttgcctctatgcgattatacaactctaggattttctgagtataaaaaaatgcttccgctagcgcgttgcggtcgtactcatcgcaactatcaagaccctttgtgtgaaaaataaacaggccatatgagataaaactctctccaagtgtatgggctggaggattgttgccatatttttctatagccttaatccaaggctgctcagggaaaaaaattgtcaaccgatcatatactgcgttgtacaaatcctttctggacattccgccatccatttcaataattaacgtataagtatttgtgaaaactaaatcgtgcgcatgaaactgcagttagttttgcttgagtccaatattcgcatggctggccataacgcaacccaaccgacgctctaagtacgtactaactcacgcaagttgctgatgatctgggcagccgcttcctctttcgattgctctcgtaacagcgccaacgcctgtaccgttttgggaatatcggtagccggcctggtaggcagccccccgctttgcacgaacgggccatcagtctcggtcaaaagccgatcacttggcagcgacgcgacaagcttgcgatgcttggcggaggccaacatctgagagttgatcgagaaatagcagccaagctccaaagccttcttagcttcacttgcagagccggtgaaccagtgaagcactacagtccccctgtcgatagggagcaggcgctctatatgggagagcaccttgcttacgctgcgaacgctgtggacagtaaggatctttccgccttgctctgaacacgcctcaagcaccctcttgaataccctctcttgggcgtcgaagcttggataaaactggggcccagcatcgagccccacttctccaacgtatcgggtctcctcaagcaaatgctccaaaaggggcagttccgactcgcgctctgccaccaactgggggtgcaggcccagagccacccgaacatgccgagccgacgccgcaagctcgcgattgcgccgccatgctttaggcgtcgttgtcacggccaacgtggccacctctgcctgatcgcactccaagatgagacgctcgtgatcggggtaaaggtcaagatggcagtggaaatccacccattttgggatcgagtttttaggcggtttcatagtggtatggctattacaccctcaagatagtcatcgacctccagcagcccatcccgatagacctgttcaaaggcgtgaaggctctgaggatggtcgatcaaaggcccgggctcatggattgagaatttggctcggtgcggtgcgcgttttagtcgagcgattgcgagctggaaggagcgcacatgttcgccgtcggccctattagtgtccagtgcctgagcatgcaagtccggtatgacatagcgggtctgatctggcccacaaccgcgatgtatcgctgcgcgccttatgatgcaggggacgcagaacccacagtgcttaggtgatctatttgatgggtcgggatggtacctcgcttttcctggtgaagagcacgacattgtgagatgcacgtgatcggcgaggaatgcctgatctaggcattgctcagccatctgacctttggtgagatggctgaacatattgaagagctttgtgctcagccccagacgcgcaaagagctcgttcacccgcgccatgtagtaagggtgggtcgtgcgcgtgctgcatgcacccaagcgacgaggatccagggggacgttcagggaaatcaggccattttcaggcacatggatggttatcgagtcgcctatagcctccgcggccattgctgccagtgcaaagaacagaaacgaccgcgcgcgaagcgtatcttcgctgccccctccttccaccagatcgttcgggaatcccacgcgtgcctggacatggttgatcgaggtctgtgaaaacctctcctgcaacgccgcccggcaatcgttctgataggtgctggtgctgttggtgtcccaatagtgactcacaagcaagggtttgctgccagccccgagaaggttgatcgccccgatgaagctgtccataccacccgagaacagacaaacgctgtcagactcatccgtcctcaagctctccggtgcgggagatagttcatcgacaccaaggggccgctctcggaagacaaggcgccatcgatccccggtgaggaatttcagggtcgaggccagcatgtcggaggcgtctgcccatgctgcaggatttgcaacgggtacatacaagtcaatctccctcgtccaggcgttctcagattcagtatcccgcgagattctggtgtctgccgcggtaagggttgctgccagaagtgcaagatcaaccgcagtctctcctggactcaggccgagatcggccaactgttcaatcgcttgaccaatcccatacctcagtagcccatccccgtcgataaactggatattggtggcgacgctccctgcctcgagcagcactaaatcctggtcatccgttttgccaagtcggcagataacgctgtgacgtctcattccagactctccgctgcagacgcaataaggtcgaacgctgcctcatagatcgcagaggtgacttgattgacctcctggtctgtgggcgccggccattgctccaaccggttggcgagctgaccccgtgtacagcccgtgatgaaggaactcagctgggattgaatccgttcgactgcctccacatcatccggcatggttatgcccctgccccccaagtccgccatgatcatgctctcaattgagttcgcgacgaaatctaggaagaagttctggcgatcagaatcagtcatgtcttcaaagctgccgctgcccgcatcgtccaactcggcaatagtattgagcgcggcttggcgagcaacgccctcgtctatcgctccgccaggggggcagatgaactcaagcagcgcgagcagcacctgggaggccggttgccctggggcaaccgtaagctgcaaccgtcgcagagtttccgcagccccgttgcgctgaacgcctccgaagatggtgagcagcttccctgcggtatcgcgagatgtgcccatgcggcgcgcacctctcgctgatccacccacgcccttgcgtacataggaagacaaggcattccccaaatcgctggggcttccagtgcgggcgaatcgcgtgaagctgttgcgagcgcccctaagtgagccagtgccgtcgttgttgaccgccgccaacggagatgaggctggctgtgaaggcgtagaaccaggctgagacggattagattggcctggcccacttggttgggccgacggagctgctggttgcgatacatcatcaatccaggagggcaccaagccagagcttgggcctccatatcctttggaggtacccatatgaatccttatgatttcccgctgaattcaagtacgcgcttggctgccttctgaagcgtttcgttctcgacttgctgactccagcctctcaaaatcccctcaaggccatggatagcagcagtgtctttaaggcactcatgccatggggcgggagcccacattcccagcttcggcgtgggcagcgatcggatgaactcgactaagcgcttctgtaacgcaggacgctgcttgacgagttcaatcaggcccggcacgcccttgggttgatccgcaaaactgtccgcctggattatttgatctcgaagtgcgtcgaaaaccgtttcggcatcaacctcagccaatcccaagatctctttcttcgtggccgcctgccggatctgcaatggcgggcccatcagcttgtcgacaagcgcctcgagatgccccactgcgacctgccccattagggaactacgcttgtcgcgggtcacgaagatgtaggggcgcagatcaacgccggtgagcgtgggttcgatcgccgcccaattgctgatccagtcgctcttttcccaatcgttcacatcgccggagcgggccacagccttgagcttcgctgagcttttcccctcctccggctctgaggcggccgctttagacttgttcgcccgtttttctagctcggctatggcgggtactgtaccgtccgcctccacactcgcgatcctggccagttgctcataaaagtcaggattaaaacgctcagccagcatgattttcgcaagtatcggccgacggatgtcctctgcaaaacctcgcgcatcggcaacggcgtaacgcaacatcatggagttgaggaaacgtttgatctgtcgcggattgcctcgggtgccctcgcttagaatccgcgccagcaaggcactggtgtccaacgcctcctgggcaaagtcgggaagcgggctgccgaaagcgccagccacagctttgcgatctaggcccgtgctcttccacggcctaagcatgtcctgctgggcggtgtgcaaaagttttttgaatcgatcgtcatccgtcctgacgaagctttcgagctgaagcagcgtgatgtagctacgggtctctgccagtccaagcgctgggatccggaacggtacctggattagcttctcgaggtagttacgtgcataggtcactggccccgcaccttgtggaaggtctgggaagtgctcgcgcaccgcatactcgatcatggcctcgtcagcacccaccacgaacgctgtccgattgacgaagaggaagagccgaatggcctccagcgtggcaatggctgtcttgggtaagcagcggtcaaggtcatcaacgatgaccaccaactggtcaatgtctgcagccgtcagcagctcctcaaactcgacccggaatttgtgcatgtgctcgggaagctgctcagactccttctcagcatccttgatgaagccgccggccttctcagctaggcccttgagcccctcaatacttaaatgatcgcctggattttgcacaaacgcagtgattgactccaccgcgcccttaagttggtcaatgctaggaatgccagtgagcgcggtgagccctaatccaccagcttgcttggccagcttgaaccaatcaacgcgacgcaagaccttcttcgctgcgtcggccaccttagctgagtccgggcgagcacgccgcagttcatcaacgatggtctggataacgacggttttcgcatcctcaaagccttcgaatgtccatccgttgaaccatatgcagcagactcgcttatcagctttaagaagttgctcggtcatccttagaacgctggatttaccggccccccagtccccgtgcacgccaatggtgaccggggctcctcgcgattcgcggagcaagcgctccactgttttggcaatgggcgtgtaatacagcaggtcggtagctgtctcctggtcattcaggaacatgcgaagaactccctttctagctttagatatcactcgatagtatgacccagctcaaaacagcggcctccatccactagatcacgttctaagattcaagatttgcagcgagtaggccaagatccgcttactgatgtcaatacgccattcgacgcaatgcatgctgatttcaaagcactctgcaagatgctcccctgcctgccagctggtatttcaagtcgagcctagtgtctagacgagatcgctgggcacatggagagcactttagccgtacactatggtgcggaaccggagcgagctgaaggttagtgttcttccatcaggtatgcatctcaggctggcgacggtagtggaatcgccaagaaacgaaccaatagaaaccgctgattttgaaggcaaagctcgatggacaaggctgaccggtacctaaaggcaggtacccgggagaacacccgcaaaagctatcgagctgcgatcgagcacttcgaagtgacgtggggcggctacctgcccaccacaggcgacggtatcgttcgctacttggctgaatacgccgacaagcatgcgatcagcacgcttaagcagcgtttggccgcgctggcgcagtggcatatcacccaaggattcccagacccgaccaagacgcctaacgtgcgccagatgatcaagggcatccgtgtggtgcatcccgcccaggtcaagcaggccgcgcccctcttactcacgcatctcgaacaagccgtgaagtggctggaagcagaagccaccgccgcgctcgatcgcggcgactacaagacgctcctgcgccaccgccgctcggtggcaatggtgctgatcggattctggcggggattccgcggggatgagttggccagactcacagtggaaaacaccaaagcctatagcggtgaaggcatcacgttcttcctgccgcacaccaagggtgaccgcctgcacgaagggacaacctttgagacgccggcgctgacaatgctgtgtccggtcgaggcctatatcaactggattaccgttgcagggctcgcgaagggcccggttttccgccgcctggatcgctgggggaatttggcggataaggccatccaacctcatagcctgattccgatgttgcgacggatcttcaaggaagccgggctgcctgaagagctgtacagcgcccactcaatgcgacggggcttcgcaacctgggcatctgccaatggatgggacatcaaagggctgatgagctatgtgggctggaaggatatgaagtctgcacttcgctacgtcgatgcaagcgtctccttcgggggcattgcgctgcgttcaagcaggcatgtatctctgtctggggcttagatacaaggcatgctttcaatggcttgagaacatgcttctctgcagtaatagatacaacttgcgccgttatcgctcagtcgagcacgtgcaagcttgctacttacgactcagactgcaccaggtcactcagaaatccatgaaagtattcattcagcgtgatagcgcattgtgaaaactcatctgcagcatttctgatcttctccaccgtccaaagctcgccagccctaaagagctttgacaagccatcagcacgatccaaaccaggcctcccatgcacgagaccattgcgttgctccactagctcatcaaaccgcaaagctgcattgagcaacttggttgtgtcttcagtgtttctcaacgaccctgccagcgtaatgaggcgctttgcaatggtacctgcggtctttgggttcaaggtttctaacgcaccaggcttgatacgctcacagatccagacggcgttccactccagtatgctgaacgtgtagacagcctcgcccagtgctcggcagtactccggatccgaaggctgtcgtagtcgtgcgttttccatattcgcctcatgcgccacaagcaccatcaaaaaggcagagcctgcccggaactctggtgtggatctagtctgaatgcccagcaccgtaggcataatttgttgatgagtgggccagacacatacttttccagttcccccctaccccagcttttcatagcagtaccatcacaaacccggcacgccctctctgaattcgccgactgttggtctagatctgaccgtatgagctactccaactgcctattgatagcactgaacagtgccgagaatcttgccttggtagcggcatcaactttgacggatgggcttgtactgaaagttgccgccacagtgtagtggttgaatccaccgctaggtctgagctcgattcctttcgataccaagaacttctcgatccgctgcacgatgcggtctccttgagggaggtcttgctcagtaatggatacgccattgagctgcttggcaaacgccttgttgaaataggtcaggtacagtttcacggtgaagagatcctcaatatcgctgggcaccgtatcctggccaacctttttcatatcgcgaaattgtgaaacgttgaacacagatttcttctgtatcagcttctgatggatgaggctttcgagcttctgatcctgtcggccgctgtagtccaaaagcagcgcgatcgagagcccgttggcaccaagcaatgatgtgaatgttgctacgttactaagcccccccacaggaaccacggtcgtgttgccatccaatccggtttccccgccagcgctgagaatcgaggacatcgtttgcaggtaggcaagctctgatacgccttcgaccagaaggtttgttttgctgataaatagattttgggcaacgctccatcctagggccgcttggagggggaatattgtgcgcgggtctgaccctgaaaggttgtctgaaacggtggtaccgacatcagccttgtcttccacaatgcgtacttgatgcagtcgctccgacctgaccataaatggcgagtgcgttgtgtagaccacttgatgagcttttgaaagctcgtcgatgtaattcagaaaatcttcttgcgccaatgcgtgcaaggctagcccaggttcgtccagtagaagaatcaggttgctcgaggcatcaacacccgatgacgccagttgatcccgaacgctgtcgaaccacaccaggaaactgaagaaccagatgaaccccctgctccgttggtcaaaaggcgtggttaccccacgatggcgtctatttttgatcctcaaatacaggttcgggccgttgtcaaaaggagtgacgtcggtagcgtccggcctgatatcgacctcaacctccagatcctcgttttgcttccaaaactccaagaccttgtcagttaggttgattgagaccccttcgactttagcgcgcatctcctcatacgttgtcttgccgtcgaaatcatcgagatcgacgcctgcgattctcagtagcgcgaggattgagagatgcttaggctcaattagggcttttttggatgggtcatttttcagcgcagtgacgcgagacttcagatcggccagattcatcttgcctggcaagaggtcatagtcgctgaagtacagaaatttggggattgaaacagagaagtgcctccagatttcgtagctcaatatcgagccttgccaagggcatgcatcgattcgcttcttcaacgcctcggcaaaagcactgtccgcttcggttaggtcgatctgaccgagttttgtgtgcgcctcgcgaatcgttttggattctgagagggccttgccggcgtcagaggaaagtcctggcttgttttgcaatgctgctatggctgatgcctccgcaaccgaaatggttaccagtttgttattggcgtagttatgaatgaccttgaaagaaaaatcgtccggtaaatcgcagctaaaggtctggttagctttggtgatttctgctttcgtaggtcggtatgtaaattctaccgccgctactgggtcgtcctcatgcgagcgcagatacgtcgtcaaatgcctacgggggtaatcgtcggtgggattgaaggattccttcccttgcgcatcgtttgccttatggagagctttcaaaaagacggtcttcccggcctcgttcatgcccaccaagacagtaacgttgggatcaatatctacagattgagcggtattgatggatcgatacgggccgaccacagctttcgtcaaaatcactagcatcttcctgtcaacagtttgccttgaaggttagctgagggctgcggaagctcaagcccggatgtgtcatattgacatcaacataatgcagcgattgggagggcatcagtattcccaatttcgctgctctatcctagcaagtgctgaacaccatgcctgctctatgacggaagcgcgcgcagcggatcgtagccttgcaataaacgccaagcgctaaacgcgcaatggaggccgcttgaagcaatgtatagcaaataccattggcgagttcgatgcgcttatagcgagcttcgggtcggacgtgttgttccgtggacagacatcccattacggcgaacccggagcgccatcggttggcacatcgttcgaccggaaggggtgcgtccctagtgagatgctcaaatggtgccgatactcccagaatgtccttgataccttcatcgtcaaacacagagctgatttcggttttcagcaggctttgcttcagcactatggttggcgctcgttctacgtcgactgcacatccaacccaggtgtggcggcctggtttgctagccactcatactccgaggccgtgaatctggaggttagcgaggactgcgatgaacgcgctgtgtggctcagaaagcgcatggcccgctatgcacccgcgaagggtcaaggccatgtctatatcttgagcaagcacgccgcagcgcaggtgggcttagtcgatctcgcaacactttcagtggcaggctcaagacctaggacggttgcacagtcagcttggctgctaggcccgctgcataatccgataccccaagattgttatctggcgcagataactgtgcccgtcgaaatacttcaggtttatgcggccagtcgcggattaactgatacgaacaccctcttcccttctcccgctgaagatccgatgctcaaggcactgctgggcttgccgtgggaagagatcaaaactgcgtcgtcgctcccgggccttcccgcgttcaagcgaactctggaactacctgagtatcatccaagcttcgtaaaaatagcgcctgcgcagattgccttctaccgcggtaccaggatcctggatacgcaggactccgtagatggcgattctcaagggggaattttcgttgagattccagacatggtgctttacggctcagtccagcaagcaagaccccttcgcttcccaagtatagagaagctggtggaggagaacggtacggtggcattcgaggcacccgttctgatcaaacatgcgagcttgggccatttgccgctttatcaaaaaggggtcggtgtcatgccaagggggccaggcttgtttgaggtatgtgagctgacagtcgaacacccaggacttgagctgacaggcgcgggctttaccagaggatggacatatcgaaaacagtcggacggagtctgggcgcgggaggcgaggtcatctgactgcacctgtgacaatgcaatcgttcacgatcagcacatcagtgccttgcatatcgcggaagattttttgaatgagccggaagctttcgagtaagccggctcacggggattctgggggataaaggcccgccctacgacaggcatctgtgatccatcgaaaagggcggaagcggtaagagtgttaggccgatccagcgatgattgctggagaaacagaggtgatcttttgcagcactaacattctggcgcaatccttcaaggcttctgattcctgtcgtggcattatgctccaagcttaaggcgtcgagtcagtgctttctccggcgtcagatgcaaaattgcgcgaaacgtgttctcgcaacgatttcaaccaaagagattcgagccacatgacaaaacctgaatatccacacgtcttgctggtgaaggttcatgaacctttaaccggcacatgggagaaagatagggtcattctcgagaaagcagcgcagcagccaactctggcgaatgagtactacaacctcgcggctgcgatcatggggctatttcagcaatttacttacggtacgccatcgcagcccaattatccgcagaggataggcttgctgcgaaaggtatatgacgagctttatcctatcggtcatttcgcaaatctctacttcacccgccctgaaaacgttgtcgtgcaatgggtcgaaggtaatcagcagcatgatgccatcgtcgaatacaaagcggaggggtcaaatcagtcggacataagctatctcgagattacgacacttcaagaccaagaagatgcagatgagctcaaggagctctcaaaaagccctagcgtcactaccgtgacgaccaattcggcgcagaaaaaacatggtcgtaaaatcgagcggttgaaaaaagtcctggagaagaaggcgggaatcaattacccggcgcagacggcgttgctggtctacacagacgaggacagatttcgtcagtattcattcgggttagctgcgccggagatcgacaagaaagctgactacgaggcggtgcttcgcgagttcgagccgtcgctccaaaaattctctcacgtgtttattttcagcaagcatgagatctactgcgcctggtcgccggctccaaaagtagctgaatgagcaaaaggatctcaggcgcgggttttgagctgatgcgaattgaatactcgatctcgagaaggcagtgagatcgtgatggttaggaacttgcaattttgaactggcaccttggccagactatttcgcggttccgtcgcggctgagatcgacttggaaaagctcactatgaccgtttttgcttctcaaaacgcgacctgagcttgtcagttggcgtcccttaccaaaaacatccccgataatctctaagtcatccttgctaagcgctgactcatcaactcccgacaactccgtttggcccgatcgcaaaagcaagccgagcgagatcggttttgatcgtgaccgatgaactgccagagatcgggagcgccgcgcgcttggcgagcgagatcatccgtctggtctcctccacggataagccacccagtaccatgtcctgaacacagcgcgaactggggattaacttattggggacgcgctgctattgccacggtcacaacgtcatatgccccaggagaaagatccggtgaaagagatccaagcaggtgtactcaacgttaggtatttggacgtcggcccaatcgatggccctgtagccgtcctcctccatggctttccctacgctgtccacgcctacgacgaagtcgctactaccctagccgcggctgggtgccgatgcatcatcccttatctgcgtggatacggtggtactcgctttgtttcgcatgaaacgctgcgctctggtgagcaagcggcactgggcgcggatcttctggcgctcctggatgccctgaagattgagaaggccgtggtcgctggctacgactggggtggccgggcagcctgtgtcgttgcagcgctttggccggagcgcgtaacgggtttggtcagctgtgagccgggctacaacatccagaacatcgccaatgccggcaaccctgtcccacctgaggctgagcaccgcttgtggtatcagtattatctgcacggcgcccgcggttatgccgggcttgaggcgaaccgtgacgcattctgccggcttttatggaagcagtggtcgcctacctggcacttctcggatcaaacgttcgcagcgtcctcacagtccttccaaaacgctgacttcgtggatgtggtcacccattcatatcgccatcggttcggcttagtcgcgggcgaccctcggtacgcgcacatccagaaccagctagcgcttcgacccgacatctccgtgcctacggtcgtattggcaggctcaaacgacggcgttacaccggctcagagcgaacaacaagcgttgctcaaattcaccggctctgcgcggcgattaatcctcgatggcgttggacacaacgtaccccaagaggcaccagctgattttgcgcagaccgtacttagtctgttgcatctttgagctgggtttgcagcaccaatggcagggagcggatatgactcggaggctaggggctatagggcgtacggagctcggcagatgacgccctacagccccaggtcggccgagaagtagttgtcacgcatcgcgtcggttgcatgctggtcttcgatgagcatttgctgcaaacgccggctgagatgccagcgaagccctgaccgcatttcgatgtagccattctccaggcaaaggccggagtgatcattggctatgaacgcgcgagctaacgcctgaaaggctgatgactccatgctggcctgataaatccgcgaagggtcatcgagccccgggcgcctgcggtaatgattcagtgcctgggacaggaatgattcgagcttcggcccatacacttgggccgctagcgaccaaatctgcagctcaagttcggtttccagcatcgatctcatttcaggggcgctgtttccagccagccctcaatattcgctcaacccgtcatcagcgtcgagcatgccgcccttggccacggttctggtgagttgggaaatcgcaacccatgatcttgagccacgattttacagtcgcaatgggcgccggcggattggccgcggtattcggtgctcaagtcaaatccacgattttttttggaagtggtttttctgtgtttgtagtcaaagagaaggcggcggcacagccgccgaaagaccgataccccctaaaacctgcagaaccatgcaccatcagcacggctgcatcagccagaagccaaaaccgaagaagaaaccagaccctgaacagcgctgaaaaacccaaatcgactcaagtccgatcacctcaaaggtggcgaccagggcgcataaagcggagtgacgaagatctatgctttttcttttgccctcaaatataaaactccgtcgccgttaaaaattttcaagaggggtctctaaaagaaatagcataaacagtgaatatgcctgtttaacaatataagcccagtggatttcactgaggaatcagcgtgccgatgtccccccccatttctgaactggtggtggctcgcggtgtagtgttgatctcaaaaggagctcggatcacccgactatcttgacgctccactacggagcattgtgagcgcccaagtctccttgcatcaggagcattggcataggagcaagccgggtggtgtgctgacgctccaccactaacgctagacccgtaaacctcgaatgtgcactgtaaacctctgaggtttacagtgcgaaaagtcggttaacaccaagcagctgaatcggctaggcgccgtggcgtctcacgtgaacgctggagtctgctagtcaagtgtttggggcggggacgatattgctgcagtcggcgccagaggcgaagccgctttcaacaaagaaagcagcgcccggacattggatgatgcccctcctttctccagaacagccatgtattgacgttcctaaacgggggcgcaagctcgaacacgttgacgctcgaccttccaggcatcgtctctagcgtgcttcgaagcatgagggcaatccccgcccaggctatcacgcatgcgaggatactgtgataagactccatctctacaatcctgcccggggttattccctcgtgggaaaaccaggtctcgaagtgacgacggtatgagcagttatgaccccaattggcggaacctgatggacagccgctaccgcgaggttactttccccgccatggtcagtcttgcggacatcatcaagctttcggatgaggatgagcgccagatctatcctgggttgaatgaggaacaattgctcgaggagctgcggggtatgaacgccgctgcgcagatcctgttcacccgcggagctcaaggcatggtgttgtttgcagacaatgccaaggttgaacaggctgcgactgccagccaggttgctgacactgtgggtgccggcgacgcgagcatggccggatggttggcctcgcagttcttagggattcagcaacccacgcacgtctgtagttttcggcagcctgcgcgtcggtgtcttgcaggcaccctggggcatacgcgcctagtcgtgaagagatgacagcattgttgtccgctggtgtgtgaggaactagccgtccttcgctgaggggcgactacccagccacgccctgccgagttcattagaccatggtcacgtatcaagactctggctcgctcactaggcaatggccgatactatcgacctctgttcagacagctcaaaaggacttggtgaactatgtcattggatgtggcctacagcattgaggctgacgactttgtcgaccctgatcgcgcctacgatctgtactggtcaggggtgattactaacaagcgcgcattcgtatgtccagctgctaactgctccgcccaagttacctgcgcaaatctggacaaagacgtccagaacatgagggttgtcccgcacttcaaggtctacggagctcatagtgaagcgtgtggtattgccaacggcgcccctgtcgaattggagctcgagcccgctgagctggatgggcaggaacgcagaacggttgaccaatccattgtcgacgtcttcaagctcgagcgacctgcctcctattatgacgagcacgcggtcgagcctggcgcggacgtccatatagcgaaaaagcgtgcgagaagcacccgcccctacaccccgaagctaggggaatcaggcatagtcgggcccatttactcggttcgatctgtagtcagcagatacatccgataccgttccgatgagacccttgagttccggcggttgaacattgccgggcaggacgtgccctacgccagcatcttcaaatgcatctgggagcaggatctggacgacctgcccgaccatcccatcatttactacggttgggcctatgttgaccgcacgaaagccaataatggctaccgaatcaaattcaaaaagaatttcaagcggggagacaacagcctgatcacctcatgcttcgtctccgacgcgctcatagaaaactacaagctcaaaaacctgatggcggtgcggctttccaagattgccgagaaggacaagccaacagcgttcgtgtttctctacggccaacccgcaatacggacgtcgaatgaacgtgactacgcaaacttcgatctgaagaatctcgacatgatcgatgtgaactacgactgccccctaccacctagatacgataagtagacggtctcacactgcggcaaaggaaggctttgcaatgtgctgcaaagcctggcgccccccggctcgtgagatctcaaggcgatggagcccatacgggtagcgtggatgtaccaaccttatcgatgacgatggccagactttggcgagctcgcgtcgccgcgacatagaacgccgcagcagccgtagcctccaaagctgtgcctttcttgatgaagctttcgatattggcagtgggtgcgagcaatactcgatcaaacgtcgcacccttcacccctttgaagttctgaaagtccagattgaggtgcttcgcagagctgaccgaatgcctgaggcactgcggtctaaattggccgacgtactcatcgacatgctgagtatggagaaggaatacgccatcatgcccagtctcatcgaggttctccgaggtggtgcccgggaagccccacgtggcgtcgaagatggtatcggaaaacgtcgcaatctcggctctgcatctgtaggtgatggtcgcatacgcaatggtgagtaaccccttagcctctctatctctaaaccattcaagcgacgcggcatatccaaatttcttgttcttctggcctcggggatttgtagacaaaaccgcctgcctgacatcgcccaccatccgcacatcgattttagagccgagcaggacttcgaggatttcccaatcgaagctggctagatcctggacttcatcgatcaatatctcgtcgtagatgcactcgagccttcgcaggagcgccggcgtcgcctccatgagctcaaaggcaagcttgccgagctcgcaggcataaacccgatttcctgagtccatgaacctgcttttgcctttagcaaaccggaacggtcgcccttcgaagtcgaagcccatgactcgatccttcgggaatttgaagcgcaggaatggctgggcaaaatgacgaagtaggaaggtgtaccagcccatgacctccaaggtgttgcagtggcctgcatggcttgctaaccgcgacctgatctcttgctggttcgtctgggtgaaagtcagcacggcgatctttcgatcaatcgctttcccgcagtattcgacaaggccctgcgtctttcgtccgccagctactgcgagcgtcaaatggttaggcattctggatgaactccgccgcttccttcatgtaattcggggcggttagggctttcggggactcagcgatgagcaaagctccctcagtcttttctcgtgtcatccaggtcaccaggtcagcttttggcgtgattccaagcacatcccgtagatgaggttcaccgttcgctgtgatcaattgcggttcgagggtgcggccatcgctcacttcgcctatgaagagttctcgcttcttgccgtccagccacttcgcgaccggaacccgaagatccgccggcttaatgccgtcgttatcccgcatcacagcgaccggcttatcaacggcagcacaaagctccagacagcgggccagcgcaagtccccgcatactgatgacatcgaccccggcggccatgggttttaaccggtgagcgtcgttgaacaccctttcaaaaatgatttcgtcggacggcccttccaccaagaccacttttttagccaaaacgagacggagcgtgtcgtaacctggcaggcgctggaagtaccgtacggtgccgggatcaagggcagtgatcttcgaggcatgattccgattcagcaggtgaagggaattgagaccaagccgattcagcacgtatgtgctgtgcgtggaaacaaacaactgttggtcgtcagacgcaagcttttctacacggtcaagaagcgtcgacaggctggtatgagagagatgattctctggctcttcgatcatgacgatcttcactttcgctgagtgacgcttcatcgccagcgatatcttgatcgcagcttgttgaccctgtcctgccatcgagaagggaacgttgtctacgtgaggcgtgatgacgctttcccaggacgtgcgcgacgtctgatccatagccaatgccatgggctccgccaacaaagatgcacccaatgtcgagaaccttgtattcactgtcgccagagcaccctcagtcatcgacgccttcaccgtacgaaagcccaacgagatctcagctttctcggtggtctccaagtgatcgctcagaatctgacgcaggtggtagtccacgcctgctgaggatttgactgtcctggagtcgattgttgcgacggacagcacccgcgggcgcttcgttagctcccggtcagcgaacgatcgccactcgcacgtgtagtactcaacgggcagcagagcattgggtgcctttagccagtcatccagcatgtcctgatactcttcgttggggtagatcctcaagaagacgcccgggcatgcatgagttgggacggctgtgttcacggcaccacatagcacctgcaattcatcttcatcgcgaaggtatagttcgatcaggatttcgggcagtgcgggtttcttgccggcggtgcgttgcgctacaaactcctgaacgagctcagtgttgaaccaatgcgggttcaattcttcgagaacgctgcggccgccgatccggccgttcagggccagcgagaccgcctccatcaaggtagatttacccgcatcgtttccgcccaccaaaatgttcattttagggttggggagaaggttaaagtccttgtagatgcggtacccgcggatgtgaattctggtgatcatgatcgtcattcccttggcgaaaaatacgggcttagtgccgcgttcagtcgaggccactgcgacgctgatgtggctcgttgtgcctgtcgaacttacgtcactctcttaccatcctgagtgaccgatgcctagaccttcacggtgatttcaggatcagtgacgttagcgattatcgaatcccgaaatgacgcgcgccctctgaccaaggctcgtggcgaactggatcagacttatatgtgaagctcacaccttggattttgtggattgtaataccgcctctagcgagccgcagactggcctcgagcgcatgtgtatgacccatgaaaccatgtgctgactcttcggtagacggactgccctcccagatctgtgggtagaagacccattgatcttcgtccgactcccacaggctcacctggtcaagtgcatcttgatcctcagttttctcgaccccgctggccttgtgaaacaggatggcgttcaggcctggcgatgcatctttgggcacctgaacagatggaaagaggatgccgtctagattaagcgcttcgttggtcgccaggtaatcggcgatcgcctgggttatcaagtaaccctgatctgcgctctcaggcatcacagggatgagcatttgttgctgcaattcacgaagaaatgcacagcgttcggcttggtcttggcgcactgggtcaaagtagctgagattagggtctgggcgaattccacctaggtcaccgaggttcaacagtcgcaacggccggatgacctcgaaggtggcggtaactacccaactgccaacaggcggacgaacctccgctatggccgtttggttatcagttgctccatagaaaacggatatacccgccgcgttcatgcgacctgccgatcccttacctctcggtgttgggccgagatacttctcaggatgcttcaatgcagcagccataccctcctcgtcctcgaatttccttgcccgctggaaggcaatgagggattggcccgggcccgcaagggtgatcgctgaacgaggttcgctcgcagtgtgaagctcctctatgccagaaaatattttctccagtacccgacccaccacgggatttaccaacctggattcgaactgaagacttcgttgcatctgagcccagtctgaggtcagctgagaggatgcatacgtctgttcaatgaaaaacgggtcatcatcttcgcactcgctccactgctcccttagctccccttcaagatcgctgagcaaattcatgtcatcagcgccgagcacgatttgtagcacgtcaaagatcgaatgccctacctcagggtatccatgatgaataactgcaggaggttgctcagcataggtaaatgacgcctgaattgcctcttcgagctcctcaaccagctcctccagcggtacgaccggccgcacctcgttgcagtagttgcattcgtcgataacattgtcggtaaaattcgcctgcaaatagctgtcacagagacattcgacgcataccagcttactcatgggttctccattttcctgtgaacgttggcctgccggcaggttaactgggaatcggcgacgtttcgggcttataagtgcatcagcctctcacaacatacttttgcctatcgtcgcatcaagctgctcgcatggattgccgatcgacccggacttaggccagctgcacccattacacaaaagtggacgtgccttgtaagatcagggtaggcggacacgtgctatcagcgaagacattaatggcccgatcgccgcgtattttagattcaaacggcgcgttctagcccaaagagattccgatctcctccagtaaccaacccagagttcacaaggatgtccatatgactcgcgctctacactacccctccattgagtttcaggacaccgaagcgctgaagcgctcgttgctggtctgggatggtatccatcgaatcgtaccaagcgggtacacgcctcaggacgacgctgaagtgagggaggctgtacaggccggtgctgtcgtcaacctagctctcgattcggaagaaaaacacaaagcagcccatcgcttcctcgatttttactatctcaggaacagcccgaccacgcggctggtatggcctgctggatgctcgtcccaatcgttcacccggatcaaccctgacaagatcgaagcaaaacttttgcctttgtttgaatcgctcacccagcgtgtgaccgcagatggcttcctagaagtaccagaagaccttgctggcggttacatgttctaccttgcgacctccgtagcggagcagcgctctctacagctcaccacagactcatctgactgctgggctgttggcacctacttcgcaaatgaggggtgttttaacgaggccgtttacgacgaagacgcagacgcctatctggcaaacatggccatcaatgatctgctgccccacgatctatcgcacgtgaaaatcgacgatcttttgcggttccgcgaggagcatacagaggtcagggctcagttccagacagagttgaatcggttgaaggctgagatttctgcttgtaacaacaagggtcacgcccagtacatagtgggtgacttcgttaaacgttttgagcgggccaaagcggattacagagatacgcttggatttttccgaaaggaggacgtgtgcagtattttttcagttgggatacccgtggcggcaaccatgattgcaatgccgacttttagctcgggtgacccgtatgagccctggcgggtttgcaccggactgctaataggcgccgtctcgtcattagcttccagagacatgggccgaaagccaaaaaccatcgcatcctacctggtgggcagtgaaagaatttcgagatacccaggccatacgctccatcgcaagtttgaggagttcataaacgactagcagtcataactggagccctaacgggttccatgtttcaagtctgacgtccttacacggtcgattcgcgctcagatgtcctgcgcgcgtcatccgctccgcacgatgtcagaagcaggctggactgatacatgaacgcctgaactgatggcgttgcacctttcaggatcacggcagtggagaacgcaaccgcggcgaaaatggaaaaaaccagcgatgctccgacggcaatttttgctgtgatagcgatgttcatattgatctcaagggatattcaggatttttgaattatctcatgcgccgcaaatacctttgagagctgcttcgttaacggattatttcttgcagataaacaatcgtcgcggtgggtcgatacccccgctacatggacttaaccgacagcacctcaacataccgatatttcttcctggccgccttaactgcttcttgctcagccaaaagcttgctaagcgtgtccgcctcgtggatgagctcaaaggttttgccttcaaactcattgccgacacgcagggttacctgcagcctgggtgtgaaagccttcgcggccttcttctttgccacaggcgacgatggcttcacgaataccacttctggaaccggctcttgctccggtggtgcagccacatttggtaaaggctcagagtcgccaaaaagcgctctgcgcatctctgcttcagttagatctggattcatgcgatatctcgagggacggtctgctcagttcggtagagtttactaaggttgctgaccggtgtgatgggcgatttgccgaaggctttggactcataccgtctgtatagttgaggtgactcaggtgaggagccgcggccggccggtggcgattcatgcctatgtcagtgccagcgggcgtcgggatccacagccccgttctcgtgcgaacgatgcgcgacgacatagacaccatcggtggcaatgatgagctcgtactccgctacccaggctcggttttcgatgatgccggtctgaaaaggagatccgtcgcacaagctgccgctttgatcgcaaaacagcaggcctgtcaccctactccgtcgctccaaggcgcaaagcaggtaccctgtaatcccttcagagtctacagctaatcgtgctcgtgcaatggctccgggtagcttgttgaaccagaagttactcatcgataggaagggccggtcggagtaatttgagaagcggcagtggcgatcacacgaaggacgcaccggatcccgggatagtcagcttccatgaaccacatgaccatcaacgactgctcatggtgcccaagatcttgagggaacctgattcagaagctcgatcgagacagactttctgaagcccttgcccacaagcacaaagatcgtgtcactggtttcaaagatgccccggccatcgtagctagtcgcgtagccggttttgatgcgctcgttggtctgaaaatctccggtgctgtgaagcagcacgctatggctaaacaagacaatgggtaaacgtcctagggcagccaatggctcggcatccacattgagtacatcaatgatgacccaagcaaccgcagcacagtatgctttacccgtttctgcgacacgtgtcttgatgagctcggcttccgcttcggacgccccagacagaggctcgccgtcgagcgcgatggcttccgcaacatgtagtcgatgcatcaatcctccaatccctgtggtacctcgtgcgtatagaggtgtccaaaattctgttccacgttgccagcctgctggatgagcacataacagctgcccgtaaacgtatgggcaagcaaatacccatgcttcctggtcagttgcatgatcgctgaggtctggatcagaccaacctccaagaaacgctcgctcaaatctccatagatctcaccagccaagctcgccgcgtgagggaacgcccgccatagaaatccactgatcctaaatttgaagctcagcgatgcagcttgaacaagttcgctaggaacctcaatgctggatgtcatcagcatttccttcgacgccgagctccctcacgatcagaaagtgctgatccccgcctggagtacgcatcagcttaaatcccgactgggctttcacgagctccagcggcggggtggcaactgtcatgccgtcgaggctggctttggatttgtccccatacacaatcgcagcgtagcgctgccctacccttgccgcatcatataggtaagcatcaatggtcacaccccaatccatggcttgagctcggatgaccgcactaggagtctcctggctctgacgctcgacggcttccttctccgcgacacgcttatgggaaaaattggtcatcaaatcgaaatctcaaaaaacgggtcaaagccagtctgctcgttgggataaccccggggattggacaccactctgcagcctgccagctcgacgtccacagcttggtgggtatggccaaagacccacaaatccgctttctcgatgagtctgggccagtcgttggtgtaagccgcattcagatgcccgtcatgcttcgttccgacaactacaggtgatggggcgtggtgagtgatgacgatcgttttgccttcaaaaggctgggcaagctgctgggcaagccaggacttggcggcatgattgcgagtgacgagatcatcgggtctcaggcgtcggtatcccgcatcagcccggatgtaattgaagtcgttcatccactcccaagccatcctgctcgcagccacctggtcgcccgtcgcggaaaagtccgtccacgctgcagtgcccaagatgcgagtgccgttgatgatgatgctttggttctcgagcagatggacatggggctcagcggcgtctcgcattttttgaagagttcgatcgatgtggccgtcataaaattcgtggttgccgcagatgtaagcgaccttgcactggaatgtgtcatttgcccacttcacgccacgggccttcttgtcgatatctcccgcgagaatgaccaggtcgacgtcggggtcgagcgccggcggatcgaagcggtgaaattcgttatgcaggtctgagtagattcgtagcttcatcgctcggtcacttatgaatttgctgtgtttcaaggtggtttagaggttgcacggtgtgagtatttgctcacctgtttgaccacctcgccggcaccgttatgagctttgctggttccgaatacgtttgatagttcatgtgacctttaacggcttggcttgcgggattcgtgttccaaatgcctagtggcgtacgccagaaaatcgtgggctcattccttcaggtgcccactcgcaaacaacgtatgagctgccattacttgtttcgaagacgtggtatccgtggctctcgaaccttcgacgtagcgaggacgttcgaacggtcgctccatctcgaaaacgcccgcgttgttcttggtaaaccacacctaccaggcagttgatttcgtgatctacactcgcgcaacacatgtaagcggtggccggaaattcaaactgcacggctatagcacgctcgacgcttgcggggattgaggccggcttgacctccgcggcggtctgcaagctgttcaaggatttatagtctgtaggcatggtaattcactcgatctgtccaggcgtgatgtcctgtgttgatgtcctgtgttcaatgcacttcgaaaaaaggcctgatagcaccgttttcgaagtaatggtgggccaccacaaacaatccgcccgtgtccgcctccaccaccaggtaaccgttgcggtgaaaccgccttaaaactggcggcgtatgagctggcagacccggaggcagaaggcttatgcggttacagaagatcaacccggtcatccgcgaaggtcgatacagcgcgcataaaaaaaaacccaccacgtcgtcatctggtatcgccgctttcgccttttgaatcaccgttggtagcctgttgaagctgaggtctcttatcgtcgacccgaaggttttgatcatgaatgccaaagggtctggcgatgctgtgttgctcactggtggttcctcgcataagtccaggtctctcggcccaccacgctgctctgttcgatgcacaccgattccggagaccaccgctatctacttcacgctttgagctcttcatccagttccgaggccgccactgcagctgattgccaacaccgggacgtaacctctgctgacctaggctctgcagctcgcctagggatagaggataaaaatcacaatcgacggtttagggctaaattgatatttggtagagagatgtcgccctgagccgctgccctcgcccgcctgcctgaacccacgcagcggtaggtcgaaccacgcgcttgcgccgtaactgtacgactactatatacggtagagtgttacggcacaacatggctacatcctcggttttgaggaatgcctgtgtcgatgaaggtacctttagccgcgatccttcgcgcgctgcgagctcacaaagggttgacccaggagtcaatccccgaggggagcaatcgtcagtacctgagtcagcttgagcacggcaagtcgagtccgacattggacaagctgcaggacttgtcggaagcctacggggcatctcccctgttgctggtaggcgcagctaccctgatccaagaaggcataactgttgatgcgatcgtagagagattcgcagaacagatgcgtgagttggatgccaccggcacactcgcggcagcgcgggcagaattggatgacggtgggctacgtagcaggccagccggccgggtgattgatcgcgatctgaaggcttcgatacaggagtgcaaagcccagggcttgagccaggcgcagacggctcagaatcttggtgtgaacaagatgactgtcagtcgatattggcgcgactagtgcggttaagtgatgactatcattatcataccgtaacttttggtacgatgataatcccgacaagaacggtacaatacaagacgatgcgacctttcatgaaaattttccaccaaaagtaagcggtattcaatatctcacaaataaatgtaactttttactattttggatttctgtggatcgataaacttcaaaacagatgtagcatcagggtagaatcgttcaactgtatcttcgacaagatgttgtggtacatagtccgcggctccggatttgcatccgcagcgcaagttcgacaattctttcaggtgagatggcgatacaaagtaagcgccatatttttctgaatcatcgatcgaaggtgccaacggaatttttttgtaggtatgagagaaactgtaattaagggtctgctctaccttcatgttgtggaatttcaccaccgtctcaccgctctcagcagtaccgatcaagagagctccccacacgctgtagaatcgcaccagtttgttgttcaggctatttttaaactccgtcaatgggcagtggtcacggctgccatatgtcgaatatgtacattgacctctcccgagtgccaacgccacatcatttgttgttaaggcatgcatcagccaacaaacatacgccagcgaggcaaaacagctagattcaggctgcaaatgcatacgctggtgaagcgttaagttgataaaagaacgaaaacattttctatgttttgaaatgtaagttttccatatgtacctcctgagagactttatacaccgaatctggtctatttttgaaatcgatacggctcccatgcaccggatgtcgtatagtctgcgcgtgctggcgtcaggactccaaaaccttggaactccaccctctcgctcaaaagagtattcaagactgagcctcgtcacggggaaactcaaacaagctttaaacggctttgggatatgggttttatcctccagatattgcaatatcatatcatctagatcgtgtttatactcgggtgattcaatccaacggaatatgtcacccccgactattttttccgaagccgctaaccactccgcaaagtcacgataccaagaactcatcacttgaaatataggtgctgaaagatctggaataataaatcgcccagcaagtggcaaaatatgttcacaaatgcgctcaggctctgctggaaagctccgagatttttgtgaaggaagatggagtaaacttaacaattcgtagcacttggtgcagccaacaagtttatcaccgtgccatgggcaggactgaatttttcggaggcaaaatatagatgaatggtaaccaattttaatgcaactagggcagtgccatatttgaggccccgtataatgaaggtggtctctgggtaccatcgtaagaaagctgtcatccaaatcgccgcgctggtaaccaagcgcatcttccaaccttccttgatcgatggagccttttgcccaccaactaaaattacgagaaccttccattcctggttttttaattaaatcgatcacctgccgtccgctgaccttattgatcaacagcaccttgatcagaatcaaccaaatagactcgaaaggtgctaggcgccttatgaatgataatactttgtgatcactcatcatctggcccactcggcggatcgacacgcatcagcgcagcgaactgactcatttcggagctcttgattgcacttttgatttctttttgactaaaggaaaatttctcacagtcgttcagcctagcgccgactagcaggtatgacatagttaggaagatatgctcggtcgggattgtcttagcacccgctgccaccacgcaattcatcgagtgccgataaatttcgtcagccatcgacaccagcctgaagcccgcatggaatgccttgggcaaaaagaattcggtaaaactacatttgctgccatgcggataggccgacccctcgtcgaaatacgctaaaattgcaccaagccactcaacacttccgcagccaacgaaatcaatttttcgacctaggaacctggccaatatagccatatgattcccagcatgtagcgagtttcggacattatcgatttcattttgtgcgaagccaacagtcgtgagctttaaaccacgcgtactcaggatattttgcagcacttgaagatgctgatagtccttgtagtctagggcctgcatctcatcaatcactaatataaaatgagtactcccgaggctggcaagctcacagataatatgatcaatcacggcatctctaataccgctcaacttagtcctaggcttgaccatcagaccaatagccttgaccatagaatgaattatactttcctctcgggctatatccgcggtaacaaatttcacgtaccgagtgggaaaatcgttacgcaaaattgctacaatagcggtcgcacactgagtttttcccatccgagggactgactggaaataaacgctaggcatgctcaaccaaacttgctcgcgaacctgtttgtacgcccactcaatggtcggcgttaacacaaaataatttcgaagaacaacaggatgaccctccagtagctgatctcgcatgggtgttattttggggtcaaaatcaaacactggacggtctccggtctacttgaataaactcttaatattgagggctgtatctggaaccaccgagtcgtaagacttagtcggatctatgagtggctcaatgctaggttttgaaggtttcggcttcgggggaggcgcgggctcacccgactcatgcagcgcttttttatatgcagacgcagctccggcgttctttcggtcattaggtgtttccacaattttttcttgggacgcatggagtgactgcgctttttttgcttggtactcaaggaatgctacgacaggatcgtctgagtgtgcgaggataagtagtcgggcccgcactagtttgttgatagcctttctggtgcgtcgactgtgtttggtctttccccacccacccatagcggtcaatgtaccaagtggtgctccatcttccagaaatgcttcaacagatctcatatcgctctcatcgatttcgacggttagagttttacctatgagccaggttgaatacgagaggagttcacttttatacctagcccgatcaatttgaatgtaccccctaaccccctttttcagatagccgatgactttcacttgtgcaacagtctttttgaatgctattgatggaagaactgctgcaatagggcttcgaggaatgtagctgctattatcgcgccccaaatattggccaatcatgtctaatgggcttaaccctcctttgccttcagaaggtaggccgtttgccatcgcgtgatggtaatacaacaattcctcaacttcgtctgcttcgatacggtactcagctgccgccttcattcctgctgcaccctcgccaggctttgaactggcacgattgggcattcgcatcatatgagcggccacttctctgaatgctcgctcaacattgggcctgcgttcgaattttgcgggcgcgccatagcataacgaaaccccgagtagcttcctaagttcggaagagacaacggtcgcttgatgcgctaacgcgttatcaaaaaatatgcagctaggcaaagagcctaccaatgctgggaacttttcggtagggtagccagcgccgtcggggagggttagatttaaattattagtacggggttttggcagtacactcctcaaagactctgtaataatatcaacaatatcttgagagttaacctctgggctgaataccaccttcatccaccatgcggcagaggttgccttttcaatgattgcgatcaagttgactctcttgattggcacatatgtcagaagacccgcattatttctcatcgccacgacgaaatgggcatcaactttatgcgagtcaatttcaaaaacgtctagaaagccatcgagtttcagaatagagtcaatgcctcgtcctactgccaattgtgcaatcgcttcggaacttcctgatatcattgtaaaggcgtcaaaatatctgagtttaatcttctccaaaaaatttgccacagttcgatagccctgatactccacattcagcggccactgatccgaaggatgtccttctgctttcaaaaaatcatgaaaatgtgagaataacgccttgggcttcatatttatttcttttggcgcgttctttgatttcttagttattacttttcctatcaaatactgctctagattagggtattgcttaaagagtgccccgagagcacctgcatagcctccacgacccgattcgccgggattatccatgggagcgactctctcgtaagtcgctatcctgaaatgtgggatcagagcggtataacctgccaccattccgttcgaacatactaacatgcaacgcttcgtgaagcgtcccacatccgaagacgagatgtttgtactattatagatatcttccagcggcgcaccgtcaacgtacatatcaaccgctagcttccttgcctcaaaaatttccttatctgattcactcatcagacttgtatggacgtcattccaaggccgagtggcttccattgcggtgataatttctctacgagatcgtctagctttcacttagcgaccaccatgttgagcgcccaaaatcagacatgcttaagtttgtttgtttgataaccccttgaaaaatatacttagcaacaatcccgatcactatcatttcatcgctcaagggggtgttggcaatcacttcctgaatatcaccactttttagaatcttgagggtgtttaagataatctcctcctcaaacagccatttcttgtagcgcatctgggctacaaagggcagaagtctgagcagtcttacggcatattttgctcgaatgaccaggtagtcttcagtgatagctcgatatgttatgtttcgaacgctgtcgtcttcaaggcgaaatgtcgcagagaaagcatctacgtgtccaatcttcgaggttatatgatgtatctcttcatacccagtatcaagaatcacctggatggcgtcaatcggcttaaagttttgcttttggtcatttacttgaatatgaatattatatccaaacttgaatgaccttacattcctattagattcgagatcagccagccaatagatcagctcattattactgctcagtgataagtcctgattgagtttcacgctgtagcaaagccacaggttatttgtggtattagtgcgctggccatgcgcagcggctaatctccccctcattttacttttgagtgatggcatggaaagcaccttcgtcaagaccgctttccctcacctatcccacacgatggcggcaacttcaagtggtcttgagaggggggtatcctcaatgccagaggtatttgtgccctttaatgtttttatgcggtcttgttttttgtacgtatgcgtagctttttttgtgctgcatacttaacagtaatgagaacgcagctttacctgggattacttccggccaagcccttggctttggagttccttggcaagaaggagcggtagtccgatcgctcgagattgataaatcctgctccggcttccgcaaaatttgattagctaaacttagaattacttttttcttgaagcgcacgctctccgtccagcacactaggtgtatggcagcttatgctgaataatccgacgaacggtaatacccgttaggatctaatgacgcccgattaccggctaattattgtgcgacaccctgaatcggtaaattggtgtagagcaaccttgtcccttgagcgaaaccgatatgcgaggcagtcggccttgcctgatcagcagccgtatatggacggccctctgctcttctgtccatggggcgatcaactagagattcctgtagttccaattactgatgccaagggtctagaccgcgcttatttctgtctgcggtagagcgagtttgtgaatctgccttttctggtatccgagggaggagatctgcttgaccgaatgctctaccttacgaatatttctgcgttcccggcatctgagatgcaggctccgaaaatgccgaccaaatgccagttttggtgtggctatcgcacgcgtcaccgcggctggattcgaactctgacgtacgtagcgcggcttcgctcagcaaggtctctgattctcgatcttccgcaggtctgcgccaataccgtgcacaagcattcatcttggctgtatgccttaaagcattattacttcaaatgtatgcgttagattaaaattacttcaatttctcctgaagtaaacgctgcgccaaacctaagcctggttatggtttatagattctaggttattgatttggctaggaaggctctataggagctttagggtaagatttacttcagagcactatgacccagacagctttggtcgtaggcgccagcggcatcgtcggcagcgccatcactcagttactcatcgacaacaagtggcaggttgccgcgctatcgaggcaaccgtcgcaatcgcaaggcgtgatccccgtcgcggcagacctgcaagatccagcttcgctggaacatgcgcttgcggatctgaaacctactcatgtgttcatcaccacatggtcacggcaagccacggaggccgagaacattcgcgttaatgccgccatggttcgcaatgtgctcgccgccattcgacccgccaggagcgttgagcacgtagcgctggttactggcctgaaacactacctaggccctttcgaagcttatggtaaaggcagccttccgcaaacgccgttccgcgaagagcaagagcgtctggatgtcgaaaatttttactacgcccaagaagacgagctcttcgccgctgctgaaaaggacggcttcacctggagcgttcatcgtccgcatactgtcaccggggttgccgtaggcaacgcgatgaatatggcaaccaccctcgccgtctacgcctcgatttgcaaacaaacccatcgcccttttgtatttccgggatcaagggtgcagtgggacagcctcaccgatatgacggatgcacggcaattggcgaaacaacaactgtgggcggccaccacgccggctgcgggcaaccaggcatttaatgtcactaatggcgatgtgttccgctggaaatggatgtggagccgaattgccgaatacttcgacttgcctgctgccgattaccccgcctcactctcaccgcttgagaagcaaatggctgacgaccaagccgtgtggacgcaaatagtcgcggagcacggcttgaaggaggctgatattggtcgcctgatttccccatggcataccgatgcagatcttggtcgacccatcgaagtcgtcactgatatgtcgaaaagccgtgcaatgggcttcaccgcctaccaagcgagcgatcaagcatttttcgatgtgttcgacaaactacgcgagatgcgcttgatcccctaggtcgtgccacaacggataggcttaagggcattcgcttaagccttctgtagcacaaacaccaagcaaaagcgcgtaccggctccagtgctctcaacggttacccgcccgccatgcaattgcataattgaacggacgattgctaatcccaagccaccagaatcgtccggctgattgcgtgacgggtcgcatcggtagaagcgctcaaacaaccgaggtagatgttgcgccgaaatcggagggccttggttgtgcactgtgacttcgatcctgtcctcccataccacactgctgatagtcaccgaggtaccagtcgcgccataacgtagcgcgttggacagcaagttagccaatgctcgacggatcaaggccggatcagcacgcaactgatcatgggcctgattgatcagcgtgacatcatgctcttgcgccacgccttcaaaatactcacacagttgctctaccagatcgtgcaggttgatgagctcatgacttaccgatgcatgcgactgctcgttacgagcgagaaacagcatgctgtcgatcattcgcgccagacgctcatattcttcctgattggaaaccagcaggttctgatagtcctcaattgaacgaccatgcctcagggattgttgggtatgccccatcaggttagtgagcggggtacgcatctcatgggcgagatcctctgaaaatcgtgagagctgggcgaacccgtcttcgaggcgtgcaagcatttgattaagcgcctggctgagcacttgcagttcactgaattcgttgaactcatccagccgcagatgcaggtggtgtgcatcaatggcggcagcgcgcttggccagcaggcgcacaggtcgtaagcctcgctggctgacccacccgccgagcacaaaagccagcagcgcgccgaccgacatcgcaagccagagcttgagtcggtaggcccccagcatctgctcgcgctcgctcaacaacttgccagcaatcagggtcaagccgcgatcaccctgcatgacatgctgccaggcaagccgcaccgacaccaaagtgtcaccatcacccaactgagcctgggctgcagccggtaacgtgggcaagctcatactgacggggttgatttcgatcagcacctggccggtgtcatcgataatccacagcaggttgtcgcgattacccagcatattttcgtatagcttgggccgatttctgagttgctcgacgctgacactgtcgttgatcaacgcctgcatgcgctccaggcgcccgagcagggcctggtcatcgcgccacgcgatttctcgctgtaacgactgataaagataaaaaccaatggagcccagcagcaacgcgctgactaacgcgaacatgaccgccaggcgcaagctcagggcgcgcggaaacagtttcaggattgcacctcaagcatgtagccgatgccacgcactgtctgtatcaacttgagcgggtaaggatcgtcaaccttggcgcgcagtcgccggatggcgacgtcgaccacattggtatcactgtcaaagttcatctgccagatctgcgaagcaatcaacgagcgcgatagcacctctccttcacggctgaccagcaggtgcaacagggcaaactccttgttggtcagggtcaggcgttcaccctggcgcgtgaccttgcgtcgcaacagatccaggctgaggtctgcaaccagaaactgctcgacctcacggggcgggcccctgcgcagcagcgtacgtacgcgtgccaacaactcggcataggaaaagggtttgaccaggtaatcgtcggcccctgactcgagccctttgacccgatcctccacagagtctctggcggtaagaaaaagcaccggggtttgccacttgcgccgaataatctgcagcaattgccagccgtcaaggcccggcagcatgacgtccaggatgatcaggtcgaactcactttcctgcgccagatactggccctccaggccatccagggcgacctccaccacgtagcccgattcagtcagggctttgtgcaggtaatccgctgttttcgcttcatcttctacgaccaggatacgcatcttttcctccggaactggagcataggctagcgcgcccgagcgttttggcacattacatcttggtaatcatcaggcaatcattctgacggagtgcacggggcatcatgcctggctatgactcagccagaccacacaaaggacaaagcatgcgtataagcctatcgacttcattgctgatgtcactcgcaatgaactcagcgctcgccgttgcagccccggatcaagtgctgcagcgcaacgacgtgtcactggcaatggccaacgatttgctgaatgccgcgctgacagcctgtcatgccgatggccgtacaggcgttgctgccattgtcgaccgtgggggcaatttagtcgccttgcagcgcgacgataacgtggggccacacaacacattggccgcccaacgcaaagcctataccgccctgtcgaccaaaacgccaacacgactattggcagagcgtgcccgcaacacacccgatgcggaaaacctcaacaccctgcatgagctattgctgctgggcggcggcgtgccgttgctgtttgaagggcaagtcattggcgcgatcggcgtggccggtgccggcggtgcagcaaacgatgaaggttgcgcactggccgctatcaacaaaattttaccgactgtcaaaaactaaggacatcatcatgactggattaaaaacgttcttcgcaggccttgtattgagtgtcgtatcgtcactggcgttagcggcaggaaacccgctcagcgtgcatgtactcaacttacaagatggtctgccctcccctggcgtcaatgtcacgctggaaaaacaggacggcaagaactggaacatgctcaacagcgccgcgacaaacgagcaaggccgtattcccgggctgtaccccgatggccaggccctggagaaaggcatctaccgtgtcacctttaaaaccggtgagtggttcaaagcgcacaacgtctcaagtttctttccagaggtacccgtcatttttgaggtagacggtaccgttgcgcactaccacatcccattactgctcagcccctacggtttctctacctacagagggaattgagcgtcgactgaaaagacaaggccgcccctgatctcatgggcggcctttttgcttgattatttgaccaacgttatgtcgatcaccttcatcgcaccgctggacccgttctcgcaagccacaggcgatccgttcacgaaagcaggctgaccgcccgtagcacagcaaaaaaatagtgcccattgtcagtctggttctttcagcatatcgtgtaaaaaacttatacaagagcatggtcgatgtacaataaagtgaattggccgctgacgctgtattttgacggtgaatgccctctgtgtgcgcgcgaaatcaagctcctgcgcggccatgccgtaaaggatcgactgctgtttgtggacatcaacagcggtgcattcgacgccaaggcactcggattcacgttcgagcacatgcagtcctcactgcacgcccgtttcgctgatgggcgctgggtaaccggcctggatgccaccctatggagctggcgagccgccggcttgggtttttgggcaacgccattgacgtggcgcgcattgcgcccgctgttcgaattcggttatcgccttttctgccgcttaaggccccatttggcatggttacctcacccagatagtggcagccgctgtgtcgataaccgttgcagggtgccggcgtcaaaacccgcatcagacgagcagtccactttgaaaaaaaagcagacatagaaagcttcgctttgtcatgaccccgacgagatacggggtgtggagaaacaaaattcagtgatgacctcatccgtgatgctcggcgcctttcgggagtcctccgcgacccgtcacgagttcctgcaactgatagggcgacggggttaacaccaacacatcgcatcacaccgccggagagcctggatgaacactcccttcaaaatggattccctcggtgagggctatcgtgccctcgtaataggcgccagggtcagctctacgaagcagctcagtcgttccaggatttggcaatcccaatgagttctctgcagataaaccagaggctcctcatgaacataaatctgtgaacatctggctccatgcaccaggagaaaaccagctagtcattgggttttcgatcgctcatgaacaacaaacatcgcccataagtataatgatgtgtctggttggagcggttcaagccgactgcgcagccaagttcaacctgtccgcctgccacaaccagaaacgattggggtgcctcaagtcaattagctggtagtttcatagctgttccctaattttttactgaacccgacctcccttccaaacatttgcttgcctgcaggtcggctggagctgagcgtggcgaaggtgatagtccacgaaagccttagtcacttctaggtctgctaattcgagggccatgccatttcccacgacgtccagatcgggcagaacaacctgagactcactacagaagtttgccagcaagcgccagaacgcaattttatggtcgatgtggaggtcgttcgggtgggctatttcatcgccggtaattgcacagttgacgggccatgaaaggcttgccctgaacgcctccatctgtggcctcaccgcaaagcgtagcgcttcacacaccttcccatggtgggattgggtaacgccggtgatgcagcgcttgtaggaaaaggtatctctcgtgccgtcgatgcgaactaagtgtaagcctcggcccgctagctggtttcgttccacgcagaaatgatcaacacccacaccgatcttgcgctcagcatctggatgaagcgcaagcagaaaatgtagtttttgcgtcgctacatcatgagtgatacgcccgacatctgcggttctgatgaagtgtttcaggcgatccagaagcgcttgtttggacgggtattcgaacgggcctaaccagtacatccttgtactccttcactgctctacgcatcatcctccgcaggcacgagcactgcggcaggagctgattcgacagcagcctgattcgtgataccaaaggggatgtgaaccgatggaacgacagcgctggcggatttcagatgaccggattggtcatcgaagaaaatgtggggcttcagaacagccagtaccttgcccttttcaatacctccgaggaagaatgcatcgttggccataacgccccaacttttaagtgtgttcagggcgcgctcgtgagatggcgcgttgcgggcggtgacgatggacacacgaatacggttcttatacgtaggattgagctttttatgctcctcctcaactgactggattttcgccaggcgtaccatgaactccttcaacggccccgggttatggggctgcatgacattcttgacttcgtggtcatggaacttgacgagcccacctgtctgcattacagcttctgactcatcgccagcaaggacgccgtcaaagtcgaatgcgatgcgcagtgtatggtcgctctcatcgtcatcgaattttgagtcaagcatgcgccctgcggggtgatcagccttgatagctgcctccacgtcctccttgtctcctgaaagaaacagtgcaatgttcaatgctgggatgtactcgtagggtgactggccctgcatgaaaatcgcacgtgtcatgggaaggccgtagtgctcgatggtcttcatcacacgcatccccgtatcgggatcattttttgaaagcaggactacctcaaccagcgggtcggatgggtcatgtgagaggtcattcaccgacaggagtcgcttgatgaaagggtaggcgattccttttggtaaaggggtagctaggttcgcctcttggaacttccggtatttctcctctccttcgcttttgaacacagcgtccgattcacgcagatcaaacacggcactggaggccacaccaatgaccaagcggccttctagctcgtaaggcatacaaccctccatagatgactcaattcaaggcactttgccgccacttacaaaatagcccttagaccctaccctcaaaaactcacgcagccctgccctactgaagtagagcgccccaccaattgagtgggggacacgctttaccccatctcgcccagctgaagattttgcgcgagctaggtacatattggttcaaagagcgcttcaaccaatcagtggaaaatcatgatatggtgaaaataatcgaatgattccacccttttttcgaaggcatctgtttggcgtggaaaatacagggcttcggggctttccacttaaatcgcgattggagcagacgtccactctctcaacggatgatgtccttcgtattcatggcaagtcattgaatgaggtggcttccgatgaagctgattcaatgtcgcttctcttcaggtcagcgcgtaccgttgcttggttcagaccggggatgcggcgccgctgcccatgcttatcccattcatctacgttaatctcaagccaaggtaccgcgcctacaacacggcaacggcacatttgcgcacgatccaggctttctacacctacgctaaaactcgaggtctggaaatcgatgagaagatcttttcctgtcaccttgacgcgattctggctttattggacggctacgccatttggcttcaaggcagtcgtcaagccgacaacctggtggcccaaatcggcacagctaaaaccatactgtttccgcagatcgatccacgtccccgtaaccagtacctgcgcttggtgaagaaatacctttcctggtgcgtcacccgttacatttcgcgcgccgagcataactcccatgcgcgttaccgcagccttacagatacgcaactgtagatcgttcgcgcattgattatcccgggcgcgtgaaaattccgttccctgaacgtttgcaactgcgtagttggctaatgattgaattgctgttggagaccggcatccgccgcagagagcttctgaagctctacacctcggaatggctgacgaaaatcatccccgccgttaactgactcgagcatatctaaagcagctggacaccagacccgctgtcactcccgccatgatattcagaacaactgggcctactggtttgaagaattcgtacagatctaggttccatactgtattcataaaactaccctccttaatggcgttgattaccatcaaaattgttgggcaccgctcaaaaacaacggcagctacgagcactgaaacgaggctgaatacaatcagggagataggggctttcgaaaccccgcatccaggtagtcgtcgcgtctctagccagctagaagacgcttaaaatgtttacaggccttaccggggcctgagaagacgcgaatcttaacctcaaaggggctcagaaatccagaaaccctactctcgaaaagctcgtcgtactcatcatttttgcgcagcaagtgctcaaggtgggtccgtttagtggcggtatcaggcaatgtcttgaggcgctgctggatgttgtgggctcttaagtgaacgggcgtctgcaacacaatgatgtgttgagcttcacggaagcttttccctaaccaactaaaatagactccttcagcaatccagcgcgactgctggctgtattcgtctacgcggcgcaaccttagatctctatcagtggggctgctgaaagctcccaatgcagcatcattataggcaatctcatccaagcgaacgaccggcgcctgtattaacgctgatagccgagttgccagctcgcttttgccgctccctgggccaccgatgatgtggattcgttccaatgcgttgtccatttcgattttggtatttttcatacattaccttgacccggctcccctttctgtaatttttggtgataaaaatgatcggcatggagctcggtgggccagccaagataacagtgagagccaaccggctccgaagccccacataaccagagtatttctcgcggcctgccgggaatacccacgcagaggttgagcttatggagaaccacagtcggctgaccttgcggattttctcgtaaataagcgattggctcagaagcacgtcaggttaatccgacacggggaaattgcggctgacgccggcgaagccagtctggaacacgcgagcatcactcttacggcaaacgagatcaccaaccacgtgaccaattgttctggcaacacgctatcgaagcaaccagacgatgcaagtcggacattcagttcagaggtgtctcgaatagacgtagatcagagcgccccatgcacaacctaccaagacactcgcgatccagaccgtatgcacgccgaagaactacggcatgggaagatatttgtgcgggccatttagtggaccgccctcgcccactgatctgcaggtccagacgcgcggggcgataaatgcaaaaagggaacgcccctggcggagcgttctacctttgtggctcagcggcgaaagagacgatctagaacgagcaaagcaactgcaccgatcgcgattgcagcaactggtttttctttaacaaatgtagatacgctgtccagtgcatcgccataggtttgggtcaactgaccagccacttggcggccatttccttcagcctcgagcttcgaatcaccaaacaatttaccgactgcgctctgcgctttgccagcaaccttgtctacaaccccttctacctgttcgctcttcatgattcaccaaatgtcgtgtgtgagtgagtacaccagaaaaacctgggcttgatgcaatctgcacagcgttagggggacgagcgtaatgattagttcagattggttgcgaactgagtttcatgcccgtcggcatctcgcgacaatggggaggccttgataccggcacaatcactccgggttaggcattgcttaccctcagcatttgcacaccgctgaggttgattaaagcagaagaaaaaaggcgctccgaagagcgccttgaacaaaattattgcaggcttacctgacgctggtctggcttgccagcagtaccgatctggatgcgttttggcttggcttcttcgggaataactcgaagcaactcgattgccaacaggccatgggtgagtgatgcaccttgcacctcgatgtggtcagccagccggaaagacaagcggaaggcccgctgagctatgccttggtgaaggtaagtcaccttctcatcgttttcgcgttttccaccagaaacgttcagtacgccattctctacctgaatgtctatgtcctcctctgtgagacccgccactgcaatcacaatgcggtattgatcatcaccatgtttctcgacgttatgaggtgggtaggtattacctgcctcactacgaagcgccgattcaaacaggtcgttgaagcgatcaaaacccacggactgacgaaacagaggggccaaagaaagagtagtagccatagcaaaatctcctgagttttctccaagtgatttaagacgcgacccgttttcggcatcgcgtaaaaccgaaaataggtactcccaaaacattttcaagggcgcctcgaaaaaaattttccaccccaatttctcggcttaaaaccatgggcacagcgtgccgcacaagcgcaggtcttaagcaattctctctattcagaacgcgcctgcagcgagcgaattcgtcagctgctggagggcaacttgctagtcagacaggtcgcggtgccgcaaaagccagcaaagcaggccgagtaccaacgtcgcgaaacctagtgccgcaatggtcgaagccggagtgacggccgaatccaggatgacaaattttcggctaagggccagcaatgcaatcatcagtacggttcttacctgcaccacgctgttgcgcctgagggcgggtcgcactatcgaatgcttgaattccaaggcaatcaataccgtgaaaatggagccgaatagcgcttggaatgcgttgtgatccagcggatcaatggcgcctcctatcagaaggggcactacattcctgcagagctgcatcacggcgataacgatcaccagcgctatgatcaggctcagcgtcagtaccaccagttgctcgaagcgctcataggcgctcatcaaagcccactggattttaaagtttttgaatgtcgagttactctcacgattttctggatgaagcttagacacgacctctctcctcttatcttggaggacttatgtaagatgcgccccgtttcacgggctgaccaagtatgggcacccgaacttgatatcaaggacgtctattgaaaaagtcagagcttccagtcaaaacctgtgcaacctgtgggcttcctttcacatggcgaaagaaatgggcccgttgctgggacgaagtacgctattgctcggagcgctgcagacgcagcaagtcactcaacacctgaataaaaaaagcactgtttaagccctttgatgttcaggcgaagatagcttcgtcagccaggactaaaccgtgattgaattccacaccgaggggaatggtcacctataaggagaatagaagacgacaccgagccctttggagcccctggatgtatccgataacacccgatggtcgctattttttagttaacggcaaactttggcgctgcagtaacccgtcactacccgcagacgctcggcagaagtgggttaactcgctcatggaagcgcgtcgtgaagtaaagaacgctaaagcgtcaggtgatgagacgctgctgaagggtgcgagggcgcgggttcagaaggccaaggtcgagctgggtgagcgcgggccggtatggtgggatgatggttcccccgactttaatcagtgccaggtcaaaaacacgccctattcgcagtggtataactctctcggtgctgcacaaggagataaagctcgcacataaagccagttcgcaagacacgctccactgcgtcagcggcagcttcgtcacaagctcattccacgtaacgcagccaaagatacgtccgaccggagatcgcctgtgcgacttcagaaatgcgtgcttgcaggtcttcgtcgccggtgttgtaaagcgcacagaaatctcgggctactgcgttaacgaggcatctatcagacggctcagcacgtatgaagccgatgtaagaggcgcctacgcccatcaactcatagccatatgcttctgaaaagtgacgcgcaactgcaaagtttttcgcaggatccaggtcggaagtgaaatagccattcggaaaagccgcgagtgcctggcaagaatgctgaacgggcaccaggagggctgaaaggggctgatccaggagagagacagggttgttctggtagccgatccactcctgcatggcctgctgatccagcgtcaaaccatgcgcgcaagcatcttcgaaagacgtggctgcaaccaggttcatgaaattgcgatagcagattgcaaactccgctttcgtagtcggatagcctatgtattcaccattttcgaagcactctggaggcaaactcgctatgtcctgctccgatgcatcgtccatccctgaattattgcgcgcatgccccgaggtgtagcgagcttggtgcagatcatcgagcgagaacagaggtttaaagcctgggtgcgattcggcaatcttgcgacgcgcttcggtcaggtcgtcaaagcgggtaatcccgctcacgccgtactcatcgcatgtacctatagacgggttgtcacgcatgccattgccgcgaaattcgatatccataaaccgtggcctgctccatggtgctactgaattgaatgagtaatcctaagcgttccaggatcatcattgaaggtgtgccgccaaacggctatcgatgagtgtccgcctcctcagccggataaaactcgccttccctacccatcttttccaaccgttcgcgcaccaccaactcaacggtggccactgcagcttgatcgtcagggttgaccacctgcacgcaaagacgtcggacattctgatcgtgggtgccctcgctcatcatttcgtgtgtgaagacgtgttcgccacgccataggcacagctggttatgcgtcccgcccaaccatatctcattgattgatccaaggtcggtggtagccagttgatcgacggtgattgtcttatccattgcgctgtaccttaccgatgtgtagataccggtagactttcaggcatagcgggtcgttccaagcgtcggcagttcaatcgcgcagggtgccaatcttgcaaggtcgcgcccagacgccatcgaatcggcctttcaattttgatgaagatctgccggctctgcgtttgcgggctcaaaaagaatttcattcaattcatccaccagacttctcaaacgatctggtagctcaagatcctgatagattccggctgccaggtcgaaattctccttcgacagcaaaagatgaccttgggctttataaagcatggcgaaataaccaaatacctccgctcttaacttaggatacctgttcccttcttttaccagcgcctcatccaagtatttttccgccttccccagctcagacgttttaatcatcagatgcccaaggtttacaaggttcgtcaactcccctaaatggtcgtcgttaccgatcgcagcgttataggacctgctcaaatatttctcggcaagatcatacttccccatgtccttatacacatttgacaagtttccatagtgacgggtcagctcggtcttttcttgactcatttcagcgatggatatggcatcaaaaagaagtgatttagcctcatccaatagcttcggctcacgacgcttcactgccaaatatcgcaactggatagctgtatttgtcagcaaattacttttcttaaccatcaaacgtttccgctcatcaagatcatcctcaaactcgatcgccttatcaatgaacgcgcgagcaacttttaagcacctcccagcgcgaccgtatttttcgagatgattgtagcaactgcctaggttgttatagtggttcgcgaagccttctgtgtctgatttgcctgtcaacttcagagctgttctaaaatactcaacagcttcgggataacgcgatcttttcttagcaagaatgccgagattaccgtttaaatgctcacgctggacttgcgtcagaccaggagaatccaagcatgatttaaacgtcctttcggcctcgtccaactgacccagcttcatcaggtttagaccgtgaaggttggctgacgccacaccttcaggctgcaaaacggcggctttttgataaaataattcagccttcagtgggtcgacgagcgtgtaaaggttcgccaagctatagagcttaccacctgcctctttaagtacaaactgcgcacactcatccaatttcttcttggcgagctctgtttttttatccttcactaattgaatgacttcctgtcgaagaggacttgcaccatcaccctcctcaccaaacgttacatagctattcaaaatctccgcatccaaggcaccactgaaagcgtcagtcaaaaaaggcatgcttcttttgattttcgaatgcaggtcagataatacctcgaaagaagcgtgcctcgcttcaattacaattctgcaaaaatcaatcacatcatttttatgattgaaatccagtgcactgggctttatggcgtaacttttctgcctgggggatagagtgaaaactatcagtcgcgttaaattcaaatcgtggcaggtgatgcaggcaagcgtttcgtttatttttgccgcacctttctttgaggtaacctgaactccaaccctgctgtcaggatcaaacaaatctatgcactcatgattcggtttgattttattggcattcaccaagctccagccaaaaatcgcattcagcatatcagccactaagtcttcagcagcaatattggtatctgagaaattaagctttgtgtaggtcgctataaaactctgcagggtggaaagtccaaaatttatatcatcaagcatttttttggctttcagcatctgcaagtccttatgagaagatttcgttagcgcgaggttgtgcgtaaacagtatttataacaataacatgacgatatcaaaaagccatcctagcgctagcaaatctcgcgctaaacataccgttgaagcctgacagactcaatcgcagtacgagcaaaacggcctcttccgggaagcctatcctgcatcacttgctcggaattcccaatcctggcttgcgcaggttctggcaggatcattcagggtcggctactttgaagaagcggcatatggagtccgtccgcgaacatcgctctcttgtggagaattcggatggaaccggtcgatacccctgatacttcaaaacctgatacttcaaaagaagtcccttcgctcgaagccctgattcgagaacgccgaaatcatatacagcaatcgtccggcgctgagtgccagccagagcgttgggggcttgcgctctcagggggcgggattcgtagtgctacgttctgctatggcctgatcaccgccctggccaaggcgaaggtcttctggcgcttcgacctgatgtctacggtctcgggtggcggttacattggctccatggtcggccgaatggcacagacgacggcatccgcggagcaattgcagaatcaactcggcgaggaagacagcgcttcccaccaccgcaagtggttacgtgccaacagccgttaccttactcctcgcggtagccgcgatttgttgttcgttatcgttacctttcttcgaaacctggcgggcgttcaccttgaactggggtgtttagggttgctgctgggctgtgccctggcgggtgtcgacctgctggcctggtggttgctggacctcttcatcagtcactctcaggccttccctaccgataccagtccactccaagtgtggaacgctgtctcaccctggccgacgctttggctagccctgccgatcccggtgctgtgggctgctggagcggcgacctggtactggtacctgcctgctgcaaaccgtacaactgcgcaaacggattctgcttggcacagggtgacggatcagttggccattgctctgtggattggggcggccatcgtgctgctcggtgcaatcgactggatcgcctggcacatagccaagaagccctatcaacttttctggctggcgggtggactgactgccatcctggccgcgttgcgtaccctgctcccgctggttcaacaaggtgggcgctcggtgagtgagctcatccgccagcgccttcctatgctattggatctggcgggcaagttcgggcttttggtcatggcgaccttctggaccagcgtcgttcatgcactaacgacccaccgtgtgtgggatgccaacatggaacaggttgacttcgtcggcgctgcttatgctgtcgggattcttgccagcatttcgctcgcgtggattttgatctcggggcgcaatctcgactttctgaatcgctcatcactgcataacttctatcgtgccaggctcacccgcgcctacctgggagccgcgaacccggaacgggaacatgattccaaggttacccaggtgcatgctgcggacgacgtgcagctgaaccagtacacgccgcacgccaagggaggcccggttcacattatcaatgtgtgcatcaaccagacctaccagcgtcatgggctgcacaatctcgacaggcaaggcgagttgatgtcactcgtcggccctggactttaccaggtctcgggcaaggcctggcatgcgctgaaagccgatgcgcgcgcgacgctgggtgcctggatggccatctcgggggctgcggcggcgcctgggctcgggtctgccacccgcccaggcctggctaccctgttgacaacactgggagtacgcctgggctactggtggaacaccgccgataaagagcgatcgcagccttggtatagcagttggttgcccaagtacacttacctgttgtcagagcttttggcccggttctcaggaagtgacagccgcatccagtatctcagcgacggggggcattccgagaacacagcggccttcccgctgctggcggcgcgctgcaagttgatcatgctggcggactgcggatcggaccctgactatcaattccaggatctggaaaacctcattcggcgtgctcgcatcgacctcaacgtcgaaatccgtttcgtcaaaccagcccatcaaccggtcgaacttttcggctccctcgatgacctggcgtccccgactcacccggcttgcctggcgcttgctcgagtggattatcccggcgacgacgtccccggcgtgctggtactggtcaagccaaacctgacaactggcctgccggaagacatctacaactacagtcgcgactaccccgcctttccccaggaaaccactgccgatcaattctttgacgaagcacagtgggagagctacttctcccttggatgtcaccttggcaaggaattgaacgagaaaacgttgctgtcgctgacggaaatgatccagcgcggatgcggggcagtaacgccctcggcaccgaacgatgagacagcaacatcgccacaggacgatgagacaccacccagtgcgcagcgcaggccgggtcgcatcggcgtgaaatcagctgctgctgccggcctgggtataagtgctattgcctcagcggcttccgcgttctggcttgctctgcagaatgtcagtgccgacagcggcacagcctccaggatcgatgtccagtcattacgaccgctgtatgacacttacgccatgttgtcgctcgatccgaacagcaaaactgctgacgaatatgtggggcgcatggccgctcagttgatgaccacatggagaaccgtacgcgccaataagcaggaaaccctggtcctggacaacaacgaaaccctcgacatgctgcgtacgacctacagcctctgccaaccattgagtcacaaactggcagtatgcaagacgctcctggatacattcgagtgccctaaaaagccagcgcccacctccgcggtcagccagaattttggctactgggctcgacacgatcccaccggctcaccgcgtctagctgcgcgggccaatagcagctattgccaatcaaccgacagtgttgtctctagccagcaactggcggtggcgaccgtagcaccccaatctaagcggcaggaacaacagcgagcggcattagccgttgcagccgcctccagacccaaggcagccgcactggcaaagccagaatcaccaaagcccgcggcagagacagtcacacaaaccaaagcggtggaatcagcaccaacggcagtggcgatgccccagcctgaagtagcagcagtgccagagagcgaagtaccagccttagccgcaactgcagagccagaaccaacggcgctggcagcgcctgaggccgaaccggcagaagttccgcctccagaatcagacacgtcaacgtcagtgccctcggttgcagcggcgcctgcccctcaacccgagtcagttccagcggacgaaatagagttatcggcctccgaggcccctactcccgagaaacctgcggaccccgtctgcaagggaatcaccctctacacacagatctatggccctgcaggacgcgacaatgtgcgcaccttgcgctcgctttggcgaaccgtcggtgcctcggtcccccccatcgaggacgtgctggatagcgctcgccgtcaggggcgcagcggccctgcgccttatagcaagccaacggttatttaccatcttgaagatgccaaggcctgtgccgaatcacttgcaacagtggcctttcagccagccggaagctgggatgtcatgcctctgaacaagcgcctgtcccgcttaccccgcagcgtcgaagtctggctgccacctgttgccgtagccgccggattcgaccagtgggccagcaactatggtttctgctatcagcagcacgcccctaacggccaggatgcgccgtcttacagcgttcactgctacccgagccaggctgcctgtgcagaagcgcaggactccaacccaggcaaacgccaatcggcctgcatgggcactgaattgacgagtaatgaaaacaacacgctgctgcctttcagcggctgggccggctcccggtacaacctagatagcgccgaattcaaaggacccttccctcccctgtcgcaatagtgcgtgtcatcacgcattcacggtatcagggtggtcagtggcgacaccgcggacgccaacaatggtttgaccgccgcgggaaagtattccacttgcagcgggtactcctgccccatcaaccgccctttgccgtaccacaggataccgccctgacggagcaccagaccattgcggccgaactcgaaaacgctgccgacagaactcctgaacaggaagcggctgtcatccatttgcagcagcgtgtactgcgtgttcgcaggcggcagttgttccttgatgcgctgcagataagtcggggccaggcgggcaaacaactgccctgcctgttcacgatattgcgtgagcgtcagccccggcttgtgctgcagctcaacggcgatcagcgcgaagacatcggcgttggcccttgccaaggccaacttgatcgacagcgctgacgtcagcagcgcgttatcaatctgcaacgacgatttctctggctgaccgttggcagccggtgcaacgacggggcgcatgaattcggccacgttgactgccgacagcacgctcgtcgccaggtacgcggcacaggcggtggcctgacccggctggtcaccattgaccagcaacgaaaatgggctgccttgtcgaggcacagtctgcgcgtcaatcccctgctgtttgagaaaggcgttgacctgttcctgtttcacttcgccgcgtgccaatgcacagagctgctccatcatcggggctttgctcgcctcgttgaacctgggcgacatttgcacaatcgcgtcctggattacaggtaatgcagggacacgcagccagttacgcggagtctgcgcaggctggtccgtcaggagtttttcgtaaccggcccaggccgccaacaggatcaggatggcgacggaaatggattttatattcatgttttttgcctgcaaaaggttgataaagggctgcgcaagacgtgcccacgggtcaccactgataaccaacacccaccgccaacccgatattgcgctggctgtcggtactgccctgtaacttggtcacccagcggccattggctgacatgtgcgacacaccgaaggccagcgacgattggccgcgataggtggccgctgcggccgtcgtcatgctggaacccggcgagtacgactgcggcaagctggacatggccatggcgccggcgatacccgcgctgagaatctcgtcctgatacttgaggtcttttttcaactccgtgtagcgctggtcggtgtaggcattggcattcgtggtgatgtccgccacgcttcggttcaactggtcgaggttcaccgcatccgtaccgcgtgtacccgccgcgaggttggtcagctgccgctcattgccggcactgccgaccgaaacactgttgtcccggtccgccaccgaattggctcccaatgccgtggcattcctggccgaagccttggccccgttacccagcgccaccgagtttgccccggtggcctgagaccgcgtaccgaccgccgcgctgttgttgcccgaggcctgcgcccctgccccacccgcgaccgcatcggtacccgtggctttgggcttagcggcggcactgctgttgttcacctggaacatgccgtcggtgccgttcttgaggttggtgacatcgccttcgacggcggtgatgcgagccccctgctgacccgtttctgcgtccagattggcaatcgaatcgtccgtgtattgcttggcttcggccaccgcaccgtcgagttggcgcacgttgaccgcatcagtggcgttgttgccgtcggccacgttgctgatcgtccgggtggcgccggtagtagcattgcccaccgataccgtgcccgaggtcacgttgttcgctcccgaatacttgccgctgtaggtttcggcacctcggccagcatcgctggcgtcgctgccgatcgccacgctgccactggcagtcgccgtggcgccgctgcccaccgccaccgagccattgccagaagcctgggcctggggccccagcgccatggcatctgtaccggtggcggcggagtcggccctgaccgagttgacgtgcagatacttgatgccaccgcccaccccgatcagtgtttcaaggccccctacccgaccgtcgaggttagtaatgtccgaggtgttctgatcaacctgcgtgccgagtactttcagttgcgccacgttgaccgcgtcggtgtcctgcgtgccggccgccagcccggtcagcttgcgactgcccagcgccgtaccgatgccgatctcgccgactgacgtctgcggtgcggctagtcgataggcgctgtagtttgtttcggcgccgaccgtggtcaacgagcttgaaccgagcgctacgctcatggcttggctggcattggcgccggcgcccagtgccaccgattgctcggcggctgcctgggcggcgctgcccagggcgatgccggaggccaacaacacttgggtattgcgaccaatggcgataccaccggcggcggcttggctgacagaggcctgattgcccaggccaatgccgttgtcaccgttgaccacggtgcccgggccgaccgcgatcgactcgctaccgctggcgagcgagtccgtcgggttggtcgagttggcgtggaaatacagtgtgccggtagaactcaaagagcccatcgccccggtcaattgacgcaaggtcacggcgtcgtgagcgtcggtcgcatccgccacgttggtgatctgccggtagctgccggccttgcccaccgacaccgaccccagcaaggtggaatccgaggtgtcgtagatgatcgttccgcttcccgccgcgatagaaccggtggtgggtgccaggacacggtcggcgaccgaaccttcgccgagcgcaataccgcccgccacctgagcctggctcagacgtcccagcgcgaggctaccatccgccgttgcattggcccccgaaccagccgcgaatgaattggcacctgcggcaatggattgtggtccgatcgcgatgctgtccagaccgttagcctgcgagtcggccagtgtggagttgctgtggaaatacttgatgcccgtgccgttgttgacgaggttgtcgacggtcagattggttgcgaacagctgcgagccatttaccgcatcggtgctggtggcgttcaaggttcctgccgcaacgttggtcaatttcaccgccgcgcctgcggggttgaaggtcacctgggttttggttgtggcatcgtcgtatttcacggccaccgccgcggtattggtcacgctggtgttgaggttggtaagtgctgcgccaacattgttgctgaccaaaggcccggtgttggcaccggttgcgctgatgctgttggtggaatagcttggcgcggtccatacgcccgtagtcgcatcaagcgtagcgccgccacccaatgcggtcgcggtgtcctgccctgctctgttcagttggtcgacgttgacagcatctgtggccgagctgcctgcggccaggccagtaatgcgacggctatccgcgccattggcgatgttcacttctccaccggttgccgcgccacccacaccataagccgcgttagccagtgttgcgccgatggcagatgaacccgaacccaaagcgatgctgttggcgatgctggccgtggcgccattgcccagggcaacgctgttgacaccggtggacacggcagccggccccatcgccacgctgtcctgcccggtggcgctgctgtcggcgagggtcgaattactgtggaaatacttgatgccggtgccattgttgacgaggttgttgacggtctgattggttgcgaacagctgcgagccattcactgcatcggtgctggtggcgttcaaggtgccggccgcaacgttggtcaacttcactgcggtgcccgcagggttgaaggtcacctggtttttggttgtggcatcgtcgtatttcacggcaacggcggctgtgttggtcaggctggtgttgaggttggtaagtgctgcgccaacgttgttactgagcaaaggtccggtgttggcaccggttgcgttgatgttgttggtggaatagctcggcgccgtccatacgcccgtagttgcatcaagcgtagcgccgccccccaaggccgtcgcggtgtcctgccctgctttattcagctgactgacgttgacagcgtcggtcgcagaactgcctgccgccacgccggtaatgcgacggccattggcgccgttggcaatgttcacttccccccccgccgtcgcggcaccgccgacaccataagccgcattggccaacgtcgtacccgtggcggacgagttggcacccagcgccacaccattggcaagggttgcgctggcgagcgggccgatggctacgctgtcctggccggttgcgctgctgtcggccagaaccgaattgctgtggaagtacttgatgccggcgccgttattgaccaggttgtcgacagtctggttagtcgcgaacagctgcgagccattcactgcatcggtgctggtggcgttcaaggtgccggacgcaacgttggtcaacttcacagcagtgcctgctgggttgaaggtcacctggtttttggtcgtggcgtcgtcgtatttcacggctactgcggcggtattggtcaggctggtattgaggttggtgagtgctgcgccgacgttgttgctgaccagcggcccggtgttggcaccggttgcgctgatgctgttggtggaatagttcggcgcggtccatacgcccgtagtcgcatcaagcgtcgcgccgccgcccaaggctgccgccgtatcctggccggctttattcagctgactgacgttgaccgcgtcggtggccgaggcacccgcggcaaggccggtgatgcgccgaccgttggcgccattagccacgttaacttccccgccagtcgtggcagtgccgccgacgccataggcagcggtgcccagcgtcgtgccagtggcggaagatccgctgcccagggccacggagtttgccgcccctgctgtagcgccattgcccagagctacagcattggtggcggtggaactcgcggtcgggcccactgcgacgctgtcggtaccggtggcagtaccgtcggccaaggtcgagttggcgtggaagtatttgatgccagcaccggaaatgatgttgttcaccgtagtgcccaaactgttcacggcggtattggtggagaacaactggctgccgttcaccgcatcggtgctggtggcgctgacttggcctgcggcgacgttgctcagttgacgttcgttgcccaggctgcccaggctcaatacgccgacaggcgctgcccccgcgtaggtgtaagtggtgccattgatcaccccgctggccgtggcggtagcggccgcagtcgtcgcgccgctgcccaaggcgactgaattagccgtcccagccgttgcgccattgcccagcgctaacgcgttggtagcggttgcgctggcggtaggtcccactgcaacgctatcgacacctgtcgcggtgctgtcagccaaggtcgagttggcgtggaaatatttgatacccgcgccgttgttgatgttgttaacagtggtgttggtggcaaacagctgcgacccgttcaccgcatcactgctggtggcgttcaacgcacccggggcgacgttggtcagcgttgtcgccgccccacttgggttgaaggtgatttgagtttttgtggccgcattgtcgtatttcacagcaaccgctgcggtgttggtcaacccggtgttgaggttgcccagggctgcgccgacgttgttgctggtgagtgcgccagtgttggtgccgctggtattgatgctgttagtgctatagctcggtgcggtccaggtgccggtcgtaggatcaagtgctgcaccgccgcccaaagcggtggctgtgtcctgacctgccttgttcaactgactgacgttgactgcgtcggtggccgaagcacccgcagcaaggccggtgatgcgccgaccgttggcgccatttgcaatatttacttcaccgcctgccgtcgctgcaccgccgacaccgtaagccgcattggccaacgtcgtgccggtagcggaagcgccgctacccagggccacagagttagccgaccccgccgttgcgccattgcctagggctaccgcgttggtggccgtggagcttgcggtaggtcccactgctacgctatcggtaccggtggaggtgctgtcagccaatgtcgagttggtgtggaagtatttgataccagcaccggcagtgatgttattcaccgtagtacccaaactgttcacggcggtattggtggagaacaactggctgccgttaacggcatcggtgctggtggccgtcaccttaccggcggcgacattgctcagttgacgctcgttacccaggctacccaggctcaatacgccgacaggcgctgcccccgcgtaggtgtaagtggcgccattgatcaccccgcttgccgtggcggtagcggccgccgtcgtcgcgccgctgcccaaggcgactgaattagccgtcccagccgtcgcgccattgcccagggctacagcgttggcggcagtggaactcgcggttgggcccactgcaacgctatcagtaccggtggcggtgctgtcggccaaggtcgagttggcgtggaaatatttgatgcccgcgccgttgttgatgttgttaacagtggtgttggtggcaaacagctgcgacccgttcaccgcatccgtactggttgcattcaacgtcgccggtgccacgttggtgatcgtcaccggagcacctgctccggcgccacccgtcgcccccagcgtgatcttggtgccgccggtggcatcgtatttgacggcgatattggcggtgttatcaacgttggtgttgagcgcggtcaaggcagcggcaacggtggtctgcgcggtaggcccagccacggcaccggtagcgctgacactatttatgggctggctgaagccggtgatattgcccgtcgccggactgtaggtcgcgccgccgcccaacgtgctggcgcttgtggtgcccaggttgttgacgccggtgacgaccgaattcagctgagagccgttaatggcatcggtgctggtggcagaaatcacgcctgccgcaacgttctggatctggcgctcagtaccagccgcccccaccgacaccacaccattggtcgaagctgctgcttgcacgccagctgcagtagcaccaaattgcgccgtagtgccggtatgcggtgcagctgtcgttgacttcgaacctaacgccacatcgttggtattgttagccactgcggtatcgcccagcgccacggcgcctgctgcagccgcattgctggcgtttcccagtgccaccgaaccttgcccggtggctttattattgttacccagcgcgacagttccttggccgttcgctgtgttatcggcacccatagcgaccgcgcctgtgcccgtggcgacgttcggatcaccgatagccacggcaccgttccccgtcgcagtgtttccggcaccgatcgaaacggctttgccaccctgggccagcgcgctatcaccgattgccacggacgaggccgagctggttgttgcccccttacctatagccacgctgttggtcccgccggaaacagctaacggccccgttgcaacgctgtcgataccggtagcggtgctgtcggccaaggtcgaattagcatggaaatatttgatgccaccaccggcagtgatgttattcaccgtagtgcccaaactgttcacggcagtattggtggagaacaactggctgccgttcactgcatcggtactggtggccgtcaccttaccggtggcgacattgctcagttgacgctcgttacccaggctgcccaggctcaatacgccgacaggcgctgcacccgcgtaggtgtaagtagtgccattgatcaccccgctggctgtggcagtggcggcggcagtcgtcgcgccgctgcccagagcaatggagttggcaatactcgacgtagcgccattacctaacgcaatggcgttggctgctgtggcactggcggtaggacctaccgcaacactgttagtacccgtggcggtactgtcacctaaaattgagttggaatggaaatacttaatgccgccaccagaagtgatgttattcaccgtggtgcccaaactgttgatcgccgtattagtggaaaacaactgacttccgtttaccccatctgtactggtggaagtgacttggccagccgcaacattgctcagttgacgcgcgttgccggcgctgcccaggctgactacaccaataggcgctccacctgcgtaggtgtaagtcgtaccattgataacgctattggtagtggcagtggcggcagtggttgacgaattggcacccagcgccaccgagttaagggtagaggcgttagcgcctctacccagtgctatcgaatttacagcactggccccgctagcatacccgagagcgaccgccccatccgcagtagcgttagccacccgtcctatcgcaacagtgccttcaccgactgttgcgctcgtggccttagcgccgtcgcctaacgcgataccgtagttagtcgcggttgcgccactgattgagccaacggcgatggcgaaactatcagctgttgtattacctgtactgctcgcagagatagtggccccttgtattgctgtacccgcccacgctgccggcaatccagcgagcagtactgatagagtccctacaacctgtactgcttgtacattcagttttctgatacggaaggcgccactgcgcccgcttttggtttgtcggcaagccaattcagaggccaccatccagcaacctatcgaagcgttccaaaccacagagtatattttgttcattttgttaatttggcgagagccaacctcgatatccgcgtcatccattgcgtgatgactgccgccttcaattcgattgcggatacagagcctcgtcgacagacaccgaatcccatccaccaacgatgagaatcgaacttcgctgacgtaacgagcaggccacacaatggaattaagtaagcgtattttctcgactgtctctacggattaagtcaggaaacttcctgctatttgtaggaaatttcccggcaacaactatgagcgcccctttcgaaacgcataaaaaaacgccaaagagccatcaatcaatgctcgttggcgttatgcgtttcctgaataagttaaagccatgcacattgagtggcgcgctcaataacttgccgttatccctcgctgaagttccaaccagttcaataaactggccgccgacatcggccgtgcgcacaagtagccctgcccttgcttacaccccagttccagcagcacttggcgttgttcttcggtttcgatgccttcaaccaccaccgccatgcccagcgcctcgccgagggccagcgtgctactgattaccgcgcgacgacgcggttcatcttccagcccgcgtacgaactcgccgtcgagtttgatttcgttgaacggtaactggcacagccgctgcaacgaagaaaaccccgcaccgaaatcatcgatagacagactgcaccccatcattcgcagacgcaccaggctttccaggctgatcgccggttcttcgagcaatcccgtttcggtcagctcaaaggtcagccccgaacccggtagatcatgcgccgccaacacgctctgaatctggcccgtgagttccggtttgagcagttgccccgcgtgcagattgagcgcgacattcaggtcaaagccctgatcgagtgcctggcgctgtagcctcaaacaggtttccagctgttggaacagcaactcattgagcaacccgcaccgttcgataaccggcatgaacaccgcaggtggcaaaacccctttgaacggatgatgccaacgcgccagcgcttcagcactgcatacctcacccgtctgcaaattgaacttgggctgaaagtaggtgtgcagttgatggccggcgagcgcccgacgaacctcttcctcggtggccggtgcgacaggcagcacacccgattcgctgataggctcgttcaagtgttggtccagcaacgcttgtaacgccccaggttgtaaaggcttggtgacatcgtccagcagcgcgatgccgagcagcgaaatcagttgccccagcacactgcgcgtatcgcccggcagcgtgcggctgatgatgatcgacccggtcagcccggatcggtccatggcctgcagaagatcctgagcgccggcactctctacaggcaaatcgcacagcgtgatatccactggaccgtcctgttcgaggaatgcaagcgcgtgcaggctctgggtggccacaaagacttcctggcagccggcttggcgcaggcggttggccagccttgacccagcggaagccgtgtcggccagcaccagaatgcgaagagggagcatgggcatggacgccgctcacgttgaaaggaatgagcccattgtcccggccgagccagcaggtatctttaggaaacttcgctgtagatgtaggaattttccgagtcgcgatcgacatctaatcaacgtcgacgctgcctcccttctcgaccgcttgcggatcagctatctcttgttccagcgtatgccccagtcgttccatcgcttgttgcaatgcatccacggcctctgtcagcgcggcattgtcatccccccggcagacctcttccaactgctcgcaacactgaatcagtacgccggccttgataatccgcgcgccgcccttgacccggtgagcgagctcggaaaggccggaaaggtcgtgcgcgccgaacagcttgatcagccgcagcatgtcctcttcgttgctgttggcaaggttcctgagcaacttcctgatcgcggtctgatcgccacggttcaactgctgcaggctactaaggttgatgtcgccctcgacaacagggctcacggcgctcttcatcggggactccccagactccacgcaggcgagtcgggcactcaggtcactgaggctgatcggtttaaacagacagtcatccatgccttctgccaggcagcggtctttttcctctggctgagcattggcggtaaggccgaagatcagacagggcggcgcccccgatgagcgttcttcgtcacggatagcctgcgtcagttcataaccgttcatgaccggcatgttgcagtccgtgatcaccacatcgtaatggccatttcgccaggcccgcaggccatgggcgccgtcttctgcgtcgctgacgctgtgccccaggtaagataattgctgagtgagcagcaagcggttggccggataatcgtcgatcaccagaatgctcagcatgctcatctggtccgggagtttagccgcccgccgctcggcagccggcacaggttgcaggaccatcagatcgaggccgatatcaatctgcgtacccttgcccggcaaactggtcaggtgcagatgcccgtccatcatttcacacaaggttcggctgatgaccagccccaaccccgaaccaccccgcgccgactgatgattgttgcgggcctggccgaacgggttgaacaacagcgcttgatcctcggcgcaaatgccgatgccggtatccttcacttgaacatgaatcgccaggcgctcgccgcacgcgctcagtagcgcctgaacgctcaagcgcacctcgccttcgtccgtgaacttgatcgcattactcaataagttggacagaatctgtttgaaacgcagtgggtcgattaacacatcgcgcttggccttgatgtcgaaatccagcaacagtcgcagccctttctgccgcgccacgccctcgaacatgcgcaccaccgactcgaccagctcacgcaggctggcccgctccggtgtcagcgacaagcggccggactcgatacgtgaaatatccagaatgtcgccgatcagatccagcagcccgcgagccgcgcctgaggccacttcgatggcgaagcggtccatgacgccttgatcagccttcttcatcgccagctccagcatgccgatcacggcattcatcggcgtgcggatttcatggctcatggtcgccagaaaggtggttttcgcccgattggcgtcgtccgcactttgcttggcgctatgcagttgatccatcaggcgttgacggtcgctgatgtcgatccagccggcaataatgcccatcaccaccccttcactggtgtgatacggcagcatccagtgatacaccgtgtgcaccacgccatcggtgtggatgtaggtgcggtctttaatccatcgcgtgccgctctccatgaccttgatgtactcggcctggaacgtctcggcatccgcgcggccaaccaccgggctgtcgatcagtcgcttaccgatcacggcttcgcgcggcaggcccagcgcgtcaaggtaggcgcagttgcaactgatcagtcgcccttcacagtcgcgcacataaatcggatggggcgtgccatcgatcaaggcacgcatgaattccatctggtcattgagcgccagttcggcctttttgcgggtggacaccagtttgcgcagacgcacgttccacagcagcgccagcatcaacaacaacgcgaagacagcaaagccctggatgaccgccgaacgatactgcagccaactgtcgttatcgatcaccacgtcgtggcgccagcgtctggtcagttcatccagttcctctggcggaatgctttgcaggaccttgtccagaatcgagtacaactccagcgccccgcgatcggtggcgaacccggtggttgccagcagcgggccgacaagaccggccacccgcagactatcgcggtactgacgcataatcatgtaacgcccgttgagcagcgaattgagcgccccgtccgcatcacctttgtcgaccaatgccaatgcctcggccgaggtggtggtctcaatcaattggatgcccgggaatgtctcacgaatgtaatcctgcaatgcattgccacgccgcatcgccaggcgtttgcccaccatgccttccagggattgcggttggtcgggccggtcctgcgtgatcagcacaaacgggctcgtcaggtaaggccgggtgaaccgcagctccccttcacgggcggtgcttggggtgaaggcgacgatcagatcggcactgccggatcgtagctgatcgaccagcttttccatggagctgctgcgcacgacatcaaatttcaggccggtgcgctggctgaccttggccagcacttcggcgccgataccgcggaactcaccctgcccatcaaaaaaggacacaggcggaagaccgtcgttgacggccacggtaaggcgaggatgtttttgcaaccagcgttgttcggtttcggtgaactgcaacggttcggggccggctacattcaggtccccggctccccagcggtgcaatattgtcatgcgctcgctgattgggatcacctccagtgcagcattgatgatgcgcaaaagccgactgttgcgttgattcagcgcgaatgagaactgggtggacacgcccgacaacgttgtcaggtacacctcattgaggaagtatttgcccaccagatagtgagtactgacggcatcgcccagataagcatccgcctgactgaaggccaccgcgccgagcgcgctttgcgccgatgggtgcagctgcagcgcagccttcgggtagttcgcgttgatcgcatccgccggcagaacctgatcaacgatagcgaggcggttgcccgccaggtcgggcgccaacaccttgctggtgccactgcgcgtcaccagcaccgacggcgcctgtacataggcgttggtaagcatcaggtcctgatcggtgccatcgaagctgttgacgttgcccagcagctccagctgcccgtcccggagcgcctgcatcgcctcggctcgagaatcataacgaagcacttcgatctttatgtgcagcatgctggccagcagcgccgcataatcagccgtgatgccctcgtagtcctggccaccgcttatcatgcccaagggtgggttgtccggcagcgatacccccaggcgcagtgagcccttgtcgcgcaaccagcgccagttttcttcgtccagaacgaccgaagggtgttcgccattcgagcggcccaaaaggttaagcggttgtacttcagcctgtaccggcgaaacactccccaactggcagagcagacaggcggccagtccaacgcaacgcaacagagtgttcatctagatcaggttgttgcgcttggcaaagtcagccagatacaccaccgacttcacattgagcttttcaatgaggcgggttttgtaagtgctgacagtcttgttactcaacaacatggcatcaccgatttctttgttgctcatgcctttggccagttgctgcaagatgatcagttcacggtcggacaggccacggatcatctccagctcggtggaatcaatatcgctgcggcgtacagagtttcctgcaaggttggggaaaaacgtatagccggccatcagcgccttgatcgctttgctcagctcgctcaattcatcggttttcgagatataaccggccgcgccggcctttatgcagcgcatggcataaaacgccgccgactgagaggtcagcaccaggatcttgcttgagagtttcagcgcactgatccgattgatgacttccaggccgtcgaggctgggcatggcgatgtccagcagaatcagttccggctcgtacttgcgcgccatttgcacggcatcagcgccattatcagtctcagcaacgacctcgaaatgctcacgctcaagcaataccctcaccgtcgcccgaatgaaggggtgatcgtctacaaccagtgctttatgcatttggaacctcacagctatacgcccgggaataaccagtgatgagcggtccatgcatcacaaaagtatggaacaaatcactggcttatgctgcccgattacacgcggtaatcaggcagtgatatcggtctgtttcaggactggaaaggaggtgctcacgggggcgagtcaggcgcctgcaaccagcgcaggaaccgctgggcctccatcgggcaacccaggtggaagccctggcctaacgaacaccccatcgcgaccagaccgtcgcggataacctggctgccgacgccttcgatcaccaggctcatattcagcgcccgggccagggccacggtgctggtgaccatcgcatgggtgcgtgggtcctcgatggcgcgaacaagttggccgtcgagcttgagctggttgaatggcagttggcagagcaatgtcagcgatgaaaagcccatgccgaaatcatcgatcgacaggccgcaccccatcatgcgcaggcgccgcaggttttcacgggtgctgcggggtacatccagcaagccgttttcagccacctcgaacaacaacgtcgctcccgggaagtcgtgacgtttcaacagctgctcaatgtgctcgatcaggtcattgtgggccagttgcgacgcgtgaagattgaacgccagctccaggctttggccggattgacgcaaggtgttgagcaagctcatcccttgttcgagcatgtgttcaagcatttcgtcgatcaggtcgtaggccaacacggcggccagaaagtgcctgggcaacaacaaccctctgaccggatgctgccagcgtaccagcgcctcagccccggccaacgccgccgtattcaaatcgaatttgggttggaaccacgcctggaactcaccctgggccaggccccgccgtacgtcctcctcactcgggagcctggcgtggggcgccgactcggtgtccggtgccaactgctggcgggagtagcgctcaaggatttgatgcaacgtatacaactgcgtgcgcctgcccacgacaccgagcatttgcaaccccgagagacaggtcatctgttcgactgcacggcgcagttccggcttcagttcgctgcacagtgcaactgctcgcgccattccgctttcgccgatccgggtcaaaacgtccatccagttgacggcggtgttgctcaggttacaaatcacgatatcaacgccgccttcgcggcttacctgcgccatcgcccattcgctgtcgcccgcctgcagaatgtcgttgacgcccacatgctggagcgccttcaccaacatttcgcgctgaaacgattgatcatctaaaaccagaacgctgggtgtgcacatctcgcccatcactcgctaatgactttaagtcaaaattctggcgacttcacatcaccgacagcgaaggatttatctctgcaacatgtaggaaatttcctagcgacagcgcaggcgagcgtgcacggtatttagagcgttagagggaattgcgcaaaaacggggggagaaacgacggttatgaacataaatcgatgaacagctgtattgacttatcacgcattcagtcagcaatagataacgccgtgcagcgtgtgccccatcagccgatcgagcacacgcttcaccctccactcgggttcgcccgttgtagatttactcgccgtgataaaccggcgatctcccctcagcctccgccttgcgcccttcctgaaagtccttcgacttgtacagcgctgcgcgttgcacatccaggttggacagcgcgtcggcttgcgccgggtcgataacccgatgcgcagaggccagcgttgccttgatgcccaaggggccatttgcggcgatcttgtttgctatctcgatggctttgtcgaggtctgactgtggatcagggatctcttgaaccgtgcccatgcgataggcctcacgggcgctccagtgatcgcccgtgagcatgtagcgcatggcattgccccagccggcttcgcgcacgaagcgtacggtcgagccaccgcccgggtaacggccatgggtgttttcgtcctgtccgaagttggtgttgttcgccgcgatccggatgtcggcgacgaggaacagctcatgcgccatgttccacgtgtcaccgtgcaccgcaacaatcagcggtttggtcaggccgggcattttcttgccgagcgggtcaatcagcccgtcgccgagcgtaaccccgccggcgctggcaacggccttgaagccttcaacgtcgaggccctgggagaaattggtgccgtgcccgaacaacacagcggcacgcagtgacgggtcatggtcgtagtcgtaataggccttggcgagggccagatacgcttcgggatcaagcctgttctgaatagcgggtcggttgataccaatcaacacgatctcaccgcgacgctcgacggtgatcgtgtgggctgggcttgtcgaaatatcgaccatcttgacttcggtttgcgcaaacacagccccggtgaacagggagattgctgagaacaggacggtcttgcgaaatactcgtggcatcgatacttcctttcgtgaagcgggctatgcgaataggttcaccctgcccgtcaggcgccgggcctggtgctccagttggcagttcagtactgagagacgccgccatcgacatcgagctcgatgccggtaatgtaggcactgtcgtcagacgcgagaaatacggccgcccttcccagatcttccgggctgccgaggcgagacagagggatagtgtcaacgaggccggcttgcgcggcggcgggaatcaacgactgcaatcctggggtcagcgtatggcctgggctcaatacgttgatgcgaatgcccaacacctttgtgtccagcatgaagccgcgcgccaagttgcgaaccgccgctttggtcgatgaatagacagacatcgtggggatgccaatggaagcggcgatggatccggtgaatatcaccgaggcgccctttggcagaagcggcaaggctttctgcaagccgaacagtaggcctttgacgttcacattgtaggttttatcgaaatgctcctcggtgatctcgccgagcttcatgaactcataaaaccctgcgttcaacgccagtacatcaatgtgtccggctttttccttgacggtcgcatacagtgcgtccaggtcggcaagattgcccgcatcgccctgaatgccaatcgcaccttggccaatttcggctaccgctcggtccagctcaggttgacgacggccagtgatgaacacgcgagcgccttcatcagcgaacgccttggcaatacccagcccaattccggcgctcgcacccgtaacgacagcgaccttacctgcaagttttttgctcatgtgacgtaccttcaatctgccctgcatcgcgccgtaagcccatgtcgcagcaactcggcgaggcgccaggttggcgccgaagcgtgaagattaaaggccgtaatgaatcacctgtaggcgccatccgggactaagatttattccgcgttggaatgctggctatcggcatgcactcatgcctgagccgttgtcagtgaacacctaagcttaggtccgaaaggagaatattcagctacaggaaaacgaaacacaaaacgccgccgccgctggccaagaacagcctgattaggctgccggcgcacctttcaaccgaggagttgcctgaaggaatgctgcaaccaagcccgccaccgctgcgagtttgataccgacgcccgacttcatccgcgaccagaacgcccaactcgtcatttgtcaaaaccggtgatacgccatttccttatgcaagtcgttatctagccgaattggccaacctgcctcttaaatgccctgcgtgcctgtacagtcaacggagcaattgggaagatcgaatgtcttgggcatatagagtcatcgcgaaaaaataccttagctgtacacgacctcgagagttgcagggagttgccacgcctttagttacctttcccgcagaatctaggactatcaattagggaatactgtaaaaaatttcatgccgcatagaagtaggacttcgtcaaaactccgtttcccacccgccaccaaactcttaacttctttcagcatttcctctatgaacgtattttccccttggtacgtatattcaacgggaataaccactaacaaagttctttgatctggataatttttatcatgcttctttttaatggcctccgcaattttggccggcatcgaatcaatcattgacttgagtttggccagatttctcatcggaaaacttcctatgccacgctgctcaccccacgacagcaactcgaagtcacgcaatggaatagcccaggtaatttccacaatcaaaatcttagagtcctcaactattttaaggtcaaaattgtccgactccaaaccaaattgtaggactgctgaattagcagttttcttatgattaatgaagcgtagagagggaagaagctcctctcgaagtagcttattcggcgctttgccaccagcagagcgccgggttgaaaagaatccattaggcgagtgaaaatactcaaagtcttccatggaaccaacgcctacgtaatcgccaacaatctccttaaaacgttgaactttaattaactgctcaaagggtgccaggtccaaatcaggcttagtgtacattttctcaacgggagcttgaatatgcttcagttcaaaatttgctccaacgaccaactcgcaatagtaattcgcgaacgatggatccatatagaatccgtcgtcctgttgactcagaacgctcttatcctgcatgccttcgaaacgttcaaagagcttttctacctggaactttagagctttcgcgacctcaatccgcttgcaatcttgcccctctaagaagctaaaccaccaaaggtatacgcctgcataatccaaaaactcatgatcatgctgatagataacgacatcaaaagtcttttcaagcgatgccacaacattatcgacagcggacttgaacgggcgatacacctcccaacccaactccacatacggcgtaccttgggtgaacaggatatagctatgagattgggggtgctcaatttcttcaaattcttgcgttgacaacatactaaccaccatttgatttttagtgtgtggcacagagaccttctgacgctagacaatagcaattagcctcttccccgtaaattcaaaatggttgtcatcaacgcgcggcatagcctgaaaagtccgccatcaactatcccgcccgaatcgtcactcaaacgcgccatgtattatcaaatgcgccctcagcaaaaacgactccccacacaccaacggcgccaaccccaaatgcgccgctaccgtctgtccaatatcagcaaagctgccccgctcgcccagccagcctgcggccataccagcaccataggccaacacaggcacatgctcacgggtgtgatcgctgcccggccgcgacgggtcgcaaccgtggtcggcactgatgatcagcaacgtgtgggggtccatcaacgcgagtaattccggcagcctgcggtcgaaagcctccaacgcggcggcgtagcccgccaggtcgcggcggtggccgtagagcatgtcgaagtcgacaaagttggcgaacaccaggctgttgtctggcgcttcctggcaggccttgagcgtggcatcgaacagcgcgtcgttgccgtctgccttatacagccgactgatacctcggtgagcgaagatatcgccgattttgccgaccgcatgcacgctgccgccggcttcgcagagacgatcaagcagcgtcgccgacggcggtggcacggtgtagtcgcgacgattgccggtgcggcggaacgcgcccgcgtgctcgccggtaaacggtcgggcaatgaccctgccgacggtgtattcatcacataactcacgcgcgatttcacacacccgatacagcgcgtcgagcccgaagtggctttcatgggcggcgatctgcatcacgctgtcggccgaggtgtagcaaatcggctgttggctgcggatgtgtgcctcacccaaatcgtccagcaccgtagtgcccgaagcgtggcagttgcccaggatgcccggcaagcctgcccgcttaatgaggtcggcgagcaactgcggcggaaaggagtcgaccggctgctcgaaatacccccagtcgaacaacaccggcacgcccatcatttcccaatgcccggacggcgtgtctttgccggaagattgctcccgcgcgtggccgtaggcaccgatcggtgcagcgtcgccccagtggcccggcaacgggccgtctccactggccgccgcggcagcccccaagcccaatcggcccaggttcggcaacgacaacgccccttttcgaaacggcccatcggcttcgccgcgggcgcacgcctcggcaatatggcgcaaggtgtcggcgccggtatcgccaaaaagagcagcgtcggcactggcgccgatgcccaacgagtcgagcactaacacaatggccttgctcatagtttttcctgaatcaaatcacgtgcggcccggcgttcaccgcctaaccgataggccgcccgcaaggcggctgcgccctgcccggcctgctccaggttgcgcgcgtgcacccaacccagcggccgttgcgcgttgacctgttcaccgacgaaggccaaatcgctgaaacccacggacaggtccagcacgtcgtccgggtgactgcgcccgccgcccaaggccaccaccgccaagcccaccgcgcgggtgtcgatttcgctgacgcagccttcttcctcggcccacaccggcaccgacacgacggccttgggtaaatgcgcttcggggtcgcgagtaaaatcctgcgggccgcccagtgcgccgaccatttgctcgaagcgctgcaaggcagccccgctctgccaggcctgcagcaattggtcgcgggcctgagcgtcatcgttcgccaagccagccatcgtcagtacctcgctggccagcgccaacgtcaccgcccacaggcgttcactgcgcacctcgcccttgagcagcgcgactgcttcggccacctccagggcattgccggcactgcgcgccagcggctggttcatgtcggtgatcagcgcacgggtgttgaccccggcaccgttggccaccgcgacgatgctggcggccagcgcgcgcgcctgttccggctgggccatgaaggcaccgttgccggtcttcacatccatgatcaagacgtcgaggccggcggcgagtttcttgccgaggatcgacgcggtgatcaagtcaatcgactccaccgacccggtcacatcgcggatcacatacaagcgcttgtccgccggtgccaggttggcggtctggccgatgatggcgcaaccgacttcggccaccaccgcgtgcaggcgttcagggctgggttggcagtcgtagccggggatgctttcgagcttgtccagggtgccgccggtgtgcccgaggccgcgcccggaaatcatcggcacgtaacagccgcaggccgccagcaatggcgcgagcagcaaactgatcatgtcgccgacgccaccggtggaatgcttgtcgacgaccggccctggcaggtcccacttcagcacctggccggaatcgcgcatggactcggtcaaggccagacgctcactcacgtccatgcccttgatgaacaccgccatggcgaacgcggccacctgcccatcgcttaggctgccgtcggcaatgccggcgacaaagcgttgaatgtcaatcgcggccagggcgtgcccgtcgcgtttacgccgaatcacttcttgtggcaaccacataccgtactccttacagcgaaatgaaaaagccgacaatcgccgcactcatcaggttggaaagcgtgccaccgatcatggcgcgcaagcccagccgcgccagctcctggcgccgttgcggggcaataccggtcaagccgcccagctggatggcaatcgaagaaaggttggcaaagccacacagggcaaaggtcacgatcacctgggtgtgcaccgacaacagcggcacaccggcttcggcggccttggccggggtcaggtaattagccaggtcggcataggcgacgaactcgttgagcaccagtttttcaccgataaaaccaccggccagcaccgcctcatgccacggtacgccgagcagaaaagcgatgggcgccagtacgtgcccaaggaccagttgcaaggtcaattgcgggtagccaaaccaattgccggcccagcccaatagcccgttgaacagcgcgatcaatgcgataaacgccagcagcatcgcaccgacggacaaggccaggcgcaagccgacctgagcgccctcggcggcggcgtcgatgatattggtcgggcggttttcagcctgccccagctcctcgatcacctgttcggtgcgggctggttcggtttccggttccatcagcttggccatcaacaaggcccccggcgccgacatgaaacacgcggcgatcaggtacttgagttccaccccgagcccggcataacccaacagcaccgagcctgccaccgccgcgaaaccgccgaccatcaccgcgaacaactcagagcgtgtcagcttggcaatgaacggccgcaccaccagcggcacctccgactggccgatgaaaatcgccgacgtcaccaccatcgactcgatgcggctggtgcccagcaacaggcgcaaggcgccgcccaccagccggatgatccagcccatcacgccgatgtaatacagcaccgagataaagctgccgaagaacacgatcatcggcaacactcgaatggcgaatacaaacccgccactgccgaacacttcaaacatgtgcggcgaactcaggccgccgaacagaaactcgatgcctttgttcgcgtacagctgcagcgaggccaccgcccccgacagcgaagccagcaccgtctggccccaaggcacgtaaagcgcaaaagcaccgatcaacacctggatcacaaacgccaccgaaacggtgcgccaattgatcgagcgacgctgatgggataaagcaatggcaatgataataagggtcgctattccgacaagactgatcatgcagacgtctcaacaatggaccgagcggacgcagacccgaaggcctgcccaggattagaaagcgtcgaaggcgcccggcagcaattgcgccagggtccaggtacgcgtggcggccgggtcactgccctggcaaatcaccactgcatccttggccatcaactccagcatcacctggcggcaggcaccgcaagggcttatcagtgaaacgttgggtgcataaaccgccatcgccgtgaaactgcccggcgcatggccctggctgatggcgctgaacaaggcgctgcgctcggcacagttggtcagcccgtaggagatgttttctacgttgcaaccctgtaccacttcaccgtcggcggtcagcaacgccgcaccaaccggaaagtgcgagtaaggcgagtacgtgctctgggcggcacgctttgcctgttccatcaaacgctctttaattgtcattcacagggtcatcccatcttgttgcgagcacgtccagggcgggcgtgacgctattatcctgttatttaaataacatttgatgtgatttctcaacctttttctgagggcgaacacaggaaatgaatgcaggggtagtacgaggggtttgggattgggcttggagcgccttaccggcacgggtcacagcagcggcgttgcaccgctccggccaggacccgcagatttaaagcaggctataaatctcagcaaccacctgcagtgttgcgtcttcgattgcgccttcattaaggcataaaacccagccttgctcagcaaccgctcgctcgaacgcctgcgtacacgcgacctgttcctccagcgtatggatcaccgtactgctcaacccacgccgtcgtgctgcggccctcgcccacgaaatatccggcgcggtgacaaccccgacatgcaagtcaggcacgcgcacgttccgatcaatgttgagctgtagaatttctgcaaacgggacgattcggcgaaacgcggcatccgaggggtaccagcgatcaatcagcacgatactgcccggtggctgtttatcgagcacatgttcggacatccaggcacggctatcagcaaagcgctcgcacacctggagttccagatcccgggtggggtttctgacgaattggttaacgagggccattgtttcaccccgatagggatcgctttttctctcgcaaagccggatcaccttgttattgcctgccctcagggctttcgtaacggcttccaacagcgtggttttaccggtgcccttgggcccatccagggaaacaaacagcgaacggttcattcttcaactaatgattgatagaggtgttgacggactctatctgaatttatgccagagggttctcaaaaccctggattgccgccgtttataaacacccacccttatccctatttatgtgggagcgggcttgcccgcgatggcgtcagcccagtaaacattgatgccgactgacccaccgctttcgcaggcaagccagctcccacattcgaccgcatgccgaggctggaacccggtcagctgcgaaagctgacacctgtaggcgcatcgacaatgcagatcaaaatgtgggagcgggcttgctcgcgaaggcgtcagcccagtaaacattgatgccgactgacccaccgctttcgcaggcaagccagctcccacattcgaccgcattctcaggctggaacccggtcagctgcgaaagctggcacctgtaggcgcatggacaatgcagatcaaaatgtgggagcgggcttgcccgcgatggcgtcagcccagcaaatattaatgccgactgacccaccgctttcgcaggcaagccagctcccacattacgaagcaggcagtcgcacacttaatctttatgcttgaaccgaggaatctccagccccaagctttcacgcaaggtcgtcccttcatacgctttgcgatacacgcctcgctcttgcagcaacggaatgacttcctgggtaaaccgcgcgaactgctgcggatgcccaatatagatattgaacccatccaccgcccgcgcttcaaaccactccgccattttgcgcgcaacggtgtccgccgtgcccacgaacgcccccggtcgcagttgccgtccaaactccaccgcctggcgcaacgtgaagcctttctcccgcgcctggtcagcaatgcgtttggcgttggtgaaaaagctgctgcgcgcggcttccaggctctcttgcgggaacggtgcgtccaggtcgtactgactgaaatcatgccagccgaaattacgcccgaactccttcagcgccagctcaaaactgtgatcgacctgatgatagtgctgctcgatttcacgcgcctgcgcatcggtgtcgcccacataaatctcggcgccgggcatcaccaataactgctccgggtcgcgaccgtgttgcgccgccctgccctttatatcccggtagaacgcctggccctgttcgatgctggccgcgtgggtgaagatcacatcggcggtggcggcgcccaggtcgcggccttgctctgagtcgccggcctggaagatcaccggctggccttggggtgagcgctggatgttcagcgggccgaccacggaaaaatgctcgccctggtggttcaggctgtgcagtttgcgcgggtcgaggaactggccggtcgcgcggtcgcgcacaaacgcatcgtcctcgtaggagttccacaggccttgcaccacgtggacgtgctcggcggcgcggctgtagcgggtgtcgtagtcgtaatgttcgtcgcggctgtagttgccggcagtgccggcgtcgccactggtgaccacgttccagccggcgcggcctttgctgatcaggtcgagcgaggccaggcgccgtgcgacgttgtagggcgagttgtaagaagtggtcagcgttccgaccaagcccaggtgccgcgtgctgacagccaacgccgataacaatgtcagcggttccaggcggttcaggtagtgggagggcgagccttcggtgatgaactggctgtcgacgataaacatcaagtcgaacaaggccgcttcggcctggcgcgcgatgtcgatgtaccagtcgacattaacgctggcatcggccggcaattgcgggtcaagccacaggttatggcgacctggcccgccacatcccatggtcaaggcacccagtttgagctgtctgttggtcatgtcagatgaattccttgaagcgttcagggctgggtggtggcgacggcgggttgcaaggcggccgagaaggagtcgtcgaacaggctggcggccgagtacgacttgaccaggccctggcttgcgaaaaagtccacggtcttttgcgcttcgaccggcgattgcgcggtcagtggctcgaccgtggtgcgggcgcgggcgaaccaggcacgggcaatatcggtgtcggcgcgggtgcgtttggcccaggcatcggcgtaagcgtcagcattggccggattttggcgcgcccagtcccgggcttttttcaggcgttgaagaaagtcgctgatctgtgcgcgcttggcatcgacagccttggcgttggcggcgatgaaactctgggccggaatcaagccctcagcggtggcgagtacgcgggcaccctggcgttcctgttgggtgacgtagggctcccacgtggcgatgacgtcaaccgagccgccttccagcgcatgggatgcatccagggcgctgagatagcgcatctccagcgagtcgcgtgggacgccggctttatccagcgcagtcagcagcaattgctggctccaggagcctttccagattgccgcacgcttgccggcaaggtccgctaggctgtggatcgaggagtccttgcggaccagaatcgccacgccttcgagattttgccgactgactgcaatcaccttgatcggcgcgcccagcgcacccaggaacagcaccggcgcgtcccccagcaagccgatatccaggctgttggcattcagcgcttcggcaaccggcgagcctgcggtgaattgcttccattccagcgtgtagggcaggttttccagcacacccgccgcttccatcacggcttgggcattgtagctttggtcaccgaccaccagcgtttgcgcgttcgcggtcaggcacaacagcgtggcagccaacccggccgccagttttgaaaggtaacgcacgttcgtctccagataccctgtcaggcatgcaagtcgatccgcgcgcgcggtctcggagtgttcgtagggactcatacgatgcggttataaccatcgcatgtaaaatacccataacgcataacgtaatgcataaataatgcagcagccgcattttccgcttgccgcccctgcgccggtacattgcggactgcccggcgccacctacactgatttaaaccttggtaacccgcgccttttttcagcggccgaggcggatggacctgcacgcatgactcaacaataaaagcagttaaccacctgattacctagagtaaatatgaaagagcagcttcgccagcgtgcatcaggagtagcgcccatccgcgccctgtttaaacctccacatcggctggcgcccctaagcctgctgtgcatcgccctcgccgcctgtaccgttgggcctgatttcacgcgccccgatgtgccggcgaatgccgactattcaagagaaaaactcaccgccaccgccggggccgacatcgacaccggtggcgcggcgcagcggctgatcgccggcatggatatccccgggcaatggtggacgctgttccgctcgccgtcactcaatgccctggtcgaagaggccctgcgtgccaacccggatgtcagcgccgcgcaggcggcattacgccaggccaacgaactggtgtatgccgatcaggcgtcactgtttccctcggtgagcggcaatgtgcagaaagcccgcgagaaagtctcgggcgtgacctcgggcattccggaatcgccgattctcacggtgagttcggcatcgctcagcgtgtcctatgcgccggacgtgttcggcggcacgcgccggcaaatcgaatcgaccacggcgcaggccgagtacgagcgcttccagctggaggcgacttacctgaccttgacttcgaatgtggtcaacacggcggtcagcctggcgtcgttgcgcgatcaagtcgccgccaccgaagaaatcatcaaactgcagggcggccagcttgacttgctgcaagcccagcgacgactgggcgccatcggcgatagcgacgtgctcacgcagcaaaccgcgctggcacaaacccgtgcgaccttgccgccgctgcaaaagcaattggcgcagacccgcaaccagttgatggcgtacctcgggcgctttccgaatcaggatcaggccgagcgtttcaacctggcttccttgcacctgccggaagaacttccggtcagcctgccctcggccattgtcggccagcggcccgatgtgcgctcggcacaggcacaactgcatcaagccagcgccaatatcggcgtggccgtcgccaatcaattgccgcagttcagcattaccgggtcgttgggctccacggtggccagtggcaccaagctgttttcggcgggcagcggcgtatggagcctggccggttcaatcacccagccgatctttgacgctggcgcactcgaacaccgcaaacgcgcagccgtggctgcctatgacgagtcggcagcgcgctatcgcggcacggtgattaccgcgttccaggacgtggctaatgcgctgcgggcgctggaggcggatgccgatgcgctcaaccagcaagtcgtggccgaacgcgctgcccaagccaacctcgacttggtacaggcccagttccgcctcggcgccgtggcgtatatcaacttgctcaacgcccagcaaacctaccagaacaccgcgctatcgcgcgtcaaggcgcaggccgcccggtacagcgacaccaccgcgttgttccaggcattgggcggtggctggtggaaccgcaccgacgtcgaccccgccacccagggcaagccggatcgcttcggcctgccgtcgtggcaagagatcatgccagccagcaataaggctgcacctgaatcgaatcattgaaacagtgagagaccccatggccgacgttcagactgcctctgccctgccccccgagcccggacaaccgcgcaagcgtcgtctgtggcggccgatgctcatcatggtcgtggtggtgctggtgatcgtcgcgatcatcgccggggtgaaattcgtgcagatttcggcactgatcgcccaatccaaggcgccgttgccggcctcagtagtgaccgccatgcaggtgccatttagcgactggcaaccgagcgtctccgccgtgggctcgatgaaggcggtgcgtggcgtggatgtgaccacggaagtcggtggcatcgtgcgcaccctcggcttcacgccggggcaggaagtcccggcccaggcgctgctggtgcagttgaatgccgacgcggatatcgcgcaactgcattccctggaggccaccgccgacctcgccggcatcgtgctcaagcgcgacaaggcgcaactggcggtcaacgccatctcccaggcccaagtcgacaccgacaccgccgacctcaaagccaaactcgccgccgccgagcaacagcgggcgctggtggcgaaaaaaaccattcgcgcgccgtttgccgggcgcatcggcattaccagtgtcaacccagggcaatacctcaaccccggcgacaaaatcgccacgctgcagacctttgatcccatctacatcgacttctcggtgccgcagacccagctggaagccatcgccatcggccaacgcgtggcagtgacggccgatggcctgtcgaataaaaccttcaccggaaaaatcagcaccatcgacacgcagttcgactcgaccacacgcaacgtcaccgtcgaagccaccgtcgaaaaccccaagcaaagcctggtgcccggcatgttcgcccgcgcggtggtcaactccggcaccacccagcgctacctcaccgttccgcaaacgtcggtcacctacaacccttacggcaccacggtgtttatcgccacgtcgagcaaaaacgacaagggcgaagaggtgctgaccgcgcaacaaaccttcatcaagaccgggccgacccgcggcgatcaggtcgcggtgctgtcgggcgtaaaagaaggcgacctgttgatcaccagcggccagatgaagctcaagaacggctcgccggtgaaggtcgataacagcgccgcgccgctgaacgatccgtcgccgactccccaagaacagtaaaggtgtcccatgaagcttaccgatacctttatccagcggccggtgtgggccgtggtggtttcgctgttcatcctgatcctggggctgcgttcgatcttcgaattgccggtgaaccaatggccgcgcaccgaaaataccgtggtcaccatcaccaccgcctactacggcgcggacgcgtccacggtcgccgggtttattacccagccgctggagtcggccattgcccaggcccagggcatcgactatctatcctcgaccagcatcaccggtgtctcgacgattaccgccacgctgcgcttgaactacgacgccagcaaggcgctcaccgagatcaatacccaagtcaactcggtcaaaaaccaactgccggcccagtcccaggaaccggtgctcacgattgccgtcgggcaaaccaccgacgccatgtacctgggtttctacagcgacacgctgcccaccaacaacatcaccgactacctggtgcgagtggtcaagcccaagctcgattcgatccagggcgtgcaaaccgcagagatcctcggcgggcgccagttcgccctgcgcgcctggctggacccggacaagttggcggcgcacaacgtcacggcgcaggacgtgtccacggccctggccaataacaactacctgtcggctgtgggctcgacccgtgggcaaaccgtcaccgtcgaccttacggccggcaccgacctgcacaccgtggatgaattcaagcgcctggtgatcaagcagaaaggcgacgcactggtgtacctggaggatgtagccaccgtcaccctcggcgccgaaagctacgacagcagcgtggcgttttccggcaagcgttcggtgtttatcggcatcaaggcggcgcccaccgcgaacattctgaccgtcgccgacagcgtgcgcgaggcgttccccgagctgcaatcgcagctgccttccggcgtgcgcggcgagatcgtgtatgactccaccgagttcatcaacacctcgatttacgaagtggtgaagaccctggtcgaggcgatgatcattgtttcggtggtgatttacctgttcctcggctccttccgcgcggtgattgtgccgctggtagcgatcccgctgtcgctggtcgggaccttcttcatcatgtacctgctgggttactcgattaacctgctgaccctgctcgcgctggtattggcaatcggcctggtggtggacgacgcgattattgtggtggaaaacgtcgaccggcatatcaaggaagaaggcaaaagcgtgctcgaggcctcattgatcgcggcgcgggaactcggcggcccgatcatcgcgatgaccgtggtgctggtggccgcgtacgtgcccatcggcttgcgcagcggcctcaccggcgcgttgttcaaggagttctgtttctcgctggcgggcgccgtgaccgtgtcggccgtggtcgcgttgaccctgtcgccgatgatgacctccaagctgttcaagtccggccaggaagaaggtcgcttcgcgcgcaagctcgaccagtactttgactggctgcgcgggcgctaccaccgcgtgctgtccggcgggctgaacatctggccggtgctggtgacctttgggtttgtgctgttcctgctggtcgccgccagtggcatgaccgccaaaagcgaactgtcgccgaccgaagaccaaggcctggtgttcatgcagatcaaaggcccgccgacggcttcgccgcaacagatggagcgcattgccgaccaggcttttcagatcgccagcaaagaaactgaatacgcgcagatgttccaactcaccggcctgccgattctcaaccagggcctgggcggcgtgctgctcaaaacctggagcgaccgcacacgctcccaggcccagctgattctcgacctgcagcaaaaatggaaccaggtgccaggcgcgaccatcgccgccttcccactgccgtcgttgcccggcgcccagggcttgccggtgcagtttgtgattaccaccaccgactcggtggaaaacctcaatgaagtggcccaggcggtcatggccgaggcgcagaaacaacagctgttctggttcgccgacatggatttgaaactggacaagccgcaagccaaattggtggttgaccgggagaagatcgccgcactcggcatgacccaggccgacgtcggcgccgcgctgtccgcggcgctgggcggcaactacgtgaactacttctccacggccgggcgctcctacaaagtcattccccaagtgctgcaggttaaccgcctcaacccggagcaagttctggattactacattcgcacgccttcaggcgcgatgatcccggcgcgcaccgtggcgcatatcgagacctcgacccagccggaatcgatcaaccacttccagcaactcaactcggcgaccctgtccggcgtcagtggcgtggcccagggcgaactgctggccaaactcaacaccatcctcaccaacgtggcgccctcgggctacacctcggactttgccggcgaatcgcgccagttcgtccaggaatccggtggcttctttggcttgctgatgttctcgattctgatcgtctacctggcgctggctttccagttcgagagcttccgcgacccggtcgtcatcctgttctcggtgccgccggcactgttcggcgccctcgccttcatcaccatgggctacgcctcgatcaacgtgtacacccaggtgggcctggtgacgctgctggggttgatcaccaagcacggcatcctgatcgtgcagttcgccaaccaattgcagcgcgccgggcacagcaagcgcgaagccatcgaagaagccgccggcgtgcgcttgcgcccgatcctgatgaccaccgccgccatggtgctcggcgtggtgccgctggtatgggcatccggcgcaggggctgcggggcggcatgatatggggctggtgatctttgccgggttgtcgattggtacgctgctgacgttgtttatggtgccggcgatgtatatgtttattggtgaaacgcatcatcaggaagctgagcagtcgatgcctggatcagacctgagggccacttgactgtcacctatgagcatcgccgcacttggattacttcactgcactgaccgccttcgtcgaagccgctgaaggcaacaacttctcgcgcgcggccgagcggctcggcatcaaggcgtcaacggtttcgcgctacgtgaaggacctggaacaggacctcggcattgcgctgttcaaccgctcgacacgcacgctgcacctgaccgaaggcggccagacgtttctgctgcacgcgcgtcgcgtgctggatgaactggaacaagccaaggcggcgacgtcggcgctgaaccagcaaccgcgcggagtgctcaagctcaatgtgccaccggcctttgcccgtcaccatatccttcccgtcctcaacacgtttctggcgcgttatccgcagatcaagctggagctggtgctggaggaggcgcaggtcaacttgattcatgcaggcgtcgacctggcgattcggattggcgcacttgccgactccaccctcaaggctcgcaagatctgcgcgggcaagtacctgctggtggcaagcccggcgtttgcggcgcaacaccctgccccgtccacaccaacagacctggacagcctgccggccatcctgggtaggcacgccgcggaccattttgccttcgcttgcgcagatgaggtgctgccctcggtgcatggcgactgcattcgcatcagcgaccttgacgcgcagttgatcgctgcgcgccaaggcctgggttttgcgctgctgcctgactggttggtggccaagtcgattgaaaccggcgaactgcgggtttggctgccgcactggaccatccgtggcgcagagcaggcgtttgccgtgtggtttgtttacccgcccaagcgcatcgtgtcgtccaaggtcaggtgcttcatcgactttatcgtcgagcaactgggcgagacaccttattggaaacgctgaaagcacccgtcagctgaagcggatatccagcgcgcgtaaataggtctgcagcccggcgtcctggatcgggatcaggaaagcctccgtatccgactcattgaagtgcgcatgccagtaacccggtggcgtcacgaacgccaagccgggcgaccagtccacccgtaccggattgcggatctggccgtcggcgtccagctcagtaccgaccagcgagtagcatcccttggggcagtcgataatgaagtccagggctatcgactgatgccggtgcggcttttgaatcgaaccaggcggcaggatgccgtacatggcccacagcacatgcgtgacggtgcgggtctgtgggaaattgcgattccccagcaagatgctgatacggctgcggtcctgggcacgcgggtcgtcagccgcttcacgcagcttcaggctggccagtgctgcgggatacaaggtcggcgcgaaacggtcggcgctgcgcgtcacgcccaggtagcgcaacagcggttcgtcatgcacgtagtacaggcgcgcatcctgtgtggcgctgaagtgagccgacagcatcccaggcaacgcgataaaacaaccggctgaccattcaattgcatgctcgccctgaacaacactgccctccccggcaatcacataaaacacctgtgaagtcgcattggggtgcaggtccagggcctcgccggcgttcaggcgaataaagttggcacacaacccaggccccgtcgccggaccctcgcaacccagcgcatcgctgaggtcaagcgcgacgacacgcgaagggccgctgtcatacagcgaggccgggaagctgtggtagggaatccgggtaatcagattggcgctgatggggttggccgctttgctgtactcaaagtactcggcgtccagttgctcgctcggcaatctatcggtcaggttgggcttgaactcgctgttcatcatccacctcaggctttggctggtttggaccgactataggcattgcgaccacagggattaagcactcgtttggcatagcagttgtgcaggatggggtggttgggtgttttttggttgaccatttataaatctttttttaaaaaatcgggtgcgccccccttcagcaacttcaataagagcccctcgaatccgctgaaaaattgaagaccgtgtttcagtcatttatcaatatcctggctttcggtaaggatcgacatcagcgtgatcttgcggttaatgtggaacgaattctttccctccatccctttcaggaatgggttcgtggctcaactccacctttatccgcattatatcgctgcggcgcgagcccttttactcattcgttcaaggttcttggtccgtatctgttcgcagcatctgaagcagatgcctagtttttccaaaacctaaacctgacagcagatcaagaagggtcgttacctttagccgtttgattataaacatcatcaccaaccttgcatccattcttcacgggcggactgtcgatctggacagattcttttgcgcctgtaaagcccgcgtcattatccgctggcgccccatgacctactatttttgtttcaccagatagtaaatcggctaccggtccttctgcatcttctattcaaaacgacagtaaagtggtcatttatcaggtccaattgaattcaggttcaatagtaaaatcaagctctgcagaaacaagagtatttctaacttgtaaaatctccatcgcctgcccagtaaacacgagagaaattccattctggagagtctttctagacgttaaaaaattataacctatcacttcagatacagctcttatatgggcttcatttttatagtcaccactacaactaacttcatacttcgtttcatcaaccttaatacccgaaatatgtgttgtcactacagaccagccacaatcagcacaccttaatccttgagcgctaccctctttgaagctctctaatctccttccgcatcgctcacacaccataaagtagttctttttcattctgccttaccaggataaaatactttaaacactcccttacttgacaaaccagggacaattaaacaaaaaaacagaccccatttattacgggagaggtctagtcaaggactatgcctgcccttttttttgttttttatggttgacgcttaaactagccgaaggatcttcatatcctgtaagagccctctatgccacctttacttgcatcataaaaaatgtcttttaagtcgcctccagctagtaaactgcaatttattggcgatggtatgggccctccctgctgccaaaacaatgaccaaaacctctaccataagtcgctcaagtactggtccatctgtatgcataaatctcatcgtacgcatagccaaactcaaactctcaggcgcccactcttcaatatatgcccactagaccagccccaagatcggcttgatctgttcattcatttgtacaaaagcttcataggacatgttcgggtcatcattgagaattaaatagacccctcccgtcagccgtaccgcaatacgacacttgccttccaatcgtgcaattacttcatcagggccgtagcctaaagcacgctgacaaagggctgcatcccagaactgggcaggatttagcgtataaatattgttgcgcccatcaatatctaaagttttgtcctcacgcaaccgattataaaccgcgttatcatcgttcaaccctccttgataatacagaccatacagatcataggctacatgagccctataccccttgaatgcctcaatcacttttggtaagtgctcattcacaacaagtttatagtcaatagccttgtttgatatcttaaatccaaaccgcaagtgttcgtcataggaggccctatcttcatatatgtatcgatcaccacgatacgcataatcccccacacaccggagccctttgatgggaagtttaactgtataggtagcaactaacccgtcgccgcaactcggggtagccgcaagctcaagacccgcaaaccctaaaggagcaccaatccgagacatcctatccatgacttcagcatgtcgctgatttatggatagagttttatcagggcgcgcgtaaaaccatagctctatatctgctgcactcatgggattcttgtcctagcactaacaatgctatcgaaaccattgggccgaatgaaagctttagcctgagcctcaactttttgattaggaaattcatatacaactttatatccgcgaacatcgggatcagaacaccattattaaaatgtggtctgacctcaatgcttttcaatgttttccgcactgcagccaagaataccctacctggaatcgcctgaccccactcccgtctccaccccataaaagtatctgcccaacataactaaatggctatcaaatcccccacgcagtcaatcttgacacttcgagaatccccctctttcaacttagccagaaaaccaaacaaaccccattctgtcttcaccaccgtatccttatttgaatcatagtgatatacagcgtcttgttgcccccgagacgtctgaacaaaataatactgtgcctcagaaataaatgaaaagacgaaaggcttattaagaaactcatagaagccaagttcttgaagttgagtaaaaaaatccaattgaaatataagatgggtacgagcgctccatgtcggacgatagagttgaactagcgaatccccgatcacgccaccgtcagttctgcccatatccgacaaaaagcttttcagttgcccttcaatgagaatattgtaaaatcttccgattttttgtaagtcgtcatctgaatatcccctgcaagcagcagcgactgagcgctcttcattcgaaaaaagaaagtcaatacatttcatggggggcttctcgagctttcctaaaaaaatagaaaatagaggtcaaattttacaggcactattttttaattttcttttggttccgcgccagacgtcagtttaatgtaagcagcggccaagtctatcttttcttgtcctgagagccgtccccaatcactcagcctcagttgctctttatatatttcatccgcaacatacggaatattttcatccaccccatctatggcagcgatgaattctttgggaggaagataattatgagcatctatgaaatgtagaatcattatgggcgcggcataaatagtttcgcgcgctggaatccatagctcagcgctaggcaacacttttccagaggagtcaagcagctctaattggccacatatttgacagcaggtcgactctcgaattggctctacaagtggccgaaatctgccacttccaccggccaactttttcagtttaaggaacgttgcctgagggatattacctcgcggaaatgttgattcgacatcaagccaacccacattttttacacctattaaagtgaatggttctatctgatgagagtagctggtcaagtcagcaaaatgaggtgttttattcattgtcattacttctttggtatatagggaacggcttgggtacaagcggcccaaaaaacgcagcccatattcgactcaagaaaatcggaaagtttagtcggcgcgctagtggtagtagaattgccaaatatatttaacggcttattttggaagcccggactcagcaatgtatagttatagcccgtctcaccaggtgcagtcacctgataacctgccaaatcgttatagttgcgctgcgtaagaacttgaccgttaggcgaaatacccgttctcatcgtattttccagttgctccactgatgttagctgctccagtatctggccggttgagtcagcaatcgttatgccaggtcgtggtgaaataacaaacgttcccgcaggagagacatattgtgttgacgcggagctaccatccatcacaccgtgcccagcaagcgcttgtccactaccaccttcggtaacagacccggcaaactcatgaccacttgtgctgcccagccctcgatcaacccctacctctactacattattctctccataagccaaacccagcgttgaaggtagcgcaccaccagcttcgctgccagccgatatcgccttcccgatagtcacagcccctatcgcagcaatcccggccaatccctcctcaggcaacatggcaatctgcccgatttggacgtcttgctcctgtgccttggctatctgctcgctgtgcccgatgccgttgtaaagcgtttcatcctcgctgtgtgagcgaaaggctgtcttcaaaaagtctaaagcagtttgggaattggcagccgtccattcagctttctgttccggtgtcccggcaaatgggaagtcgtaagtggtaatggcgccgttctgtttcaaaccgcttagcgcggcgtccgccagccccccaccgactttgctgaccatttcgtcgtagtactgttgatatgaatcaaccagaaaggaccgctctgcgtcggttagcgggtctccagccgcaactttcgaacgcaggtaatcgctttgctgatcgcgctgttgcaattccttgtattcagctgcctgctgaactgtcgcagtaccgtgttccagtgcctgacgatctgcttctcgacgggctatcgaattcggccccaggaaattgttctgcgtagcattttccgccacggaagcgccaatcgaggtattcccgcctgttgccgtggcggctaggatgccaaccagccctgacagcgcgaccagcctctgctgcgcttgctgcagggtcaccgaattggccgtcgcaggatcaggcatgaccaggtccgacaagctcttgacgacagcttcgtcagcccccgccgccaacgcgcccgttttgaaatccccgccttgagcgacggatagaacgccgccgagcaaggcgtgcatgccgatcttggtcaacgaaccgtcgggcaggtaagtccctccgatatcgttagctaccgttgcgccgccgacgttaatcgcggcaccggccagcgagctaaccagattgccctgcaggctcccgccctcgacagccgttttagcaacggcattggcaaccgaggtgacagccgccttttcaaggttgtccacgctgaacacggcagggttgtaaggcagctcgtagcctattcccgcagtgagtcccgccaacacatcgtttttaaggcttgatgtcgagagtgcgtccttcagggtcgcgcccagattgcctttgttgttgatcaaactcaccgcaccactgctggccattgaggtcaacacggccgaggccatcatgttccccaagccagcggtagtcgcatcaacagcggcagtcgttgcggtggctgcgacttcagccgtagccgcagccatggtcgacccagcgccagccccggacattgcagccaccgcgccactcgccgcccccgccgtcagcaccgagacaatgatgatgatcgccagcatcgcgccttcgcccaaactggaatggctgtacttgtaggcgtcgtgcatttccttgacttgctgccagttcacatcgccgcgggcttcggcatctttcaaccacgccaggctcgggtcagccttgaccatgacatcgatggtttgcgcaaccgtgttttggtcgatctgcttgataccgatattcaagccgttcaccgcattgatgacggtctgccccttggccgtcatctcggtctggtgaagggtttcatcggtactgcctttccctgacatcgacgtccacgccaggctggaatcgctcttgctgtggctctcctggtgcagatccttcactgcctcaaacgaaatgctcccgccactgttcaacgacaggttcgcaccgctatcaagcttggcgttctggtacacctggtcgccgccgctgatcagcgatagcgccccgcctgtttggatctgactccccacattgcgaacatcagtcacttcatcatgctgagtcttcagcgcgccgaagccacctttcttcttcatgtcgtacagcgagtagtcgctgtcttgcgcagcattcagatcaagcgtgttgccggcatacaaatacgcctcatcccccgccgtcacccggctcgccgtcaacgccaggtcttgcccggcgctcagcgccacgtcgccaccggccttgaccgtggtcgacacctggctcacatggtcgtcttcactcttgacctttttcgaggtaaacgaggcatgggattcgtccgctgccgacgacagcgacagatcgcccactgccgacatcgtcacatcgcgcttggcatcgatttcactcaccaccgcgctgatgtcccgccccgcctgtacctttagatcaccgccagcatccacgcggctgccgtactgggtcacgctgctgtccttgaacaacccgctgacggtattgctgttggtgccttcggccgcgacgaggttgacgtcgcgcccggccttgatcgtggtgtcggcgccgctgctggttaccccgcccacgctgtcgacgtcgcggccggcttgcaggctcaggttgttcgcggcttcgatgcgtgcggcgctgtccaccgagtcggtgtgttcggttcggtagccgctgctgctgtcgtggctggtgacgctgcgttcgttgaggatgtcgccattgctggcggtcaggttcacgtcgcggccggcgatgatgccgccggcggtgttgacgatgttgttgccggccagcaggtccaggcggttgccggcctggatcaggccgctgttgctgaggtagttgccggcctgggccgacaggttattgctggcccgcaaggtgccgacgttgtccaggttctggccggcgatcaggttgacgtcgttaccggcgatcaacgcgccgtccggggccaggcggttgttggcctgggccagatacaccacgggcaccagcacgttttcgccgttcacttgctcgttttcgagccacacgatgtcgtgggtcagcgccgcgacttgggccgaggtgaggctcacccccacactcaggccaagttgctgtttgctgctgatggcgttgtccatcaggtacttgagcatgcccgagtcggagttctggccgtcgatgaagcgttggccggtgcgggccaccacggcttgttcgaccaggcgttgctcgtagaggccgtcgccgaggcgcttggcgctgtcgtcggggttgtaaccgaggccggaaagcaggtagtcggagctcatgaactgcttgaggtcggtgagcaccgggttggtttcgatcaggtatttctgtggctgcgacaccggttgggtgtttggcaggccctgtacacgggcgaggttttggctggctatcagggacgggttatcggtcccagcgggtttctgcggtgtgttcgggagggacgcaccgatcgccggcgctgcactgctgcggtccggggtttgaatgctggcggcgccgccatcgctgatcgcgccaacgccgctgccgctggcaccaatgccgctggcttggcggctggccaggtccagttgcacgctgttggccgtgtcggaggccggcgcattcacctgtatcaaccggcctgcgatcaagggcgcggtgattggatgcgcgtccaattgcagactggcgccactcacggaccagcccggtgcgttgttattggaagccgtggcgctgctgccctgcccgctcaggcggaacaggccgttttgcccggtcggcaggctgaaccccggcaaggtcagggggttgatctgccgctgggccaggtcgggcggcagttgcccgttgacggtgatgcgagtggagaacgcacttgcaccactcgcgccgcccgcgccagtgccggttttggcacccgcgcccacataggtaaagcctgggcgtaccacgctgttgtcgaggttggcctgcgccttgacgttgaccgcgccacccgcctgaatcaccccggcgtagctttggtcgccgccgccgatctgggtgacggtgcgcaacaccgtacgctcagcctcggtgataccgatgaacgaggccatggcgccctgcaggccactcaggtcattggggttgtagctggcgccgccgatggagtaacggctgttgaacgcggcggcggcgtcgtaccacatttccggatggcgggtacgctcggacacgaacaggcgcgtggtgtcggtttcgccggtttccacgccactgttggtcaggttgttgacggcaacgctgaggttgccgcccgcgccgatagtgctgctggcgttgacgacgtcgccgccggcaatgctgaggttttgcccggcggtgatgctggaggcggcgctggaggccgtcacttcgagcttttcgcgctgatcgatttgccacaggtggttctgtttgccgctgcaatcacccgcgtagttcgggccttcgatgcaggggaattcggtgatcgaggcggtgtagatgccgcccgcgctggtggtgagtaccgcgcgcacgttttgaagggtgctggcggccaggctcatattgccgtcgctttgcaggctcgacgaactgttgacgatcgccgtggcaaggccgccatgtccgtcgcggtcgatgctcaggttgcccaggctgtagacgtcggcgtagctgttggtcagcgtgtcgacgcgcaggctcatgtcgccaccgctgaagatcaggccatggtcattgagcaaggcgccggtggtggcggtgagcttctgagcgctgccgagggttgcggtgttgtttatcgcgccggcattgatgaccaggtcattggccgaggtcagccgcccggcattgttcagggtgccggtgacagtggcgctggtgaggccgccgccggccacgctggcggtgctgctcaggttcagttgcgcggcgctcaggctcaggtcgccctggctggtgatgcgcccagcgccattgagcgtgccgcccacatgcaggtcgaggctgccgtcactggcgatcaggccgttggtggaccagttgccgcctgtaccgctgaacgcgctgctggcgagcaattggccgtcgctggtttggttgagggtgttgacgttgaccgtcagccgcccggcctggatcacgctgttgttggtccaggtgtcctgggcgacggtcaggctgccgcgcgttaccaggctgccgccgacgctgttgaggttgctcggcgcaatggtgaagttgccattgccgacgtgcagcacgctgccgccgacgttctgcaagctaccggcaccgagtaccaggttgctgttggcggtttcaagcacaccgttggtgttgtccagcaggccgccgatggcgaactcggtggtgcccgcgttgcccagggcgcgcaagcgaccgttgccgttgtcgaggctggcggcgctgaccttgagggtggtttggctttcgacgatccccaggcggttattcaatgcgccgcgcaggctcaggtcgatctgttggccggcgatctggccgtcgttatcgccactgttgtcgacgtcgttcgcgctgacgctcaccaggccggtggcatagatgccgccgttgcggttgtcgacattgccggtggtgatgagcgcatcgccgccttgggcagagacgcgtccaccatagttatcgatcatcgccgccagcaggttgaggtgctggccctgcaccgtgccgccctggcggttgtcgttcaggtcgtagccgttgcgcagcacgcccaccagttgcgcctgcactgcgccgttgaggctggcgagtgtgccgccacggttgtcgaggctgttggcgttgagcgtcaggtcgccggtttgcgcaaacagtttgccgctctggttatccacgtcgccgctggtgttgagggtcaggccgttctggccctgcaccacgccgaggccgttggcaattgcggcagcctgcaactgcacgccggcgccctggctgtaaatcaagccgtcggcgttgttttgcagcaggccacgggtgttgatcgcgacgttgccggtgcccgcgagggtgccgtgctggctgttgtcgatagcaccggcaaacaggctcagcaggttctggctgactatttgcccgccctggttgttgacctggttggcacgctgcaacagcaacggcccggcgctggccagtgtgccgtgggtgttgatcaggttgccgagcaggttgagggtcactgcggcgttgcctgccagggtgccggcgttgttgctcaggtcggaggcattcaccgccagcgcctgctgcgcattgatcttgccggcgtcgttggcgagggtcgttgcctgtacgtcgagggtcgcgccgctgtcgatcaaaccgccgccactgttgttcagcagctcgctgacggtcaggccctgccccgcggcgctggacagaatcccgccactgctgttgtcgaggctggccgcgttgatgtccagccggccctggctgaccagcgcaccggcgccgctgttgagcagtgcgcccgtgaggttgactgccatcgcgccgctgcggctggaaaacgtgccgttgttgcggttgtcgaggctgccgccgctgaagccgaggctctgccagcccgacaccaggccattggcgttgatcaggttggccgcgccgagggtcaatacctggctgctgatcagcttgccggcgctgttgtccagcgtacgcgcggccagcgtcaggttctgctggctggagatttcaccgcctgtgttgttgaggtcacgcaggtggttgatcgtcagcgggcctttgccgaggatcaggccaccatggttatccaggtcgccgttaaccaagtcgccatagctcaggtccagggtcacgcgttgctcgcctgtcagcctgccgtttgccgaggtcaaggtgccggtgctcaggtcgagcgtgccgacagccgacacttcaccgccgttgccggtattcaggctggctgcggagaggttcaggttgccctggctgtggatcaggccaaggccggtgttgttcagcaagccatcgctggccagttgcaggtcgccccggctgttcagggtgccgttgctgttgtccaccgaagcggcgtgggcgtcgaggccggcagcgccgatcaaacccttgatgtttgtcagcgcctggttgatgcgtaaggtcagcgcttgattgctcagcagcttgccgttgctgttgtcgaaggtgcgcgcggccagcgtgaaggcctggccgctggagatttcaccgttgctgttggtgacgtcggtgaggtggttgagttgcagcgccccggccgcattgatcaagccgccgctgttgttcaacacgccgttgttcacgtcgagcgtcagcgcgccgttgctgaacagcttgccgccttgttggtccaggccgctcacgctggtggtcagcgcgttgctgctgccgatgctgccgccgttgttcagttggccggcagtgaggttcagcgtgtcgccgctgctgatgctgccgttctggttgctcaggtcaccggtggccagcgtcatcgcgcctttagcgctgaggctgccttgggcgttactcagcccgaggctgttcaggctcagggcgccgtcggtcagcagttcgccgccgaggttgttgacctggccgcgcaggcccagcgtcaggtcttgtgcgctggaaatgctgccttgggcattgttgaggttggcggcgctgaggctcagttggctttcactgctcaacacgccttgagtgttgtcgacgtcaccggtgagggtcagcatcagcggctgctggctgaaaacctcgccgccgctgttgtccagcgtcgagccgctgagtgtcacgcgctggccgttgagctggcccagcgtgcggttaagcaattggtcgacggtcaggctcagggcgttcgccgcgagcagtttgccgccgtcgctgttgtccaggcgctgagcattcacgctgacatcggcgctgccggtcaactcgcccgcgcggttgtccacgctggccacgtccaacgtcagtgcgtgggtggcgccgaccagacccgtgcggttatccaggttggcagcgctgatatgcaaggtgtcggtgctgaccaactggccgtgctggttgttgacggcgctggcgttgagcgtggtgtcggccttgccggccacttgaccactgcggttgtcgaggctggcggtggtgagcagcagcgcgccatcgccgatcaggctgccgcgtaggttggtgagttggtcacgggcagtgatgtctacgccgccatggctgctgatgacgccgtcggtgttatccagttgcgcgctgctggaagtaaaacccagggcgctgatgtggccgttgacgttgcccagttgctggtctgcagtgaggctcagggcctgattgctgatgagtttgccgttgctgttgtccaggctgtgcgccgccagcgagaacgcggtctggctggagatttcaccgccctggttgctcaggttgcccaggttgctcagcagcaggattggcgcattgatcaagccgccgttgctcaggtcgccgccgttgaggttcaggttcagctgggtgttgctgaacagttggccgccctgttgggtcaggccgctgacactggcggtgagtacatcggcgctggcaatacgcccgccgttggtgacctgggccgcggtcaggtcgagcttgccggtgctggtgagggcaccgccggtggcgttattgaactggccggtggtgacgctggccgcgccgtcacttttgatcaggccttgcccgctgttgtcgaggctggcgctggtgagtgtcaggccgtgtgccgaatcgaaagtgccgcccaggttcaacagctcggtgctgctggtcacgctgagcatgccggcgctggtcaccttgccactgctgttgtcgaggcgttggccgagcagcgtcaggtcgccttcgctgctgagcgtgccaccggcgttgatcaggctggcacccggcaatgcggccggcgccagttcaatcgccagtgagtgctgggcagccacgcttccttgggtgttgtccaggcgcgtgccgacaaggtgcgcatcctgagcgaacaccagccctttggcctggttgattacctgggtcacggccagttccagtgccgtcgcggcgagcagcttgccgccgctgttgtccagttgccggccggtcagcgcgacgtcttgctggctggaaatctccccggcgcggttgtctgtgctgtcgacctccagtttcagcgcttttgtcgccgctaccagcccgccgttgctgttgtcgagggtgtcggcattcagcgccagcatgccctgggccgtcagctccccgccttgttgagtcagtgtccccagggttgcgtcgaggtcgccttggctggcgatacggcccttcgcgttgctgacgttatcgaaggccaggtgcagcggaccggtggcgctgatcaagccattactgttattcagcgactggccaacaaagcccagcgcctgctggctgttgattacgccctggcggttgtccacctggccggtgtgcaggttcaggttctggttggctcgaatcaaaccggtgcggttgtccaggctggcggactggatgcccaccgcgcccttggccagcacgctgccttgcgcgtggttgtcgagcaggccgtctacgcttgcgttcaggctgccatcgctgacgaggctgccggactggctgttgtccaggctgccagcgttcacctgcaagcgctggccggcgccgagggtgccgccctgattgccgagtgcgccgatgatgctcaggtcgaggctgttatcgcccagcacgtgcccgccgttgttgctcagcgtcgcggcattgaccacgctggcaccggcgctcgacacctcgccgccgtcgttgaccaggctgccgcccacgctcaccgccaaatcggtcgagctgctgagcaagccgtgggtgttgtccagcgtgcccacgtgcgccgtgagcccggctgccgaaatttcaccgttgaggttcgccagcaactggtcgacctgcaggttcagcgcctggtcgctgatcaccttgccgccgctgttgtcgaggttctgcgcggcaagcgtaaaggcctgcgcgctggaaatttcaccgccactgttgcccaccgtggcgagatggttgagcagcagcgcgcccggggtgttgatcaggccaccggcgttgtccaattgcgcgtggttcaggtccagggtcaggctgcgggcgctgtacaactggccgccccggttgctgatcgctccctggctgctgagcgcccatggcccggcactgctgatggccccgccgtcgttgatcaggttgcctacctgcgcgccaaagctgttgtcgctgcgcaccacaccctgggtgttattgagctgattgcgcagcaccaacgacaggtcgtctttggcatacacgctgccttggccactgttgtccaggctgcccgcgttgaggctgacagtgtgctggccgctgagggtgcccttgaggctattgtcgaggctggcggcgctcagttgcaggtcaccggtggcggcgaacaggccggtctggttgagcagttgcccggcgatttgtgcggtgagctggccgttgctgataatccggccctggctctggttgtccaactgatcggcgctaatctggccctggcgctgggcgctgagggtgccgtgccggttgaccagcgcggcggcattcaccgtcaggtcacggctggcgatcacgctgttgccggtgttgtccagggtttgcgcagtcaggcgcacatcgccattggtattgcggctgttatcggcatttacgcccgcttcgataatgccgctgttgctcaggcgagcgccgctgtcgagggtgatgctgttgcgggccgcgaggttgtcggcgttgctgaggtcgccctgggccttgatcgccaggtctgtgccggcatacaccgcgccttgggtttccacgctttgggcggtcacattcaaggcactgccggccgaagtttgccccaggttcaggtggccgttggcatcaatgcggatatcgccaccggcaaccatgttgccggcaagccgtaccccgacgcccgcctcggtgcccaccagcctgatcgtgccggcgtacatcccgcccaacaccgatgagtcgatcgccagcgttggtgcggcgctgccgtcggcggcgcgtgcagtggcattcaaggtgctggcgtcaacgtcattgcgcccggcgacaatggccagcttttgcgcctgaatctgcgcgttgatgtgcgcggcgcgggtgatgatttcgaactggccgacgttgctcgcgttcaggccgtcgccatcaaccgacacactgccctggtccacctggtagcggctgaccttgccgttttcaatcacggcctggccggtggtcagcgtcacttgcggcgtgttgataaaaccgcagccgttgcagctcacgccgtaggggttggcgacaatcacatgcgctgactgccccgccacttcggtgtagccgcgcaactggctcgggctgccgccgttgacttcgttgaggatggtgctggcggcctgcccgctgaagttggggttgccgacaatgatcccgcccagctgtgtgctttgggtgcggtcggtggcgttattgaggatcaggccttgcgtgccgacgttgtagtcatggaactggttatgggacaggcccgccgcattcggcgccgcgatgttgacaatcggcacgccattgccggcttgcgccagggtggtgccgggcgcattcacgacaatgccgtccgcctgcgccagcaacggctgccagaacatcgcgttcgccagaatcagcgccagcccgcgtttgggcaggcccagaaacgacgtgcggtttttcagcgctgcagaaggctggcgcgcaagaaaggcgaactggcggacgtccatgtgaagtctcgatgcacgaaggcaaaaaagttagaggaagaaatccagccggaaatagatcggggcttcacgctcggtgatggcgtccggtcgctccagcgaatgcgcaaaggtcacggtggcggcgacgttggggccgcgggcaaacaactccagcgcgtcactggtcatgcgcccgtgctgatcggggttgtagcgcccgtggctgatcacgccctggtcatagccgaggctgctgccgtattcggcaaacacggtgtgcatccagctccaggtcaccgggcgggtccagcgcaggtcgttgcgccagtaaccgccgctgtcgccggtgagggactggtcctgatacccacgaatcgacgactgcccgcccaggctggtgcgctgtgggctgaacagcacgtcttcactgtgttgcccggtcatcaggctggtgaaactgaatgactcgtcccacagcttgaacggctgcaaataactgagggtggcggtgtatttgcggtatcgcgcgtcgggctgtccggctttgacgtcgcgattgctttgcgcatcgaaagcgccgatgccgtcctgcatgcccaggtcgatgttgagaaaagcaccgccgatgcgccggccatggttgatgccgaactgggcttcgctgatgcggttgctgctcagggccagcttgctgtcttcgatgtagttgtgggtgctgaggtaggacacgccggtgctcagcgaggttttgctcagcgcgtcgcggtagatcacccgctcaagacgcaattgatggttctggctgtcgccgctttgcttaaagctgaaaccgttggcctgggcctgggagcggtactcgctttcgctgtagctgtagttgaggttccaccagccgaacggcaggttgtaattgagcatcgcgttgcgcgaattcttgcgggtatcactgaccacatcgtgcccggcgcgcagcgagagttggtcggacagccccagcgggttatcccaatcgaagctggtgccagcctgctggcgaccggtgctgcgctggccgtcgttgccgtaggacactccggcgcgccagggcttttgcgcgctgttcttgaccagcacgtcgctgccgcccaccgccttgcccggcgccagctccatttgtgcctggttcgacggcaagcgattgagctggtcaaccatctgctcgatttcccgcagattgagcacatcaccgggcttgccgggaaacacctgggccagctggcgctcggaaaagccactgccctcggcgcccttcaagccttcgaggcggccctccaccacctgcacgttcaggttgccaccggacagatcctgttgcggcaagtaggcgcggctggtcaccaggcctttgtcgatatagcgctcggtgatggttttaagcagcgcattgagctgcgccacgcccaggcattgcccggtataaggcgccagtatctgcgtgcgttcattggcgccaagcgcgtctgcaccgctgagttgcacggtcttgatcgggaaacagcgattatccgcagccgcgttgggcgcggtggccggtgtggcgctaccgggcaggtccttgaggccgtccaggcggcggcgttgttcttcgagcaggcggtcctggcggtcgcggatcaggtcggtatcgcccgggttgggcgctgcctgcagcgtcatggccaccgcgagacctgccagtgccagcgcgtagcaactcactgtgaggattgaaacacgcatggccattcccttgaccaaatggcgtagtgccatcactgggcggcgatactatggacacatttttttggcgtcaatttgtcaaacatgaaacttttacagaatgtttcatgtttgtattctggctaaaacaacggccttggtttatgtggctagaacggtttttggcttgtccatcgcctgactgtgaaccgaggatccataagcctggcatgggccaaatgctcaaacgtcataatcttcgactcgtccgcatggtaatctcgcgccaccacgaatagacattgatcgtcacaagacgatgaccagagccaggaaagaacatgccgaaaatctctcactcagcgttgcgccgcaacttccgtgaattgcttgcaaagaacatctgcgtagaaaccgcctccgttttcgaccccatgtcggcgcgtatcgccgctgacctgggcttcgaagtcggcatcctgggtggttcggtcgcatcgttgcaggtcctggcggcacccgattttgccttgatcacactgagtgagttcgttgaacaggccacccgcattggccgggtcgcccagctgccgttcattgccgacgccgaccacggttacggcaatgcgctgaacgtgatgcgcaccgttgaagagctcgaacgcgctggcgttgcggcactgacgattgaagacacgctgctgccggcccagtttgggcgtaaatccaccgacctgatttccgtcgaggaaggcatcggcaaagtgaaggccgccctcgaagcgcgggtcgaccctgagctgtcgatcatcgcccgcaccaacgccggtgtactgccgaccgcagacgtgatcgcgcgcaccaaggcctatgagaaagccggcgccgatggcatctgcatggtcggcgtcaaagacttcgaccaccttgaacagatcgccgaaaacctcacggtgccgctgatgctggtgacctacggcaacccacagctcaatgacagcgaacgcctggccagcctcggcgtgcgcattgtggtggccggtcatggcgcttactttgcctcgatcaaagcgacttacgacagcctgcgcgcccagcgcaaactgaccagcagcaccacgaacctcagcgcgaccgaactgacgcacacctacacgctgccggaaagctacgtggcctgggccgaagagttcatggacgtgaaagagtaagtacggcacaggtgccaattgaagcaatcggcacctgattcactcagctaacgttacattccggaaaactcatcgacgccgacaaactcaacgttctcaaccgttgaaccacgagtacgcgtagccttccaacgatagaagcttctgcccggagcggttaaatcccacttgtcttcacggtaagtaaaggacattaacgttttgtcgggctcgaacttgaaccatccactgacgtagtaatatcggcttccggggtagcagataccgaccgtcacactgcctttcgcttcgttttggtcagtcagctctatctcatagctgccacctttatatctaaaccaaaaattgtccgacatttaagtactcctttgaggttcactgctgattgactcaaagtgtaaatacatgccccgataaagcacctgttataaatgacagtcacgtataattattcgcgataaacagcgaatacactaactatggtttgccagcgtcatttcagtagaaatcgcagagacggggcatgctggggccgcaacgtgccgggtaagcctcgcccccatgtacgtaagctcacgaaaaaatccgccgcagagcctgcggcggcaaaccaaaggtttttgtcgaagcagagcggctaagaccctgcccacgctacacctgcgaaaaattaaaagaggtgaagtttaattaatcgagtttaatccgcaactgcgctgcagcccgcgaaaaatatgctaaaaatcagcttcgacaacctcgtcgagcacaataaaaacggcaatacgctcactgaaaaccctgccaacaaaactgctgcgccatttcaacaattgcggtgtttctgtgcacgcgttaattattccggggaagtaacaacatgatcaaacagtggagcctgttaacactggcggtgtgcgccagcgtcagccaaatggcgttggccgagtccgtcaccgaccaggccgattccaaaggctttatcgagggcagcagcgtgaccgggctgttgcgcaactattacttcgaccgcgaccgtcaaagcggcaaggccgacaaccgcgactggacccaaggcgcgatgctcaactacgcctcgggctttacccaaggcaccatcggttttggcgtggacgcctacgcctatggcgcgatgaagctggacgccacccacgccgatgccggcaccggtgacctgccgaccgatcgccatggcgacccggaaaacggctacggctcagtcggcgcggcggtgaaaatcaaggtctccaagaccgagctgaaattcggggacatgcagcccaccgccccggtcttcgccaccggcggcacgcgtattttgccgcagaccgccaccggctttgacctgaccagcagcgaaatcgccggcctggacctggaagccgggcacttcaccagcaccaacagcggcatgaccagcaaccatgaccacgatatctacgccacttacgccaacgtcgcggccaacagcgcgagtttcatcggcggcaaatacaccttcacgccgtcattgagcgcgaccgtgtacgccggtgaactggaagatatctggcgccagtactacaccaacctcaactacgtgttgccgttgggccatgaccagtcactggcgctggacggcaacctgtaccggaccctcgacaccggcagcgccaaggccggggcgatcaacaacaccacgtattcggtggcggcggcctactcgttcctggcggcccacaccctgacgctgtcgttccagaaagtgcatggcgatacgccgttcgactacatcggcaccggcaacaacggcgcgggcgaaggcggcgattcggtgttgctggccaactcgattcagtggggtgacttcaacggcccgggcgaacagtcctggggcattcgctatgacctgaacatggccagctatggcgtgccgggcttgagcttcatgacccgctacgtcaacggctcggacatcaacggcacccacaccccggccaacagcgcctatgttggcgactacggtgccgatggcgaccaccacgagaccgatgtggaagccaaatacgtgctgcaaagcggcccggcgaaaaacctgtcgctgcgcgtgcgtgacgcgatggtgtcgtcgaacgccgaccagcgcgatggcaagttgaacgagctgcggctgatcgtcgactacccgttcacgctgttgtaattacgccgggttcagccgttggcgcatgcctgcgctggcggctggaccggcctgcaccacgcacgcgtccaacgccaccaacgcgcctgcggcggtggccatcatcggctgcaccggcagcccggtctcgcgctccaccacctcgacactggtgccctcttcggcgtaatgccgattgccccacgccaccaacgccatcagcaccatgcgaaagtcctcgcccttgggcgtcggcacgtattcgtagcgtggcggccgttcgctgtaggcgcggcgctcaagcatcccggcctcgaccaggccattcaaacgacgcgtcaacatgttcggcgcaatgcccaggctgcgcgagaactcatcgaagcggcgcaggccatgcaaggcgtcgcgcatgatcaacatgctccaccactcgcctacgcgctcaaggctacgggcgatggggcattcgtcgctgacaagggacttacgttgcatggcggttcctgtgtggcagtacaaagttgtgtgacgccatgttactttcatcatgatagtgacgtccacagctgtgtatccctcaagcaaccggagtcgattgatcatgagtaaacgtatcgtcgtgacaggcatgggcgcgttgacgccgctgggtgccagtgtggaatccacctggcaacgcctgttgaacgggcagtcggggatccgccgcctgccggaagagttgatcggtgacctggcggtaagcatcggcggccaggtgcaaagcctgctgcaagaccctgaagccgggtttgatccggatcgcctgttggccgccaaggaacagcgcaaaatggaccgcttcattctgttcgccctggcggcggcggatgaagccttgaagcaagccggctgggcgccgaaaacgcccgaagagcaggaacgcaccgcgaccatcatcgcttccggcgtcggcggtttcccggcgattgccgatgcggtgcgcaccaccgacagcaaaggcccgcgccgcctgtcgccattcacgattccctcgttcttgagcaacatggccgccgggcatgtgtcgatcaattacggcttgaaaggcccgctgggcgcgccggtaacagcctgcgcggcgggcgttcaagcgattggcgacgcggcgcggatgatccgtgccggtgaagtcgacgtggccgtgtgtggcggtgcggaagcggcgattcatcgggtcagcctggcgggttttgcggcggcgcgcgcgttgtccagcgatttcaatgacacgcctgagcgtgcctcgcggcctttcgatcaagcacgtgacggcttcgtgatgggcgaaggtgccggcattctggttatcgaagaactcgaacacgcgctggcacgcggcgcgcagcccatcgccgaactggtgggttatggcaccagtgccgatgcctatcacatgaccgccgggccggaagacggtgatggcgcgcgtcgggccatgacccaggcgttgcgccaggcgggcatcgaggcgtcccaggtgcagtatttgaatgcgcatgcgacgtcgacgcccgtgggcgacaaaggcgaactggccgccatcaagacggtattcggcgccagtggccacccggccatcagttcgaccaaatccgccaccggccatttgctcggcgcggcaggcggcatcgaagcaatcttcaccgtactcgccctgcgcgatcaggtcgccccggtgacgctgaacctggaaaacccggacgccctcgccgacggcctggacatgctgcgcggcgcggcgcggcacatgccgattgaatatgcgctgtccaacggcttcggttttggcggcgtgaacgccagcgtgctgttccgccgctgggtataacccccggtttgcccctgccgtgattttcggggaccatgtgcgccttctgtttaagccaacaagaggcgcccatggccaaccacgacctgtcctacacccccgacccggatgccgattcgatttcctccgacgtgatcggcttcaacggcatcctggtctccacgcaaatcccaacgcgcgccgacggcagcctggaactgggcgacatcaccctgcaaagcgaatgcaccctgcaagcgctgaaagtcgcgctggagaaagccggcagctccatggaccgggtgatgcacctgaccatctacctcactgacatggctgatcgcgccgctttcaatgaagtctacaagcgctttttcgccaagccatggccggttcgtgctgctgtaggcgtggctgcattggcggtggaaggcatgcgcgtagaagtcaccgcgatggccgcccaagcctaagttatcacccgcaatagatatccaatgtgggagctggcttgcctgcgattgcatcacctcggtgtacctgatgtaccgagttgccggcatcgcaggcaagccagctcccacacgacgccctgtggtagatgccgctcgggcatttcacggctacaatgcgcgcctcgaccgtgacaagcctgactaaaaaaactatgtccttgcccaagcatcaccttgaattgctcagccctgcccgcgatgtcgccattgcgcgcgaggctatcttgcatggcgccgacgccatctacatcggtggcccgagcttcggcgcccgccacaatgcgtgcaacgaggtgagcgatatcgctcaactggtcgaattcgcccaccgttaccacgcccgcgtgttcaccactatcaacaccatcctgcacgacaacgagctggagcccgcgcgcaagctgatccatcagctgtacgacgccggtgtcgacgccttgatcgtgcaagacctgggcgtgatggagctggatattccgcccatcgagctgcacgccagcacccagaccgacattcgcaccctgggccgcgccaagtttctcgaccaggccggtttctcgcagttggtcctggcccgtgagctgaacctgcaggaaatccgcgccatcgccgacgaaaccgatgccgccatcgagttctttatccacggcgccctgtgcgtggcgttctccgggcagtgcaatatttcccacgcgcagaatggccgcagcgccaaccgtggcgactgctcccaggcgtgccgcctgccgtacaccttgaaagatgaccagggccgtgtcgtggcctttgaaaaacacctgctgtcgatgaaagacaacaaccagagcgccaacatccgcgccctggtcgaggccggtgtgcgctcgttcaagatcgaaggccgctacaaggacatgggctatgtgaaaaacatcaccgcctattaccgccaacgcctcgacgacgtcctcgaagaccgccccgacctggcccgcgcgtccagcggccgtaccgcgcatttcttcctgcccgacccggaaaaaaccttccaccgtggcagcactgattacttcgtcaccgaccgcaaaatcgacatcggcgcgttcgacacgcccaccttcaccggcctgccggtgggcagggtggaaaaagccggcaagcgcgacttgcaggtggtcactcacgagccgctgtccaacggcgacggcctgaatgtgctggtcaagcgcgaagtcgtgggtttccgcgccaatatcgccgaacccaaaggcgagttcgaagaagacggcgagaagcgctaccgctaccgcgtcgagccgaatgaaatgccggccggcctgcaccagttgcgcccgaaccatccgctgaaccgcaacctcgaccataactggcaacaggccctgctcaagacctcggccgagcgccgtattggcttggcatgggtcgcacgcttgcgtgaagaccagttgcaagtcaccgcgaccagcgaagaaggcatcagcgccagcatcaccctgcccggtccgtttggcgtggccaacaagccggaacaggcgctggacaccctgcgcgacctgctcggccaactcggcaccaccgagtaccacgcgacgaatatcgagctggacgcgccacaggcgtttttcattcccaactcgcagctcaaggccctgcgccgcgaagtgatcgaagcgctgaccgccgcacgcgtcgcggctcacccgcgtggcgggcgcaaggccgagacgtcgccgccaccggtttacccggaagcgcacttgtcgttcctggccaacgtctacaaccagaaagcccgtgatttttactaccgtcacggcgtgaagttgatcgacgcggccttcgaagcccacgaagaaaccggcgaagtgccggtgatgatcaccaagcactgcctgcggttctcgttcaacctgtgccctaaacaggccaagggtgtgacgggcgtcaagaccaaggtggcgccgatgcaactgatccacggcgatgaagtgctgacgctgaagttcgactgcaagccgtgcgagatgcacgtggtgggcaagatcaaggggcacatcctgggcttgccgcaaccgggcagcggcgtgggtcatttcgacccggaaagtatcatctttcagggcacgcactagcccttggggggcggggccaccaccagccccgctgcaacccggcagccgccaacaaaatcgccgcaacccccagccattgcagccagcccaggcgatgcccgaaggcaatccagtcgacaaaaatcgccgcaatcgggtagataaacgacagcgcgccggtgatggcagtcggcagtttctggatcgccccgtacaacaacacatacatcaggccggtgtgcaccacgcccaacgtgaccaatgccgcccaggcattggtcgcgttgggcaagctgttccagggcactaacggcgccagcaacagtgcgccggtgatcacctggatcagcgccatcaaatgcggcggcacttccttcagacgcttgatgaccaacgccgcaatcgcgtacaaaaacgccgcgcccaaggccagcgcgatacccgccaggtaatcacccccaccgctttgctgttcgccatgggcagtcacaatcgccaacatgcccagaaacgccacagtcaaccacgcgagtttctgcacggtgatcttctcaccgagaaacagcgccgccagcagcaccaatatgaacggctgcacgttgtacaccgccgtactgatcgcgatggacgcgcgcgaataggattcgaacaacagcaaccagttaccgacgatggccacgccgctgagcatcgccaggccgagcttggcccaggtcagcagctccagccgcaggtaacccagcaacgcgcacaccagcaacagcgtcagcgcaccgatcacgcagcgccagaacaccacttcgatcaccgacacgcccgacaccagcacaaaccagccgatggtgcccgaaatcaacatggcggcgaccatttcccacgacccgcgacggatagatgtgtccacgatgcaagctcctcaagtgaggctcaattatggcaatctgcaggtcagcggctccagcgactaaaataggcaaaaaccctcattcaccttttcttattaggcgggcagcatgattgacactatcgaccagcaactgatcgcggccttgatggacgattcgcgcctgtcgctcaaggccctggcgggcatcaccgggctgtcttcgcccagcgtcggcgaacgcctgcgtcgcctggaagagcgcggcgtgctgacccactacaccgtcgacatcgaccccaaacacttcggctacctgctgcaagccatcgtgcgcatccgcccgttgccgggcaagttgcaggaggtggagcgcctgatccaggcgatccccgagttcaccgaatgcgacaaggtcaccggcgaagactgctttatcgcgcgcctgcatgtgcgcaccatggaccacctcgacgccctgctcgaccggatcacggcctgcgccgaaaccaacaccgccatcgtcaagaaaaccccggtgaaacggcgtttgccgccgctggccgattcgtgattttgcgtcactaacgcagtgacgcaatcgctattctgtcatcgctgggcggtctttatgctgggctccactcattggaacccacaggtgtaaagcgcatgtacgttattactggcatcacaggcaaagtcggcggcgccttggcgcgcaatctccttaacgcaggtcttcccgttcgcgcggtgattcgcgacgccggcaaagcggcttattgggcggaccagggctgcgaaatcgcgtttgccgcgatggaagatgcccaagcgctgacggaagcattcaagggcgcaaccggcgtgttcatcctgccgccgccgggcttcgacccactgcctggttttccggaagcgcgagaggtgattgaagcggtcagccaggccctgaaggctgccgcgccggaaaaagtcttgtgcctgtcgaccatcggcgcgcaggccacagaactgaatctgctgacccagcgcacattgatggagcaagcgttgagcgccctggacatccccgtgaccttcctgcgccccggctggtttatggaaaacgccgcgtacgatgtcaccaccgcgcgtgacaccggcgtgatccatagcttcctgcaaccgctcgacaagcgcgtgccaatggttgccaccgccgacatcggcacactcgccgcgcagttgctgcaacaagactgggccggccaccgcgtggtcgagttggaaagccagtgggtcagcccgaacgacatcgcccaaaccctgacacacctgcttggccgcgaggtacacgccgaagtggttgagcgcgatacctgggaagcattgctgcgcggccagggcgcacaaaacccattgccgcgcatgcgcatggtcgatggattcaacgaaggctggatctgtttcgagcatgaacaggtgctgaagggaaccacctcgctggaaagcgtgctgcgcaccttggtcgggtaaccgcttaatccggcctgttatggctgtggcgagcgggcttgttgtggcgagcgggcttgccccgcgttggggcgcgaagcggcccccgaaacctgacgactcaattcatctgggaaaactaggtggctggttcggggctgctgcgcagcccaacgcggggcaagcccgctcgccacgacagccccgctcgccacaacaagcaagctcaccacaacaagcccgctcgccacgggaagcccactcaccacaataggcccgctggaaatatggagacaccgaactcaacacggccaacccaccggcgctgctagcgtcatagcttcttatccatgcaaggagcaacggattgtctcgtcagccaaactctcaccggttacgccgtggtcgctactcagaaccagggcgtgcttatctggttaccgccgtggtgcatcagcgccaacccttgttcaacagttttgaactggggcggttattggtcgccgaattcaaacgaacccacgacgcgggtcaagtcaattcactggcgtgggtcatcatgccggatcacttccattggctgttcgatctgcataactcgaccctgcccgatgtgatgcgacagaccaagtcgcgcagtacgctaagcatcaatcgagcccgaggcagccgggaaagattttggcagcgcggctatcacgaccgtgctgtgcgggccgatgaagacttgcgaaaaatggcgcgctacgtgatcgccaaccctctgcgggcggggctggtcgagcgcattggggattatccgttgtgggatgctgcctggctgtgagtccgggccttactgcggttgtggcaagcgggcttggtgtggcgagcggggctgtcgtggcgagcgggcttggtgtggcgagcgggcttgccccgcgttggggcgcgaagcggccccgaaacctggcgactcaaatcatccggaaaagcgccgtggctggtttggggctgctgcgcagcccaacgcggggcaagcccgctcgccacgacagcccgctcaccacagcaggccctctgaccacaggaagccctctcaccacaccaagcccgctcgccacaacaagccctgttgctacaaaaggctcgctcaccacaagacgcctgatcagtcgtgcaacgccttcgccgccgccagcaacccccggaacttgcgatagcgcgcctcaagcaccggctgttgcttcacatcaggccaataccgcgtcttgaccggcatgcccgcctgcaacaaatcagcgccctgcccgatcgacagcaaccccaacttcgccgcgccaatgcaggcgcttaattcgctgccctgcaaggtgaaaatctcccgttgcaggatattcgccaacaactgcgcccagtattcgctgcgcgcgccgccgcctaccagggcgcaggcaccgacgctggcgccggctgactgcacggcgtgcaaggcgtcaagcaagccaaaccccacaccttccatcaccgcataaccgagcatcgccggggtgcaatcgtggcccaggctcatgaagccgccgcgcagcaaagggtcgttgtgcggcgtacgctcacccgcgaggtagggcaaaaacagtggcgtgtccaacggcacgggttgcccaaccggcaactgtgcctgcacttgatccagcagggtttgttcgtcctggctgccggtcagccgcgtgacccaacgcaggcaactggcgccggccagcatggcgcccatggtgtaccagcgattgggcagcgcgtggcagaagctgtgcaccgcgctggccgggttgccggcggcgtgatcggtgatggcgacgatggccgcgctggtgcccagggtgatgaaaccatccccggcattgattgcgccgatgccaacggccgccaccgggttatcgccgccgcccccggcaatcaccaccttggcagacaagcccagccttgcagcaacactcggcgtcaaatgcgcactcgccgcaccgccttcaaccaaccgaggcatctgcgcaggcgcaagaccggtggcgcgcaccatcggcgcaaaccattcgcggtgcgccacgtcgagccacaaggtgccggcagcatcggacatctcgctgatgcgctcgccactcaggcgcaagcgcaggtaatccttgggcgacagcacgcagtcaatcgccgtgaacacctcgggttcatgctgttgcagccacagcagtttcggtgcggtgagcccggccatgggcaagctgccggtgacttcggcaaagccaggcccaagccgctccgcttcggcgacagcgcgcgagtcgtcccacaggatcgccgggtacaacgcacggtcgtcagcaccgagcagcaccgcgccgtgcatctgcccggacaacccgatacatgccacccgactgaacgccgcatgggcgcgcaactgctcaagcgcctgcacacacgcctgccaccagtcttcaggcgcctgttcggaccagccgctatggcgccgcgacacattcaggcgcacacctgcatgggccagtacggcgccgtcgacgtccatgaggatcgccttgagttcggaggtgcccagatcaataccgagggaaacaggactgctcatacggaggtcattccaatcaaatacagccacatgaattacggtattgcaggcgcggcgccaggcgtacgctttgcaccggtgcgttgggcgaggccatgcgttgcagcagcatctgtaccgcgcgggcaccgagttccttgacgggctgggcaatcaaggtcaggcgcggcacgaaaaaatccgcccagtcaaaatcgtcaaaacccaccagggcgatctgccccggcacctcaatgtgcgcgtcacgcagggcgtgcatggcgcccaaagtcatcaggttattgcccgccatgatcgcggtcggcggctgcggcaatgccagtaactgcgccgtcgcttgccgggcaggctcactgttggaaccgccgttgaccaacagttgcggatcaaataccagccccgctgcctgcaaggcggcgcggtaaccggccgcgcgctcatcggtcgtacccagccccgcacgcccggcgataaagccgatgcggcggtgcccgtgttcaatcaaatgggcgaccagggcctcggtggactgggtattctccaccccgatctggtcgaattgctcactcatcatgcggtccaccagcaccgtcggcatctcgttggcctgcaggtattccagggcttttgaaccggtggacggggccagcaaaattccgtcgacgcgccgatgatgcagcgcggtgaccacccgcagctcctgctccgggtcgtcgtgggggtcgacaaacagcatcatgtagccgtgtttggcgcactcggtttcaatcgcgtgcacggtttcgctgaagtagtggttggacagcgccgagatcgccacgccaatcgtgctggtgctcgaacgggccagcgagcgcgccagggtgttggggatgtaacccaactcctgaatcgcgcgctgtaccgcctgcagcgtggccgcgctgaccttgcgtgtgccgttcaacacgtgagacacggtcgacgtcgacacacccgccctgcttgccacgtcatccatggtgaccacgacgctttccccttcactgaatcaatgtttgctcgaccacccgctgtacgtcccgacgttgtcacgggtgatcagttttggcgtgagcagggtaaccgcttcggccggggctttgtcgttgagaatgtcattgccgacattcaccgctgtttgcgccatggcccacgggtcctggctggccgaggcctggatttgcgtgtcggtcttcagcgcattttcgatgtccggcgcgccgtccacggacgtgatgaggatgccgctgcgtttcagttgcttggccgccaagtcactgccaatcgcttgcgggtcgttgatcgcaaacaggccgtcgattttcgggaagcgcgtgaggtagccctgcatcacgttcaagccgccttcgcgcgagcccttgccgtcctggtcatcggacagcaccttgatgtccggcgcgccggctagtgcagctttgcagcctttgacgcggtcggtcacggcggtgacttgcgggccattctggataatcacattgcctttgcccgcgagcttgtcgaccaggaactggcaggccagcttgccggcttcgacgttgtcggtttgcacggtggcgttcacgcccttggcgtccacatccaccgccaccacgacgatcccggcgtcgcgcgctttcttgatcgcggaggccatggccgaggggtcgacggcattgagcaggatgaggtcgaccttggacgagatgaagttatcgatctgcgaaaactgcttgctcaggtcatagtcggccgacaccgaggtcaccttgacgttggggttcagttccttggcccgcgccgtggcgccgtcggccagggtcacgaaatacgggttgccgagcgagcccatgctgatgccgagggccttgagctctcgggcttcgacgacgttggacatcacggcagccaaggcaataacgggaaacaggcgtttgaagttcatgcgggtctctcttgtgattgttaggggagtgaaatcaggtgcgtgcgccggattggcgataacgatccagcgccaccgcgccgatgatcacaatgcctttgatgatgtactgccagatatccgagacccccagcagcaccaggccgttggtgagtaccgcgataatcagcgcgccgatcagcgtgccgccgatggtgccgacgccgccggtaaaactggtgccgccgaggatcacggcggcaatcgcatccagctcataggattgccccagttgcaggccgttggcggcgaacaggcgcgaggcgctcatcaccgcacccagcccggccaatgcaccggacatggcgtagacgaacagcagcaccttccacaccttgatgcccgacagccgcgcggcttcagggttgccgcccaccgagtagatctgcacgcccatcaccgtgcggcgcaggatgaaccacgacagcgccaccacggccaccgcgatgatcaccagccacggcacgcccagcaccgagtcgttgccgataaacgcaaacggcaggtcggggttgaacacggttttgtcatctgccagcaaccgcgccaggccacgcatggcggtcagcgcgccgagggtgacgataaacggcggcaggcgcataaaggcaatcaagccaccgttgaccaagcccagcaacaggccgaaaccgacaccggcggcaatcccgaacataccgaactgcggcgacatcgacgcctgcaacgcgaccacggcggatgcggccagaatcgcccccaccgacaagtcgatgcccgccgtgagaatcacaaaggtcatgcccgccgccagcaccacattcaccgaagcctgctgggtgatgatcgacaggttctgcacggtgaggaagttttcgctggccagggcaaagcccaccagcagcagtaccagcaccggcagcatgccgacggtgcgcatcagctcacgaatgcgctccgctttgccgacgggcgcgagggtcagtgcgttgttgtttgaatcagccatgggcagccacctgatcgccaccggtggcgaggtcaataatgcgttcttgggaaatggcgtggcccgaagccccgccgacttcggccaccaattggccttcgcgcatgatcagcacgcggtcgcaggtgccgatgatttccggcagctcgctggaaatcaccacgatgccaacccccgccagcgccagttggttgatgatgcggtagatctcggacttggagccgatgtccacgccccgcgtcggttcgtcgaggatcaacacgtgcggcttgacctccagcaaccgcgccaacaggactttttgttgattgccgccgctcaacgcgccgacattgaccttgcccgacgccacgcgaatcgacagcgacttgatcgcgtcattcgaacgctgcgcagcatggccgcgatccagcacgccaccggcatgcgcgtccggcacacaggcgcagacgttgatgttgtcggccacgctcatgtccaggaacaggccctgggccttgcggtcttcggtgaggtacaccacgcccgcacgaatcgcatccgccgggttgcgcagctgagtgacggttttgccgaccacttccagcgtgccggaggtgcgcgggtcggcggcgaagatcagccgcgccagctcggtgcgccctgccccaaccagcccggcgatgcccagcacttcaccggcgtgcaggtcgaaactgcactggcgcacccgcttgccatcggccatgtcacgcacgcgcatcaccacgttgccggggttataggcggcgtgctccttcttgtagaagccggagagatcgcggccgaccatcattttcaccagcacgtcggccgataacgcatcgcgggtcagctcgccgatgtactggccgtcgcgcagcaccgagacgcggtccgacaactcgtagatttcggccatgcggtggctgatgtagatgatcgccaggccctggctgcgcagctgcttgatcagggcaaacaggcggtcggtctcacgcgatgagagtggcgtggtcggttcgtccatcaccagaatccgcgcatgggcatgcagggctcgggcgatttccactaactggcgctcggcaatcgacaagctgctgaccggcgtggcgggtttgaactcggcgcccaggcgttgcagcacttcgacgcagccctctttcatgcccttgcggtcgatggtccagccgcgccgcagttcgcggcccaggtagatgttctcggccacgctcaggttcgggcacaggctcagttcctgatagatcacggcgatgccgagggttttggcggtggcggggtcgaaggtggcgacgggctggccgtcgatgcggatttcaccgccagggtcggcctggtaagcgccggagaggattttcatcagggtcgatttgccggcgccgttctcccccatcaaggcgtggatttcgccggggtagaccttcaggccgacattcttgagcacgcgcaaaccgttaaaggttttgctgatgccctgcatctcaagcaagggttcaaggctcatggatgagctcctggatttattatttttgtagtcgagtgctgccgactctagtccagttacatttccttacgcaagcgcttgcgtgtgccgtttatcgctgggttaaacgtttcatcaactgctaaagcgcgaaacccgcatcgtgtggggtgtcgatcaaaactgagcacagcggcctggaggctgaattcaatcaactgtgggagctggcttgcctgcgatggcatcaacgggttgtacctgatacaccgaagtgcctgcatcgtcggcaatccagctcccacctatctctgctattgttcaaagacctcatctcctcctcatcgcctttgcgcgatcttctgtgagcatgctctgcgccatcggctttcgatgatggcgggcctgaagttcccggaacgcgaccgcgatggataaaagccccaccgatcgaccgctcgaaccgcaatcgcgggccgaaaaaatcgtcgaattcaaacgtcagaaaaccctgctcaagaccggcgccctgcaagacgcgatcttcaacagcgcgtatttttccagcatcgccaccgacgaaaaaggcgtgatccaaatcttcaatgtcggtgccgaacgcatgctcggctacgccgccgaagatgtgctgaaccgcattacccccgccgacatttccgaccccgccgagctgattacccgcgccgccgccctcagcctggagctggacaccccgattaatccaggcttcgaagccctggtattcaaggcctcgcgtggcatcgaagacatttacgagctgacctatatccgcaaggacggcagtcgcttgtcagcgatggtctcggtcacggccttgcgcaaccgccacgacacgatcatcggttacctgctgatcggcaccgacaacactgcgcgcaaacaggaagaagccgagcgcaaaggcttcgaacgcgcgctggaagaaaaaaacctggaactggaacacgccaaccacatgaaatccgagttcctcgccaccatgtcccacgaattgcgcacgccgctgaacgcggtgattggcttttccgaggccttgaaggatggcttggtcggcgacatgagcgaggtgcagcgcgaatacatcggcgatattttcaccagcggccagcacctgctgtcgctgatcaacgacattcttgacctgtccaaggtcgaggccgggatgatggacctggagttggagcccgtggaactggcgggcttgctcgccaacagtttgttgatcgtgcgcgaaaaagccgcgctgcaacgcatccagctgaaactggaatgcgaggccgatttcggcaccctggaactggacctgcgcaagaccaagcagatcgtctacaacctgctggccaatgcggtgaagttcagcgaacacggcagcagcgtgaccctggcggtgcgcgaagtcagccgcgcgcaggtcgggcagatccccggtgattgggcgacccacggcttcgccctgcaacccggcacacacgcacagttcctggaattgagtgtcagcgacaccggcattggcatcgccgaggaggacatgagcaagctgttcaaggccttcagccagatcgacagcagcctggcgcgtaaattcgaaggcacaggcctaggcctggcgatggtcaagcaactgaccgacctgcatggcggcagcgtcgccgtggccagccgcgcaggcctgggcacgcgttttgtggtgtggctgcccctgcaccgcgcgccggaggctgtatggccgaaatcctgatcgtcgaagacaacgaggccaacatgcgcctggcgcgcttgttgctgctcaatgccggtcacaccgtgttatgggcggcggatgcggaaaccggcctgaccctggcgcgggaaaaacaaccggcactgatcctgatggacattcagctaccgggcatggacggcctcgccgccacgtcgctgctcaagcaagacccacataccgcgcacataccggtgatcgccctgaccgccatggccatgaaggaagaccgcgagaagacccggctggccggttgcgacgcctacatcatcaagccgctgcgttacaaagagctgtaccaggtcatcgacaccttgctgcaacctcacaccaaccctcttctatgagtcctctccatggccagccaacccgcaacgctgttgatcgttgatgacgaaccccaggttcgcaagctattggaaaccctgctgcaacacgagggctaccagaccctgagtgcgagcagcggtgaagaagccttgcagctcgtggcgcaacagccacctgacctgatcctgctggacatcatgatgccgggcatggacggctatgaagtcgccagccagctgaagggcgacgaaaccaccgccagcatcccgatcatcatgctctcggccctcagtgagccgagcgcgcgggtcagcgggctggaaaccggcgccgaggaattcatcagcaaaccggtagagcgtgccgagttgtggttgcgcgtgcgcaacctgctgcgtctcaaggcgcgtggcgatcagttgaaaatccacaacctggtgctggagcagcaactgcaacggcaaacgggcgcgccggccggcatgagcgtgcatgacctggcgcgccaggacctggaaaatgccctgcgccaagcattggagctcaatgagttcacggtgcattaccaacccaaggtcgaacttgccggcgggcagatatgcgcccttgaagccctgctgcgctgggagcgccccggctacggcgcggtgtcgccggcggtgttcgtaccggtgctggaaagcctggggttgatcgtgccggtcgggcgctgggtgatcgacaccgtttgccagcagatagccgagtggcaacgcggcctgattggcgccgtcgaggtgtccgtcaacgtctctggtcatcaattgatcgaaggcgacttgattgccgacatcgaacgcatcctgatagaaaccggcgtcgccccgcattggctggaggtcgagctgaccgaaggctcgctgatggaaaacacccagcacaccattgccagcctgcaacgcttgcgcaacctgggcgtgaagatctccatcgatgacttcggcaccggctattcaagcctggcgtatttgcgccggtttcccatcgatacgctgaagatcgacatcgcgtttatccgcgaagtcaccaccaacccgcaagacgcggcgatcacccgcaccatcattgaactggcccatagcctgagcctgcaagtggttgccgaaggcgtggaaacccaggcgcagctggcgtttttgaaggacgccggctgcgatcagattcaggggtatttgttcagccggccgctgccggcagccacccttgagcgcctgttactggaacgcctgcccaggctgtgaaacggcttcgcgcaaacagtcgatcagcccgtggtgagtagcactcaagcgctcggcgccgcttatcagcgcgagttccgacggcggcactggcggtaactgggtgcagattcggtggctggtcagcactgcgctctcgggcaggatgctgacgcccagcccggaactgaccgccgcctggatgccggtcaggctgtggctggcgaacgctacgcgccagctgcgccgcgccttgtccaggctgcgaatggcacgctggcggtagatgcagccttgggggaatagcgccaacggcaaggtttcggcctgcaggtcctggccttcgccacacacccacaccagcggttcgggccaactggcgtagcactcgccgctgccgggctcgcgcttgaccaaggcgatgtcgagctcgccggcgcccaactgccgccgcaaatcagtgctcatgccgctgaccgtttccagccgcgcttcagggtatgtgcgcacaaaatccgagagcatcgaggccatgcgcgttgcgtcgaaatcctctggcacgccgaggcgcaccggcaccacgctggtttcggtattcagcgcgtcgcgggcctcgcgggacaggttgagcaagcggcgtgcgtagtgggtcagcaattcgccatgctcggtggggctgacctgttggcccgagcggtcccgtaccagcagcacttgcccggcggcgtcctcgagcttgcgtatctgctggctgaccgtggattgggtgcgatgcacgcgctcggcagcacgggtgaagctgccttcgtcgaccacgcagaccagggtttgcagcagttccagatcaaacatgtcggcgcccttcatatcgatgattcaactgtgatgcagaggttaatttaatttccaactgatggacaggtttcctatgctgcaacggtcactcactttcagaacggtgcaacatgcccctggaacactcccctcgcccgcgttggctgacctttgactgctacggcacattgattcaatgggatgaaggtttgcgcgctgccatcgataaaatcctcaatgaaaaaggccagcacccggtcgaccgggacaccttgatcagcgtttatgaccatcatgaacacgcgctggagcaaacgccgccccatcgcaactttcgcgccttggcgggtctgagtttgcagttggcatttgaggaattgggcctgcccgtgaatgagcacgacggcgctatcctgaccgacagcatcagcgcaatgccgccgttccccgaggtggtgggcacgctcaagcagctcaaggaaatgggctacaagctgtgcattgtgtccaacaccgatgatgacgtgattgccggcaatgtcgcgcaattgggtggctacatcgaccgggtgatcaccgcgcaacaggccggtgcctacaagcccaatcggcgtttgttcgactatgcccatgagcagttgggcgtgggcctcgaccaggtggtgcatatttgcgccagcccgcatttggaccacgctgctgcgcgggatatcggttttcggtgtgtgtggattgatcgcggcacagggcgccagttgctggcggattacacgcctgatgcgattttgccgacgctggatcgggtgccagcgttgtttgaatctctgggttggtgaaacctgatgtgggagctggcttgcctgcgaaagcggtgggtcagccagctcatgtatggcctgatacaccgccttcgcgggcaagcccgctcccacagttgattgggttgcagcctgaaaaaatgcggttgaaggtgggagctggcttgcctgcgatagcggtgggtcagttgactcatctatggcctgatacgccgccttcgcaggcaagcccgctcccccagttgactgggttccagcctgaaaaaatgcggttgaatgtgggagctggcttgcctgcgatagcggtgggtcagttgacacatgtatggcctgatacgccgctatcgcgggcaagcccgctcccacagttgactgggttacagcctgaaaaaatacggttgaaggtgggagctggcttgcctgctcccacagttggatggggtacatccacaattttatgggtccaacaccccgccgctgtagctgtcggacaggcgcgtgccggtaaatttggccaccaccgaaccctgggccaccaggcgttcgcggtggccggtgaccatgcggccggtttgtgcggcgtgcaaaatcacttctgaggtggggtcgcccggccttgcgatgatccgggcgaagcgttggccctcctcgacctgatcgcccaggccttgttcaaacaccagcacaccggcgcagggtgcgaggatggtttccatgcagcccatgtccaccacttcaccttgccattcgttgatggccgccacttcatcaatcacgccgttgatgcacagccaggcccataagccatcggcatcctgctgcgccagcgcgtcactgacatccgcctggccgcgcaattcgatcgtcgccgccagctgtggtgagccgtggttgatgatagtttcttcaaaagaaccgtcgccgccgtcatcccagacgatcaccacctccacctgcaacgccgccgccagggccaggccttgttccggccagaagctgcggtggatatagaggtaaggcagggcctcgtcgtcggtgtgcaggtcgagcaccaggtcggcgtcggccgccagttgcaccaggcttttttgccactgcgccaggttgcttgccgggcgttccatggccagggaatgatcgaaggcacggttgaagttctgcccggtggcttcgtggaaacgccccaacaacttgccctggcgaaattggccgataccgaagggattcgcctggggcacgacggtcacggtgcccttgagaaggccctgatcctggcaagcctgcaagcgcggcagcaactggtgcagcaccagcatcccggcgatttcatcggcgtgcacgcccgcttgcaggtgcactttgggcccgctgccgtcgccttcgaagcgccaggcgccgatgtgcagccggttgccggcgtcgcctgctacctgccacgaaaggtcttttgccatgccttgccctcctctgatcatttaattgctagagattgaacacacgttcaactaaccttggcgctctggtctttcatcaaaggcattcccatgagcatcgaccctcccaaactgcgccgtgccgaccccgatgaacgccgggacctgctggttgccgccaccctcacctgcctttcccgcgacggccatgcggggatttccgtgcgcaagatcgcggctgaagccggtgtttccgtgggcttgctcaaccaccatttcggcagcatcgatgcactgatcgccgagacctaccacaagctcgccagtgaattgacgagcgcgctatgggcgcaagtcgagttggccgaaggcgccgccgcacgcctggatgcgtttctcagcgcctcgttttcgccgcgcgtcatggaccccgacctgctcggcgtgtgggtggtgttctggagcctgatccgccattcgccccacgtaaaccagtcccacgaaaacagctaccgcgcctacctggcactgatccagcaactgctcgacgacctcgcacgtagcgaaaacctggtgatccacgacagccacctggcggccatcggcctatcggcgatgcttgacgggctctggctcgaggggtgcctcaaccccggcaccttcagccccgccaacggcttgcacatctgccgctgctgggtacaggggttgcgtcacggcgcattcggcgccgaccacgtcttgtgattcgggatggcgcgcgctgagcatcgccaaggtgccgctgacggcgatcagcaccgcgccgatgatcagcgacacgtccatcgaggtgccccagatcaggctcgacaacagaaacgcccagatcaaaccggtgtattcgaacggcgcaagcaaggtcgccgtagcccgacggaaactcgcaaacaacaggaattggccgataccgcccaccaacccggcggccaacatgcccagccacgcgggtgtcggcgccggtgtgtgagtccagggcaaagtcaccgccatgcagatcacaaagacaacattggtgatcagcatctgttccagcaccgaggtcgtcgggtcgacctggcgcaactggatgtaggtgaacgcccagcacaatgcggcagccagggtcagggcgatgggcagcgggtcgaccatctggctcgggcgacaggcgatcaccacgccgacaaagccgatgatcaacgaaacccattggccccggctggcgcgctccttgagaatcagcgccgccagcaacgtgaccatgatcggcgcggagaaatacagcgtggtcatttccgccagggtcaggtccttggcggcggtgtaatacagcaaccacgccagcaacgacagcaacccgcgaatgatcagcagcttgcggctgaccgaggtccaggcccgacgcagcaggcccatacgcccggcgatcacacacgcgccgactaccaccaggctgcgccagaacagaatgctgaacaccgaataatcggccaccagccacttgatcacagcgtcttgcaacgccaggaacgcataggccagcgagcacagggcaatcccttgcaacgcgcggttctggctcatcccactgacctgcgcagcggcgtgccacgccgttcggcgatggcgtagacgccttcgatcaggaaggtcaggcacaggtagacaccggccaccagcagcaagggttggtagatctgcaaggtctgcgcgcgtaccacgttggccgcgcccagcaggtcgaccacggcgattgtcgaggccaacgcggtggacttgagcagcatcaccgtctcccccgccaacgtcggcaacagcaggcgcatcgcccttggcaagcgcacgcgcagcaacgcctggcgcgcggtcatgccgaacgcggacgcggcttccatttcgcctttgggcaccgccagcaggccaccgcgaatcacttcacccacataggcgcccaccgacagcaccagggcaaacacgatgtaccagtaaccgtcgcgcaaaaacggccaaaggaagctgccgcgcagcatcgggaactgggcaaataaactgcccagcccatagtagaaaatgtagatctggatcagcagcggcgtgccgcgcagcacgctggtgtaggccagcgcactgcgcgccagccatttgcgccgcgacaaccgcgccaaggccaccagcaccgccaaggcaaagcccagcaccgccgagatcgccagcagcgacaaggtggtttgcagccctttggcgatcaaccctgcgtaatagcttatccactcaggcatggcggctcactcgacaaccggcatccagcgacgaatacgtcgctccaggcgcccggacaggtagttggaagccagcgtcaccaggtaatacaaggcagcggccgtgaggtagaacagcaggtattgacgggtggaacccgccgcctgcttggcggtgtacagcagttcattggtgccgaccacgctgatcaaggcgctgtccttgatcaggttgatccacaggttggacatgccggccaaggcgtagggcgccatgatcggcaaggtcacgcggcgaaacaggccaaacccgctcaagccaaatgcgcgcgccgcttcgatctgaccgtggggaatcgccaggatcgccgcgcggaagatctccgacgcataggcgccctgcaccagccccaacaccaggatcgccaccagcgggccgctgatgttcacctgctcgaaccccagccacagcatcagcacattgaggcccatggagcctgcgtagtacagcagcaggatcagcagcagttccggcaccgcgcgaaacaccgtggtgtagccgcgcatcagcagtgcaatcgggcgcggcgcgctgagcttggcgcaggccaccaccaggccgatcagcaaacccaccgcgaacgagccggcagaaatttgcagggtcatccataaccctttgagcagcgcgttgccccatccctggtcgccgaagctgaggaggtcgaacatattattcggtcttctgcgcgatttgcgcgtacgggctgtcgcagattttgctcacatacgccggggtgtcagcgcgtttgcacgggctcactgacaggccgaagtagtgctgggacaagtcgtcaaaatccttgctcaccagcagttcgccgatggccttgtcgaggcgcgccttgagcgcggtgtcttccttgcgcaaacctgcgccgacgccacggccgatgatcgggtcgtagggcacgctggcgatatgcgccaggccgctggcttccggggtcttgaccatcatggcgatggcagtgtcgtcggccatcatgtagtcgatacgcccggcaatcaggtcggcgttggccgattcctgggtgtcgtagtacttaaggtcggcgatgttttcgtagtacttcttcaggtaattggcgctgaccgtcgagatctgcacgccgatcaacttgcccttgaggccttcaggcgtgatgtccactgtcgcgcccttggggcctgccacgcccagcagcgaatcgtagtaggcacggctgaaggcgatctgtttttcacgttcatcggtgactgacatcgaggagaagatcacgtcgatcttcttcgccagcagcgacgggataatgccgtcccacgccacttccttgatctggcattcagctttcatgccttcacacagcttgtgaatcaggtccacttcaaagccggaccactggccgttgccgcccttcacggtaaacggtggatagggttccgccgccactgcaaacacgatgggtttttctgccgcctgagtaaaacctgcggccaacatcaacactgcactgcccaaccacgttgccatgcgtctggatttcatgatttgccccgtctttttttggtgttagcgcgtttgatgggcgttgacgaattgtcggcaacgctcactgcgtgggtcgataaacaccgagtccggcgtgccggtttcctcgatcatgccttggtgcagaaaagccactttggaggacacatcccgggcgaaggccatttcatgggtgaccaggatcatggtgcggccttcttcggccagcgagcggataacgcgcagcacctcgccgaccagttccgggtcgagggctgaggtgggttcgtcgaacagcatgactttggggcgcatggccaaggcgcgggcaattgccacgcgttgttgctggccaccggagagaaacgccgggtattcgttgcgcttggcggcaagacccacgcggtcgagcaaggcttcggcgcgctcgatggcctcggcacggctttcacccagcacctgggtgggtgcttcgatgaggttttccagcacggtgcggtgcggccacaggttgaagttctggaacaccatgcccagggtcgagcggatgcgcaccagttgcttggcgtcggccaccagcggcgcaccggggatggcgtagttcagtttgatgcgctccccatcgacatgaatgctgccctggtcgggcacttcgagcatgttgatgcagcgcagcaaggtgcttttgcccgagccgctggcgccgatcagcgagatcacctcgccttcgtgggcggtcagcgaaatgcccttgagcacctcgatattgccgaaacgcttatgcaggtcggtgacttcaatcatcttcctggcttcgaccggctgctgcacctcgacctttgccgccgctgccacgcgcggttcaccggccagcttggcgacgaaccggctgatgcgttgacaggcctcggccaggcggtcttcgcccagggtgaaggacaagcgcacaaaaccttgcgccggttcaccaaacgcggcggcgtcgagcaccgacacgccggcctcgcgaaacagtcgccaggcgaagtccaacgaacccaaaccagtgtcgcgcacatccaccagcacaaacatgcccgcttgcggcgcctgcaccttgatccccgggcaggcgctgagacccgccaccaccaggtcgcggcggcggcgatagatgtcgcgcatgcccaccgtcacttggtcatgggccagcactgccgccgtggcggcttccatgacaaaaccgggcaagccatagagcatgctcagcaccagcgtttcggcgtgctcgaccatctgcggcgcagcaatgatccaaccgatgcgccagccggtcatggcatgggatttggacaagctaccgatcacgatgcagcgctcggccatgcccggcagcgcggcgaggctgtggtactggccgtcgaacaccaggctttcgtacacctcatcgaccaccacccacaggtcatgggcgatggccaggtcggcaatggcttgcagctcttgcgggttgaggacgacgccagtggggttgttcgggttggagaagaaaatcgcccgggtgcgtggtgtgatggcggcagcgagcaatggtgcatccaggcgaaaccccgactgcggcgaacacggcacgcgtaccagcgtcgcgccactggccttgagcgtggcttcataggtgacgtacatcgggtcgagcaccagcacttcatcaccggcttgcagcaggcacagtgaactgatgaacaaggcgttttgcgcaccgggcacgatgatcacgttgtcggcgttcaacggccgcgacagggtgttgctgtagcgcgcggcgacggcatcgcgcaaggtcgggcggccggggatttcggtgtagtgggtgtcgccgtcgcgcagtgcattgacggcggcgtcggtgataaaggacggcgtggcgaaatccgggtcaccgacgctgaggatgatgatgtcttcgccctggcttgctgcctggaacgccgcgtggtggatgtcccaggcggctacgccctgccctgcaattcgttcaacgaagggggaaaaccgcatgccagagcctctcgttcaagaagaaaaagcgcgaaccgatgtgcgtgcacatgggtggatgcggtcaacatagtgcaaactgaacagtcgttcaatgggtaggtttgggtggtgtcgtttatcgtccaaataggtcgtgaataaccgttggctgtgtcagctcgatcctacagaggtcagtgccggcgagcaggaacagggaagcctatatagtcaagcgcatggagaaaggtccgaaaagtttagagcgagttcatcaattcacagcgatagtcttgcagctcaccggcagagcccaggttcagctcggtgacggccaggtgcgtggccagcagcaccatgctgccatcggcgcggggcgtcatcagcaagctgtaatggctcatggcgtcgccttgggcatccacgtattcacgcaacaccgccaacgggtcgagcgcatcggcgtccgctgccgacagcgtgcgggcactgtaggtgtggcccatcaggcgagtcggcagcacgtgccactgtgcatcgaggctataggctgggttgttgagcacggaaaacacatccgggcgcaggcaggcaatatgcacatgcagctggttctgagagcggccataacgcgagttgatcgccaccgagacgaactgatcgggaatcggctttgccaggccatcggataacacactgcgatggcgccaggcctgggccacgtaatgcggcagcaactggcggccaagggcggggtcttcaatgccggtgattttgtcgaccggaatcagcaggtcatgcaacgggccgttgcggtctttgaacagcgtgtagccacggtccaggtccaccgccaggcacgggctggggctttgctgctgttgctgatggggcacacattgctggctgacgatgtgccacaacgcatcggggttaccgcgccattgccaggcgccaaccagcgcaatcacacaaagcaaaccaccagcgatcttgaatacggaaccgcgtttcatgcaaaacctcaacgtacggggatgtcatttattgttgtcgctgacatccctgtcgcgtgtcccgtctcgcaaatacgatcctcttttgacgagtggctgttgttgtcaggcaaggcgccgagacgactcatagctggctatggggaggagcggcaacgcagcatggcgacaacagacgccgtctaaaaggatcagtttttgtgagacgggacacctggattaacgtttgggcggggccataaattccgggccgattggatcttttatcgtgctggccagaatacggtcgatatgtgtcaggtcatcggcactcaacttccagccgaacgcctcttcataaccgcgcaattgctccggccgacgtgcgccccacagcgcaatcgtcgggccttgatcgagcacccagcgcagcgccaacgccagcaccgacttgccgtggcattcgcgggcatagatatccagcgccgcgacggcggcgaggtattgctcaaagcgcggcgctttgaatttcgggtcgagcccgcgcacgtcatcaccggcaaagcgcgtggccgaatgcatgctgccggtcagcaaaccacggcacaacgggccataggccaacaccaccagggaatgccgcttggcatacggcaggatgttgctgtcgatggcgcgctcaaacaggttgtacggcggctgcaccgtggccaacgcggtgtgacggctgaagtcatccatttgcgcgcaggaataattgctcacacccacggcgaggattttgccctcgcggcgcaggcgctcaagcgtgtcggcggtttcctcctgggccaccaacgggtcgggccagtgcacttggtacaagtcgatgtagtcggtttccagacgctgtaatgaatcttcgacctctttgcgaatacgctgggccgtggcattgcgccgtggggtgccgtcgtcccattgcagcccggctttggtcgcaatcaccgcgctatggcgcacgccgcgcagcgcctggccgatcaactcttcggacaggccaaagccatacaccggcgcggtgtcgatcaggttaataccgcttaacaacgcttggcggagggtccgggtcgattgctcgttatccgcgccaccccacaggtgcccgcccatggaccaagtgccgagggcaatccgcgagatcggcttatcaatcccggctatgcggagggtctcgatactcatgaaaatttccttgtgcgcgcaacaatacgtagaaaagcaattactctagatcatccgaggttgaatagggctcaacgccccgtgcaaccgaactcctataaaagaggcttgaaatggctgcgttaaatcgttccgaattggccgatctgaatgtgttcatggcgatcattcgccgccgcagttttcgccatgccgctcacgagttgggggtgaccacctcggcgttgagccacaccatgcgcaacctggaaacccgtctcggcgtaaagctgctgtaccgcaccagccgcgccgtcgagcccaccgacgcgggcagcctgctcgcagaaaaactcagcctgggctttgcgacgatccaggacggcctcgacacgcttgagctgtaccgcgaagcgccaatcggccgcttgcgcctgaacgtgccacgggatgccgccgtgctgctgttggcgccgatcctcggtgatttcgccaacgcttacccgcaattgcgcctggacttgatcgtcgaagaccacctgatcgacatcattgccgagggctacgacgccggcattcgctatggcgcgaccgtgccccaggacatggtcgcggtgccgctgactggcgcgctgcgctggatcatggtcgcgtcccctgcctacctcgcccggcgcggcacgccgctggcacccaaggacctgctgcaacacgcgtgcatccgcatgtacctgggcgacaagaccacctacaaatgggaactgggcaacggcccacgccagcaacgcatcgacgtgcccggcaacttcagcgcggccgacaccgagaccatcgtcaatgccgcgttgcaaggcgtgggcattgcttactgcctgtccaaccgcgtgcagcaggaactggcggacggccgcctggtggaagtgcttgccgactgggcctgcatcggcgagccactgtgcatgtactacccgagtcggcgccagtcacagccggggctgcgtcagttgatggacatgattcgaatgaaaaccatcggttcgcagttaatcgaaacacattgaaccgtagctcgaaggctgtcctggccgcggtgacacatggattaacgacttaatccgacggttgatggaattaatccgacgctgttgcgaagtaaggaaaaaacgctgctcgccaacccgacgaggcagtatccccaaacgccaagggacagtccttatgagccgtgtttccaatccgattgccgcgcgccctcaattcgctccaccgccacctccccctccgctgctgtccaggcaaaagcgtgacgacgcctccgccccgcaacccgaggtcacgacgcgtgcaggcggggacaatgaattggcaatgcaatacatgattgccttgaacctggccggcaatcgcatgaaagtcgacgacttcgaccacattccgccccactccacattcggccaatggtggaagcagttgcatgatgccttccaatcacccgacgttcagcagtggatccgggccacgggtatcgacacctccacgataaaactcgatccaaaatcaggtcagctctcctactcccttgagcgcaggcttgacccccagcgcaccttgcacacggttggccaggacgacagccagtgggccgccatcagcgggccgatcctgcaggctgcgcgcgtcatcggcacggagttccggtttgcacctccggtcaacagcacggacgtacccgtgccctggtggatcgttgggcatttttatcaggagcctcaaaacctgacgctggccggaatgcaccggcgggccgacgagatcagctcacaacagaacttcaaacccctcgatccaacccgctttgcggatttgatcaagtcgcgcagtgaagatgcactccaggaccagcaagccgttctgggcgacattcgcaaccgataccaggcgggcgaagcgctgcagcgcctggcgacggccttgagcaatggcagcaaggacgtggggcaaatccaggccgaactgcaaaaaaccgtaccgctgtccgccgacggcacctacttcccaaagggcgccggcgaatcaaacgaagtcagcctcacgcaattgttggaggatcatggctgggacatccccaccacccacgaacaggtggtgaacctggcaaatgccctgaccaccgcgccgcccaaggctgccacccatggcgacctgggcggcgcgctgagctggcccgtgccgctcgaccagcaaagccaggaacaactgagagaggctatacgcgcgggtgaactcggcggcatcccgttgacgccgtttaacaacgtgctggactacctgctcaatggcaggccaatcaccacgcaggaacaccgtaatccacgcttgttgatcgacaccttgctcagttcgcccaggggcattgaactgggtaaggcccttgaggccagcttcgcggcgcgctcggttaaaggcagcgccagcgactggctgctggcggccttgaacgtgggcagcaccggcaacgctggcagcgctggcgaagcaacggcgattgagggctatcaactggtttcggttgccaaccacaacaagcacccctcggcggtcttcgaggcgctggcggctcatctggtgtccaacggcacagcccgttccctggacaccgcgcgggtacacgcccatctcatgctcgccagccgcgccccggaatttctggtcaaggacattcccaaggaagtcggggtgggcacccacagctgggtcagcttcaccacggcggttgctcgcatagaggcgaaagcgcctggcgcgaccgctgcaatgagctacgcgcaaatcatgctcgccgccagcactgcaccgatctcggaggacgaacgtcaggttgagtatgccgcccagaaccaggcgatcaaggaatgggcgatcccacatggcatggactacccgacgaccgacaccgccctggccgaggtgcgcaaggaattcgatgcgcagctgcgtgtgctgagcgcagccgccgagacgccggacatcaagatgccgatgaccgatgccatcgccaccgaactcatgaaacaagccttaccgggcgtggaccccaagctcttcgataaaaagtgcatcaggtcaaagccctccaaccgccactttcccggaccttattcgctaaaggacctgtttcgcgatggccgggcactggtgggggcgccacccgactcgaacactgattggggcgtaggccgcggctttttcgagttctttacgggaggcggtatcagcattgcggctgacgggacaccggcggtgtgggtctcatcatcggctgatgtcaacgtcaacgagatgctgcccaaactcaaagacctgcccggaccgcaggagcaatttgatgcggactttgcgaaatacgaagacgccatcaaaaagaccacgtcggcgctgttcaaatacggaatctccaaactgccgctggaagaccagcagcatctgcagttcggcgaaataaccgtgcgcagggaaatcgactacgacaggcctgacttgcctcagcgtactgaaaacggcgtgctgctgttcgagaccaaactcaacatcaacggcaagttgagcgtcatgacgtatgcctacgaccgactgaagggcactttcacgcggcggccgggcaagacctatcaggaaagagtgccaagcgagggttggtacccggccaaaggtaaaaaatacgacctgataaaaccggcaggccaacacccaccggggatcaccgacgaacgcccaggtgctcagggggtgcccaatagcttctccagtgaccgaacccactaccttattgatgccgtcattgaagacatggagctgcctgcggtacgccaatacgccaagggtgcatcaaccttcgagactgaagtcccgacctacaagatcgtaggcgaaattgcgctgaacctgatcccgctcaggtcagccattatcaacttcaaagaaggcaagatcaccgaaggcattgtcgacctggccttcgatgtcttcggctttgtggtcggcctcggcgccgccgccaaggccgcaaaagccctgtctgccggtgcgtccgcgctctccaaggccgcccaggcggtcaagatcatcggtcgggcggcagtgggcgcacttaaccccgttggcggtattgatgatttggcgcggggtgttttccaggccgggggctatgtggtcaataaaacctataagggtgtcaaacaactacgcgccgcctattcgggggtcaatctgcttgagttggcaaaaaaaggcgacgtggcgcagggaacaatcaaagcagccaatggcgcgggcagccgtaaagtcctggcccaacgcgacgaggcgaccggtcagtggtacgactttaatccacgcaccaaaaaatccaccggcaacccgatgaagaacttcgtccccgatgcgcccgtgactacaaacgccaacagtttgcacgccatcgccagtgatgatgtggtgaaaactgccagccagcgatacggcctggcggcaacgggcaggttcaaggtcgggcaggaaactgtcgaggggcctgccgtgatgtatcaaggtaattggcatcaatacgatcccttgaagaaccgcgcctttggcccaccgctgctcgatttcaccccaacccgcgtcgcggtcaatggcgaagtcattaccctggacccccatctaacgggctatgaagccaaatacatcgcctcggacgcgttatcgactcagggcacacagggcaacgtgtacgtgggagcgagtaaaaaggaatatgtaaaggtcgatgggctgctttatgaatccaggttgaaagacggccagcgcgtcatcctccaccccaaaggtgcgggccccgatatacctgtcaaggatctgggcgtatccgggtgggtgccggcggcaagagccgaccagttgctggggggcgcgagcagcgcgccgggacgctgggatttggggcatggcaggtttgcggtgccgatagatgatattcacgaaacgaaaaattcagcgacgcccttctcgcttacgtatgagggcctcaatcataaggtcaccttcgacagcacagccggcgcgtggacggaaacccaatttgtctacggtaccgataaggtacagactcacttttattattggagaacggggaaaggccagtggcaacgcggaacgtttgatgagttttcaaacgccaagaaactggaatcgaaactctacaagctggttaatatttcgacgccactggttttaggtattccgaaagacttaaaacctgtgccaaccaaactgcactatttttgggcaggcaaggaaatcccgcctaagttgatcgagactatggcccacaacgcccgccagacaccggggttcacctccattctgcatgttgacgccgacagccagattatttttcaacagattaaggccaaactgcaaagcgaggtgcctggcatcacggtcgtgaatctgcacgaggacaaggctttcgaaccggtgttgaatagcgagctgtacaggtattaccgccaagggcaagggaaaaacctggcggcggcttcggacgtggcacgttatccgatcatgcataaacatggcggcgcgtatctcgataccgatgatgtcattcaaaacaccatcacttccgatccgatgttggcaggcgcgaacgatatactgctcggcgggccgactacacattgggccaccgacaataatatcttttataacaccagccattttgcaacacgaccgggtaatccactgctgctcgacatcatcgaggggcaacataaacggttcaaagaaaataagacctacttcgcggccaatcgagagtacggcaccgtaggggctgatggtgtaactacctaccctccagcatttcagatttatgagaaaaaaatattcgatactgtaggacccaatttgtttaacgacattctcaagtcgaaaagacccgatatgtacgaagcgggttttgatggggcttacaagaaagtcaagcgcgtaggaaaaaaagtcgagggagtaggcccggttgccgacatcgcaccagagatacttgaggggtacagaagaaatggcattacgcctcctgatcgtctggctaaccgaatacagcagatgaaggagcattacttgccgctccagtaccggttcaacatcaaggtgggctccgagcattcctgggccattacctgatcgaagtacattgaaccaccactcggccgtcgtcctccaacctggatagaccacggccgagtgcaagtacgatgacatttattctatggttggcggtcttgggcgctgtactgctcacgctcgccctcacctcttcctacctgcgctggatgccggtgaccacctcggcggtgtgcctgttgctgggcgtggccattggcccgttgggcgtggacctgttgcacctggatatcaaaggctccgcacgctggatggagcacttgaccgaagtcgcggtgctgttttcgctgtttgtcagcggtttaaaattgcgtttgcccctgcgtcatcgcacctggcgcattgcctatggcatggcgggaccggtgatgctgctgaccattcttggcgtatgcctggcattgcattacctgtttgcgttgtcgtggggcgtgtcgctgttggtcggcgctattcttgcgccgaccgacccggtgctggccgggctggtgcaggtcaacaatgcacaggactacgacgcgctgcgctttggcttgtccggcgaagccggtttgaacgatggcactgcgtttccctttgtgatctttgccctgctgttcatgcagcacggcgggttcgacggcgactggttcggtggctgggtgttgaaaaacctgctgtgggcggtgccggtcgggctgttgaccggctactggatggcccgcggcattgggcgtgtgacgctgtggatgcgcatcaccaacgaagacagcaccttgtcgcccaacgactacctgaccctggccttgattgccctggcctacgtggtggcggaagcgctgggcggttatggctttctgtcggtattcgccgccgggctgggactgcgccaggccgaattcaaatccaccggcaattcgcagacaccgtcggagcacttggcgctgccagtggtcggccatctggaagtggagcctgcgcgcgccctgcaaggtgatgtcagcgagctggccgatacgcaaatcgccgccggggtgatgatgggcgacatgctctcattcggcagtttggtggagcgttcgatggaggtgtttctggtcaccgtgctgggcattgtgctggccagccattgggattggcgagcagtgccggtggcggcgctgctgttttgcgtgattcgccccttcagcgtacttgcgatgccgtggggccgcctgatcgactaccgccagcgcggcttaattggctggttcggcattcgcggcatcggcagcatctactacctgttctacgcgctcaaccacgggctgatcggcaccagcagcgcggtcgcggtcgacctgaccgtgtcagtgatcgccttgagcatcgtcgttcacggcctcagtacccagccgatgctggtgtggtatgaacgacgtgccaaggtgaacgctcagtcctgattttcggtatggccaacatctgccgcgtcatccaagtcgttcagcggcacttctgcatcatccatcaatgagcctgggtcttcgttgcccgggtcattgagttcttcgtcgtcgtcttctgacatgactgtctcctctaaccgccctgggtatcgatatcggcgtcggtttcaggcttggcctccggcgttggcttgaaatccgggctgtagtcgttgtccttggctttagggtctttcgcaggcgttgggtctttgggcgcatcggcggcagtaccgggagccggttcgccgccatcaatggccgggtcgttgcggttgctgacttgcggatcgttacttgtggtcatggttcacctcttcgcagtttttggaaaacacaggctgcgtaaaggtaaggtcctgcgcggggcggtgaagttccaactgtcttatgacaccgggttatcaacttggatgtaaaacgcatacgcgcccagcaatacccagaacaccatgaacagccacggcgcacgcatcgaaaacagcaacgacttgcggtagcccttgtgggacgactcggtctcgcagaacagcggcgaatcgtcgtaggccaggcccattaccggttcgctgcgcagcagttcactctgcttgtagtgccagtggtcgatgatttcgtacgcagcgcggatacccggccaggcgttaagggagctgagcacgccgagagaggccaggaacaccggcacgatcagggtgaagaacttgccccactccgggttcaggttgcccatgccggagacgaaggcgatgaccaggaatgactgcgcggtgaggtaggcgtcggtgcggttggccaggatggtagtttcgtactggatctcgcgacggtagaagtcgagacgatccttgggtgaaccgaagatcttggcgttgtgttcactgtgatctgtcaaggacgcttcgggggtgtcgggggagatgattctgggcacagcggtgctccacacgagttcgaatcttgttagaagaatcagggctgtgtgaagttcaagtttgttcatgcaccattttggaacatgccctgcacctttgtggcgagcgggcaagcttaagcccgaaaccaatgtgggagcgggcttgcccgcgaagaggacggcccagcgaacattaatattgcctgacccaccgccttcgcgggcaagcccgctcccacatttaatcttcgctgctttgagcagttccggcacaggcattgctttatccattcatctgcccggatacaggagcattcgttaccccccgacccagagccgaccccattagaaaataaggaccaggcctgttggcaccctgcgccacgggctcataaaaaaatgcgttttttgcggcagtgccacccaagcaacttgccaatcaagcaatgcaggcactgacaaggtactggaatggctcgatctttctttgatgaaatgaatgacgcagatggcgtgtgccgtgtgcattatcaggatttctcccgctggctggccaatacgccgccggaactgctggcgcaacggcgccgcgaagccgatttgctgttccaccgcgccgggatcaccttcaccctctacggcgatgagcaggacaccgagcgcctgatccccttcgatatcatcccgcgcagcatccccgccagtgaatggagcgtgatcgaacgcggctgtatccagcgcgtcaacgcactgaacatgttcctcgccgacatctaccacgaccagcgcattatcaaggccgggatcattccggcggaccaggtgctgggcaatgagggttaccagaaggcgatggtcggcctggacctgcaccgcgacatctactcgcacatttcgggcgtggacctggtgcgcgacggcgacggcacctactacgtgctcgaagacaacctgcgcacccccagcggcgtgagctacatgctcgaagaccgcaagatgatgatgcgcctgttcccggaagtgttcgccaagcagcgcatcgcgccggtggaccactaccccaacctgctgctcaagaccctgaaaagctccagccgcctggacaaccccaatgtggtggtgctgacgcccgggcgcttcaacagtgcattttttgaacatgcgttcctcgcccgtgaaatgggcgtggagctggtcgaaggcgccgatttattcgtgcacgacctcaaggtgttcatgcgcaccaccgacggccccaagccggtggacgtgatctaccgacgcatcgacgacgccttcctcgaccccaaggccttcaaccccgactcgatgctcggtgtgcctggcctggtggccgcctactgcgccggcaacgtggtgctcgccaacgccatcggcaccggcgtggcggatgacaaatccatctacccgtatgtgccggagatgatccgcttctacctggatgaagaaccgatcctgcaaaacgtgccgaccttccagtgccgtaaaccggatgagctgtcccatgtgctggcgcacctgccggaactggtggtcaaggaaacccagggctccggcggctacggcatgctggtcggcccggcctccaccgctgccgaaatcgaagacttccgccaacgcatcaaggcgcgcccccacgcgtacatcgcccaaccgaccctgagcctgtccacctgccccaccttcgtcgaaaacggcatcgcgccacggcatatcgacctgcgacccttcgtgctctcgggcaaggaaacccggctggtgcccggtggcctgacccgcgtggccttgaaggaaggctcgttgatcgtcaactcgtcgcaaggcggcggaaccaaggacacctgggtggtggagggctgagtatgttgagtagaaccgccgcagatctgtactggatgtcgcgttacctggaacgtgccgagaacctggcgcgcatgcttgaagtcagttattcactgtcgttgatgccccaggccgggcgcagcgatggcctggatgaactggcgatgtcgttgctcagcagcggcacccttgagagttacctagagcgccacaaacaactggatgccgagcgcatgctgcacttttttgcgctcgacgaagaaaacccggccagtatctacaactgcctgcgcgccgcccgtggcaatgcccacgcagtacgcgggcggatcaccgccgacatgtgggaaaacctcaacgccacctggctggaaatgcgcagcatcgccgccggcggcctggcgcgacacggcatcagccatttctgtgactgggtcaagcagcgttcacacctgttccgtggggcaacctccggcaccatcatgcgcaatgacgcctaccggtttatccgcctgggcacctttgtcgagcgcgcggacaacaccttgcgcctgctggatgcgcgctacgagatgttcggcgaagagtcggaagaagtcagcgacttgtcggcacgtggttattaccagtggagcgccctgctccgcgcgctgtcctcattcgaggcctacaccgagctgtacccgaatgcattgaatgcccgctcggtctcggaattgctgctgttgcgcagtgatgtgccgcgttcactgcatgcgtgcattgaggagttgagccatatccttgcggacttgcccggcagttatgggcgcacggcgcagcgcctggcggcggaattcgaggcgcggctgcgttataccgggatcgatgaaatcctcgaagacggcctgcacagccggcttacggactttattgataccgtacgcgaactggcacgcgcgattcatagttcgtacctggaagtggtgtaagttgcagccacttaactgtcagttcgggtgattgaccctgctgcggtgccgctcttatgttgggcaggtcaaacgccttcccaccataagaacaggtacagagcatgtccgaactgacactcacacccgccgccgcacagacgctgcaacgctggcacaacatgctggcggggcgcgatctgtcttccctgcccgaactgctggcacccgacgcggtgttccgctcgcccatggcacacacgccctaccctggcgcgccggtggtgtcgatgattctcaacacggtgatcaaggtgttcgaagactttgaataccatcgcgaactggccacgggcgacgggctcagtgtggtgttggagttcagtgcgcgggtgggtgacaaacagctcaaggggattgacctgattcgctttaatgaattggggcagatcgttgagtttgaagtgatggtgcggccgttgagcgggctgcaggcgttgggcgaggagatggggcggcggttggcgccttatctggcgaaggccaagggttgattgttcccacgctctgcgtgggaatacatcctgtgacgctccgcgtcacgcctttaacagcggacgcggagcgtccagggaggaattcccacgcggagcgtgggaactatcgctggtggggttgattgttcccacgctctgcgtgggaatacatcctgtgacgctccgcgtcacgccttcaacagcggacgcggagcgtccagggggcagttcccacgcggagcgtgggaactatcgcctctatcgcctatcgcctatcgcgggttgggttattggtttttgactaaaaccggctctgcttggtattggttcgggaacagttttttcagctgcgccacctttggcaggtcattgatcacgatgtacgggtacgacgggttctcggtaaggaagtcctggtggtaggactcggccgggtaaaacgtcttgcccatctctactttggtcacgatgggtttatcgaagactttggcggcgtcgagttgcgcgatataggcctgggcgactttttgttgttcggcggtctgcgcgaaaatctccgagcgatattgggtgccgctgtccggcccttggcggttgagttcggtggggttgtgggccaccgaaaaatagatctgcaacagcttgccgtagctgaccttggttgggtcgtacgtcactgatacggactcggcatggccggtatcgccgccgctgaccgactcgtactgagccgtgttggcggcgccgccgtcatagccggacacggcatttttcacgccttgtacatgctggaacacgccttgcacgccccagaagcagccaccggcgaacacggcggtttgcaggttgccggactcggcgggcaggtcgagggcgggtggtgcgatcatgacggcgtcgtcagaggcgccgaaagagaatgcatagctttggccgataaatgcggcgaaggccagtgcgggtagcaatttgagcagtttcataaaactcactccagtgcgcggtcaagtgtgggagctggcttgcctgcgatggcggtttgactgagccagatgagttgggcgacttgccgtcatcgcaggcaagccagctcccacattaattgtgattgttcaggttcagagttcggttaaccgaaggtgaaggcataggccgacacgtgcgggtcgaggaattcgatggtgaaggtgcggtctttcacgccgctgggttggcgcaccagttggtacaagcgctgctcggtgacggtgccgctgccgtccggtgccacgtcggtgccgtgggcatcgccaggggcctggccgtcaatcgttaccttgaaacgcaccggtttgccatccgcgccagggcccagcaccaggtgcaggtcacgggcgtggaagcggtagacgatgcgcccgccggcctggtcgaggctggcttgctggccgccgacgttccactggccttccagggtccagttgttcagcgccaggttgccggctgccgggtaattcaccactttgtccgtgcccagggtgcccgtggtgacgaagttttccgcacgctggaagcccaggtaggtttccggcgattgcacttcgttcatgtccggcgcttgctcgacgcccttggcgtccgcctcgatcaggccaccggcgacatgggtggcgccggcttcacgcagcagttgctgaatcacctgctccgactcggcgtaatcgccttcgccaaagtggtggtagcggatctggcccttggcatcggcaaagtaatgcgccggccagtactggttgttgaacgcgcgccagattttgtagttgttgtcgatggccaccgggtaggtaatgcccaggtccttcatcgccttggtgacgttgcccacgtcgcgctcaaaggcgaattccggggcgtgcacgccaatcaccaccaggccctgatcgtggtatttctcggcccaggctttgacgtaaggcaagctgcgcaggcagttgatgcaggagtaggtccagaaatccaccagcacaaccttgcctttcaagccttcggccgtcagtggtgggctgttgagccactgcaccgcaccctccagcggcggcaacgcgccttcgatcggcaatgcgtcgctgtggttggcagcggccatcattgccccgcccgccatcatcgccccgcctttttgttcaggcttggcgctcagcgtgtcaaccaggctttgttccaggccgccggtggaggctgtcgacaatcgcgacagcacgccggtgtccagccccagggcgatagcggccacaccggccagcatcagcgcgcccaggccacggcgcagccattcaccggcaccgagagactttttcatcaagccaaagactttaccgccgaccagcagcgccaacgccagggacgtcgcagcaccagcggcgtaggccagcaacagcaaggtcgtcccgatgctcgcgccctgcagcgccgcgccggtcagcaccagccccagaatgggcccggcgcacggcgcccagagcaaaccggtagccacgccgatcaggaacgaagcgcccggacgcggtttggcgtcggccccagcggcttcggacaaacgactgccggcggctaccaacgggcgcgtcaggcgctccgagagttgcggcaacaacagcgtgagtccgaacagggcaacgcacagcaacgcgagccaacgcccgtattgattgacttgcaccacccagccgccgcccaccgcagccagtgaggccaccagggcgaatgtcaccgccatccccgctaacagcggcaagccactgcgcataaacggctgcccggtgcgagcgaagacaaaaggcagaacaggcaggatgcacgggctgacaattgtcagcacgccgcccagatacgcgagaaccagaagccacatgggattgacccttattaatgtaaaaagacatcggcttaagccgccgtgaacgtcatggccacgccattcatgcaatagcgcaggccggtaggtgccgggccgtcgtcaaacacgtgcccttggtggccgccgcaacggcggcagtgaatttccttgcgcaccacgccgtaagaagtgtcgacatggctggcgacggcgttgtccagcggctgccagaagctcggccaaccggtgtggctgtcgaacttggtggccgaggaaaacaatggcagcgcacaaccggcgcaggcaaaggtgccggtgcggtgttcatcgttgagcgggctggtgtaggggcgttctgtgccctcctcgcgcagcacgtcgaaccgttcggcgctgagcaggctgcgccattgagcctcggtgtggttgacctcgaaggtttcggcggcctcggcttcagtgaccatgtttatttgttttaacaagccaccggccaggacggcgacacccaggccgccggtggccagtagtatttgtcggcgtgagtacatgtggttttcctcaacgtgtgagcgtttgtggctgatgcgggacctgtgggagcggtgggtcagtcgacataggtataggctgggccgacgccttcgcgggcaagcccgctcccacatttgatctttgctgccttgagcaatgcgttcgtttagctgaacggtgttgaggtcatcctgaggtttgggcggtcgcgaaatcctcacgcagagttaaacaattcgtgataactacagggttgcaaaacccgcacaatgcgcgaactacaagtgaaggtttattgaatggaacagcccaaacgtgtcctggtggtcgaggacgatgcgcacattgccgacttgatctgcctgcacctgcgcgatgagcagtttgaagtggtgcacagcgccgatggcaacgaaggcctgcgcctgctcgaacaaggcggttgggacgcgctgatcctcgacctgatgctgcccggcgtcgacggcctggaaatctgccgccgtgcccgcgccatgacgcgctacacgccgatcatcatcaccagtgcgcgctccagcgagctgcaccgcatcctcggcctggaactgggcgccgatgactacctggccaaaccgttttcgatgccggagctggtggcgcgggtcaaggcactgctgcgccgggtcgatgccatggcgcgcaacctgaagatggacgccggcagcctcgacctcggccagctgttcatcaacccgctgacccgcgacgccaccctgcaaggccagcgcctggatctcacgccacgggagttcgacctgctgtatttcttcgcccgtcagcccggcaaagtcttctcgcgcatggacctgctcaacgccgtgtggggctacagccacgagggttatgaacacaccgtcaacacgcatatcaaccgcctgcgcgccaaggtcgaggctgacccggccaacccggtgctgatccttacggtgtggggccggggctacaagttcgccgagacttcgccatgaaactgaccttgacccagcggctgtcagtggtgttcgccgtgctgctggtgatctgcagcggcacgtcggcctggctgcaggtgcgctccaaccgcatgcatgagctggaagtggtgcaaggcttgtcccgcgacctggctgcgcacattgcccgcgacacccaactgatggacgccgatggcctcaagcccgaggccgtgcgcaacctcttcagccagttgatgctggtcaaccccagcgtcgaagtgtacttgctcgatatcgacggccgcgtggtcgggaatgccgcccccagcgggcatttgctgcgcgatcacgtcgacctcacgcccgtgcggcgcttcctcagcggtgcgatgctgccgatcctcggcgacgacccgcgcagcgtcgatgggcgcaaagtattcagcgcggcgccgctcaaagccaatggccagcaaaccggcttcctctacgtggtgctgctgggcgaagcccacgatgtatacgacgccaaagacgcaacgggcatggcgctcaagatcgccttgtggtccatcggcctggtcgccctgctctgcctgatggccggcttgatcgccttcgcctggatcacccgaccgctgcgccagctcaccgacaaggttggccagttcgatatcaacggcgcgcccaaaccggcgcaaatcaatgccgccgaactcgacagcagcgatgaaatcgccgtgctcgaccatgcttttgtgcaaatggaaaaccgcctcggcgagcaatggcgcgccctcacccaccaggaccaggaacgtcgggaaatggtcgcgaatatttcccatgacctgcgcacgccgctggcgtcgctgcacggttacctggaaacgctgtcactcaaggatgcgagcctcagccccgaggaacgccgccgctacctgggcatcgccctggaccaaagccgcaaagtcggcgggctggcccagtcgctgctggaactggtgcggctggaacatggtttcgtgcaaccggtgatcgaaggtttttcactgccggacctggtgcaagacatcttccagaagttcgaactcaccgccgaagcccgccacatcaccctcaccgccacgttgccgccacaggtgccgacggtgctggccgacctgggcctgattgaacgggtattgaccaacctgctcgacaacgccctgcgtcatacgccggtaaacggtgaagtcgaagtgatcctggcgccagaaacgaatggcgtggccgtcaccgtcagcgacagcggcccgggcatcgatgccgagctgcgtgaaggcctgttcctgcgcgccttcaccatcggcggcgcacgccgcgatggcggcctgggcctgcgcatcgtgcaccgtatcctgcaattgcacgggcgcagcattcagttggtggaccgccccgggcatggcgcgacctttacattctcgctagaaacgcgagcatcagcgcgttgacccgctgggcttgctcgttctggatccagtgaccacagctggccaaaacctgctgttccaggtcgggcactgagtccggcatgcgcttgagggtatgagcttcaaacacgccgaccgggtcgcggtcgccgatcaagaacagcgtgggttgcctcacctgctggcccgccaggaattcagtgcgctgccaattacgttcgaaattgcgataccagttcagcgggccacgaaaaccgtgctcgctgaaggtttgcacgtaaacgtccaagtctgcctgggaacaccagtgcggcaatgcaccgggcgccgagacaccctcgagcaaggtcgcagtggcgggtttcttctgcaggaacacatcctgatcctgcatgaacaaccgcagcgtgcgctcaatatcggcgttcaactcctgctcggcgacgccaggtgcctggaaatacaggatgtagttgaaacgctcggcgtacagctcgcgcatgatgtcgatcactgggcgccgcgcacgcccggcgaacggcacggacatcgtgatcaaacgcgtaatacgcgcaggctccagcaatgcaaggtgccaagccacgacagcgccccagtcatgcccggccatcgtcacctgttcgtggccgaaatggtccatggcttgctggatatcgccgcacaaggtcagcaggtcgtaatcggcgatctcggcgggcgcactcgacgctccgtagccgcgcatttccggcacgaacacccgatacccagcggcagccaaggccgggatttgcgcacgccatgaatgccaacattcaggaaaaccgtgcagcagccagatcggccggccctgttcggggccggcgctgtaaacgctcaattcaatgccgttgacctggatcctgttgtgctggatatcgctcatcactggcttccttgtgactggtggtgtgcaagacgcgctcgcggtattcacgtggcgagcagttcatctgacgtttgaatgtgctgccaaaggcgctgtccgactgataacccaacgcctggccgatactcgacacactgctgtcggaggtcttcaaggcctttatcgccaggtccatgcgccaacgggtcaggtactccaggggcgccatcccaacgcgttgtttgaagtgcaaggcaaacgtggagcgcgactgcctggccaactcggccatctcgctcaaggcccaaggccgcgccggtgccgcgtgcacctgcgcaaacacaggtgccaaccgtgcgtcagtcaacgcggccagccagcttcgagtgctggcgcccaaggaagattgatagagccgcaggatttgcaccagcatcatttgcgccaaatgttcggtcatcaatgccgcgccgagcttggggccggcatattcgagggcgagacgctccaggcaccagcgcaatacaccggcctgctcggaccgggtgttgatgcgcaccaccggcggcaacccatcgagtaataaacgggcatcgtcaccgtaagtaaacagcccgccaatcagaaacagatccaccgtgtcgcccaaactggcgattccgcctacggcgtcttgatagacctcgcaagcctcaatgcccccaagtgccaggttgctggacaatctccacgggcgattgtgtgtcagcaaaaaacagtcgccctcgctcaaggcgattggcaccggttcgccctgcacttccagccaaccattgccttccaccaccgcaccgaacctgatgccccccggcgccggaaaattcaccgcccagttgccaccagccttcagccccgaaaatgacgcgcgctggctgcacagacgagccaccacttcggacagggtatccataataaaaatcaccggacgatcgcgatagaaacaccgactttagtgcccctcgcgtccggctcccaaaaaagaacacaaccaaaagcaacaccacaaaccccgtggcgagcgagcttgctcgcgctggactgcgcagcggtcccaaatgtatgtcagcaagaaacagtcgccctcgctcaaggcgattggcaccggttcgccctgcacttccagccaactattgccttccacaaccgcaccgaacctgatgccccccggcgccggaaaattcaccgcccagttgccgcctgtcttcagccccgaaaacgacgcgcgctggctgctcaaacggcccaccacttcggacagagtatccacaacaaaaatcaccggacgattgcgatagaaacaccgactttagtgcccctcgcgtccggctcccaaaaaagaacacagccaaaagcaacaccccaaaccccgtggcgagcgagcttgctcgcgctggactgcgcagcagtcccaaaaaactgaatgccagcccccccaaaaaaaacataaaactcaattaaccggcacccaccaccgcggcaacaattgccgcacccgcgcctcgccaaatcggtcgtcaatcaacatcaccacgccttcatcctgctggctgcggatcacccggcccgccgcctgcaccactttctgaatacccggatacaagtaggtgtagtcatacccagacccaaaaatcgagcccatccgcaccttcatctgctcattgatcgggttcagttgcggcaacccgagggtggcgataaacgccccgatcaagcgcgcccctggcaaatcaatgccttccccaaacgcgccgcccagcacggcaaagccgatgccctggctatgctgggtgaactggtcgagaaagccttgccgctcggcctcggccatgccgcgcgactgcagccacagcgcaatctgcgggtgccgctcggccaacaactgcgccacttgttgcaagtaatcaaagctcgagaaaaacgccaggtagttgccgggtttctgcgcaaattgtcgggcgatcaagtcgactataggcgccagcgaggcctcgcgatgcacaaaacgagtggagatttcatcgacgatgcgcacgtgcagttgctcagccttgaacggcgactccacatcgatccacgcggtatccgccggcaggccgagcaagtcggcgtaatagtgccgcgggctcaaggtcgcggaaaacagcacgctgctgcgcgcggcggtcaggcggggccggataaattcggcgggcaccacattgcgcagacacagggtggaagtgctgcgcttgccgccgaactggcgcttgctgatatcaaagatgaagtgctcgttgaacagctcggcgaccttggcaaattgcagcgcctcgaaatacaaggcttgcaggtcgccgctcagggcttcggggtgatcgttgaagtaatcgcccatggcactggtgcacaggctcaaggcctgcagcagtttgtcgggcttggttgcataggcctggtacggagcgagctggtccttgtgcagggcgttccattcgcggttgaggcgttgcagaggttttttcagcgactcgggcgcactgtcgcgcacagtcttgaggctgtattggtcgaggctcgcgctgtacatcgaacgggcgcgttccaccaggttatgggcttcgtccaccagcacggcggcgcgccactggtttaattgggcgaggccgaacagcatggcgccaaagtcaaaatagtagttgtagtcagcgaccaccaggtcagcccagcgcgccatttcctggctcaggtaatacgggcaaacgtcatgggccagggccacgtcgcgcagattgcgctggtcgagcaggcgcaccttggaagcggccgtgcgtgcggccggcaggcggtcgtaaaaacccttggccaaagggcaggaatcaccgtggcaggctttgtccaggttttcgcaggccttgtcgcgcgcgaccagttcgagcacccgcagcggcaagtcggggctgctgtcgtagagcacttgggcggcgtccagggcgagcttgcggccgggtgtcttggcggtgagaaaaaacactttgtccagttgctgtggcgccagggccttgagcagcgggaaaatcgtgccgacggtcttgccaatgccggtgggcgcttgagccatcaggcaacggccagtgctgaccgctttgtacaccgattcggccagcgagcgctggccggggcgaaagtcggcatggggaaacgccagcgtctgcgcggcactgttgcgtgcgtcgcgatgctgcatttcctcgcgggcccagccgaggaacagcgcgcattgctggttgaagaacagttccaggtcgggcgcttgaaagcgctggttgagcagggtttcgccttcgccgacgatgtcgaagtacaccagcgccaggtcgatctcgctgaggccgagcttctggcacatcaaccagccatacaccttgacctgtgcccaatgcagttgccggtggttggcgggctgggcgtcgaggtcgccacgataggttttcacttcttccaggcggttgctgtccgggtcgtagccgtctgccctgccccgcaccttgagctgctggtattcaccttccagggcgacttcattctggtaatgcgcgctgcgccgtgaagcgaccgtgcgatgcccgacgataccttcctgagcgcttggcgacggcgtgaatcgcaggtcgaggtcgccgaccttggcggtgaactcgcacagcgcccgcaccgcgacgctgtagctcaagcggtttctgcccagcgtacataacagacggtgaccggcatctggtattcgccacagaactccagccaacgcagctggttgtcttgcaggcgatcgccggggcctttgacctcgatcatgcggtaggttttttgcgcgggccagaactggatcaggtcgggcatgcccgtgcggttggcgcggatgtccagcagcagccgttcaaaccagtagcgcaggtgttcggcgggcaggcaggccagggcttgctcaagcaactcttcgctgagcaggttccagaaaacgaacggcgactggatgccccatttctccacgtagcgttggcggatggtggctttgtaacgctcatctgccagctgttggaaacaggccgcgaacaacggcgcgcggcgctgatggaaatcctcgctgtgcaaatccaccggcccgcgctggaacgggtggaaaaacgatccgggcaatggcgcaaaaatcgcttcccagcacaacaacccgaacagcgaattgatcaggccattctcgacgtaatgcaccggcgcatcgggctcgctcaggtgggcctgcacgcaatactccaccgacatcagcggctcaggaatcgccagtgccaagtccagccgcgtgacgggacgcggcttggttttaggcaacgccggttcgccgagcttgcgccgcaggcgtggcagcacacgcagcatatgctgctgttcggcggcgctttccggggcacgttgtgcggcgcacgccagggccatggcttgcgggtaatcttcctgacgctccagcacgcgaatcagccgtgagcgcgcgccgggataggtgcagtcgcggtagatctgcgcggccaacgccaattcggcgctgcgctcgcaatattggccgatctggaacaacagcttggcgcgacgtttttccagccacgggttgtccgtggtcagcgtcgcgacctgtgccagcacttcgtccagcgcctctgcggcttcaaaggcttgctggcactggtgcaggaacagaaacccgtgcacatcgtcgcgtgtgcgcaagccacgggactcggcgcagaacgcgactttttcataggtgtagatgcccaggtcagccagcacgaactccgaccaatcctggtgcagattgccgaaaaacatcagccgcaggcggtcacacaggtccatcacgctgaggctgtagagcgtatcgccgaggtccgggcaccactgggcaaagctgcgcgcctgcgtgaactgcgccgccagcggctcaagccagtcagccttgttgcctttgggctggtcaatccagggtttgaaggcggcgaggatttcgcctttttgcagcaacgcaaacagcgcctcgaactccaacaggccttggtcatcgacccaaccctgctcgaccagtgccaacgccgccgtacgggtgcaaccgatctcgaggtaattgagtttgctcgcacgaaagtgcacgcccttgcgcatcaccatgcgcaccaaaagtgcctgggacgcttgcggcaacctgtcaaattgctgaatgaaatgctgttcgtccgcatcgagcaaatcggcatagcgctgccccagccaatgcagcacttggcggaagttatgcaggtaatacaagggatcgtcgaggggattggccatgtcgcgcgctgattaaatactggttatgcatacagagtgccgccgcaaagcgcttgttgcaatcggtaatagataaatggcgcacgcaacttttcttataaaagtgatcagatagctctgtgggtggcgtaacatttatggcccgcagcgcctggcgcgggatttttcagggttaaaagtaagggttatgaacatgaagaatttgggtctgccgctggttgcactcacttttctgctattgaccggttgcgcgacgcaaaccgtggtgacactgcaaaatggcacacagtatttgaccaaggacaccccgaacaccaaaacagccgacggcttctatgagttcacggacattgccggcaagcacattcgcgtgaaggccgccgacgtcgcgacggtacgcaacgaaaagtgataacaaaaagccccgcagatgcggggctttttgttgggggggtcagtaccgatagtacgggtggtaatacgggtgatagtagggatggtaatagtacgggtggtagtacggacggtagcagcatgggcccggataggccggatacaccgcacacccgcccaaccccagcagcaccaaggcgcacagcagcaatcgaaatcgggacatgctcagctcctcacatgacgcgcgaaacatctcgcaggcagtcattaaacgtgtgaggcccagccaatccgtcgccgtattgtgccgctgatcgatgaagatttatttaccgaaggttttccagcgctgtggcgtttaaccgataagccgccttcatcttcgaaggcggtagaacggagaaagacggccatggcactcatgtcccggacaattcgcgcgcttgcactcatccccctggccctggcggcattggccagtgcgccggcctttgccgacaccattatcattcgccagccgccacgggtgatcgtggtgcaacagccgccaccaccggtgtattacgggcattggggttacggcccgcgcccctattactacccgcaccacgtctacggttacggttatggctacccccaccgaccgtattggggcggtggctggcgggggcagcactggcattgatcagccgatgctgacgccatcggcccacaggccgccatacccgacgccgaccaacgttaccgagtcagcaccaaaggtgagcaccgtatcggcgccgaccaccttcgcgtggtcacgcaggtcggtgctccccgccacgtccttgaacaccagcttgtcggtgggttgatagccaatcacgcggtcattaccaaagtggccgctgaacagaaaggtgttgtgcccgctgttgtcacggatcgtgtcattgcccttgccgccttcgataaagtcggcgcccttgccgccctggatcaaatcattgccgtcactgccgataatgaacgtgttgcccttgtggggttcggctttgcggttgaggtcctgcacccaagtgttggcccgcgccgggtcggacaggttggcgacgatcaccgtagagtcgcgggtcatctggtcgtagaagccggactcgaggatacgcgtcatgccatcgccatacgccgtgggcaggtgcgacacccaggttggcaggttgacgatggaaaacggcagcacattccacaacgtcgaggcgtagtggtcgttgaagttgacgatattgtcggtggtcgactcgtggggtttgtcatgcacgcccaacgacgacaggttaaaggatgagccgtccagcgcgcggaacaccgggtcgttttcataaccgatattgagcaccttgtcgccggcactctgggtcggcgaggcgtaggccacgtagttggaatccttataaaaccccgcccacttgttggtgctcaagtccgccatgctgttgaccgccaggccgcccaggctgtggccgctgaccaccacgtccttgccggtcaggccatgggcgccggcaaaatcggcgacattcttgagcaaggcgccgaaggcttcaccggcgtaattttttgcgtaatccttggggcccaaagccgcgagcaagtcgctgatcaggtcgccgatggcgtcgctgatcaaggtttcccgtggccccgaggtgccccgaaaaccgatgccgatttcaagcaatttgcccgcgtcatcgtacttgcccagcacctcgacctgcgccgtggtgtagccggctttttcgccgaagaacgtgccgcgtgcgtcaaccttgccgccgtagcccagggcgctggcgctgatgggcgcccacccggctttttgcaccgcttcaagggcggctttttccgagtcggggttccatggaacgcccggaatcaccccttgtgaatccgtgctgccgagcaacgcccccaccaacgtcgccggcaaacccaagcccagcccgttgtgctgataacccacggcaaagccgttatccaggttgtgataggaatacaacgtgatcgccatggcatcggcgaacaacgctttggagccctcggaaccgaggtttttatagtcaaagatacccatggtactgcctctctgttgttgaatttgtcgagaaagcgaaaacacctgtatccacagccctatgcgagagctggtttatgtaggagctggcttgcctgcgatgaccgcctccagcctaacgcagatctaccagcccccccgcgacccaactgtgggagcgggcttgctcgcgaatgcggtgcaccagccacgaaatccgttaactgacacaccgctttcgcgagcaagcccgctcccacataacaccgcgttccacattaagcaggccgcacttgtttagaacgcccagtcaaggctcaaccccaccccgtgcactttctccttgctggccaacaggccgttgtagtcaaaattcacccgtgcatccttgctcaacgccaagctgacccgcgccccgaccagcgccgcatcgcgcaccatcggcgcactttccaccgcgaacgaagggccgcccgaagcaaacgccaggtgctgctcggaatccgtgctgctcaaattgtgctgccagcccaaggtgccagacacctccaactgctggtgatcattcacattaaaggtcttcaacgcacgcacgcccaaggtgctcagcaccacatcgcgagtgtcgtcatgacctttcaacgcagccgcatcacccttctcggtaaacccatcggtgtccaggtgcacgtacgccaggttggcgaacggctccagggccagcggctgcagattgacgcggtacgccgcctcaccgaacacctgcgtgctgttggcgtccactttgaccttctgcttgccggccacatcgccatattgcaggtcgcgcttcacatctgcacggtgccagctataggtcgcgccgccactcaagcgccaggcgccgatctcatgcccggcatacgcgccaaaatggtagctgtccaccgaggcacggctgtgggtgccatcgcccatgttcaacgaggtgtcgctgtaaccggcgaccacaccgatgcgagtcgcatcgtccagcgcgccatccacaccggcgagcatgccaccgacagacgtggtgtagcccgccgtgtcgctgcggctgtcggtcttgccccacgcgcccagcgccttgacccagacgttgccacggctatcgacggtctggctgctcgcgcccatctcgccattgcgcaggcgctcgcccaccgcttcacgcacataccggctgtcattcaccagcgcagtctccagcgccgggtaaatttcgccgctcagttgctggaacgcgccctgagccgaggccgcgtttggcgccagcagcacgctctcatacaccgcattgccggcgcccaattgctcggtcgccgccgccaccgcacgctggtttggcgtggccgccgcactggcgaagctgttggcgctgcgcacaacatccaactgcacgccgttggccgcgtagttcagcgtgccaccgatgaacaggtaatccggcagcaccgaaccgaaactgccggtaatgccaccggcggcttgcaggatgttgtactggcgcccgatcaagctctgcgcttgtgcgctggtcagcagggtcgggctgttttccagcgccagggtcacggtgccgccattcagcgtggccgtgccgcccgcgacaatacggtcgctgctggtcggcgacagctccaccgcgtaggtcgaaccggcgtcgaaggtcacattgccggccacgttcaaggtgccgatggaattacccggcgccacggtgccgccgcttttcgcggtcagcgagccgatctgccccgagccccccactttgccgctttggctgacggtgacgtcggaggtcagcgagccattgatcgccaacaagccttggttgaccaaggtcgggccgctgtaggtgttggtgccggtcagcaccagcgtgccaatgccttgcttggtcaggccgccgtggccggcgatgtcattgctccacacgtcccgcccgcagtgcacgtcggtgcaaatccgttgggtcggtttgccggcgtccaccacggcgccgatgccgggcaggtccgcaacgaattggccgctgccatacgcgccgtcgatacgaaactcagccggaatatcctcggcagtgataaacatgcccggcccgttgacggccttgcccaggttgatcatgccccagccgtacaacgagtcgatgcccggcgcgccaaggtcggtggcggtggttttcagcagcgtcgagacctgctcgccgttcatgtacgggaagcgctccatcagcaccgccgcactgccggccacgtgtggcgcagccatggaggtgccgttgaagttggcgtagtcggtggtgaggttttccaggctggtgccgttgatgatcgagctgtagatcttggtgccgggggccgacacgcaaaaacttgcggcataaccgcagcgcgaagagaaggtgctgatcacatacggatcggggctggcggtgttggggttttgctgcaacgccgccaccgacagccagttcggtgcaatctccggcacaaagtacgccaggcccgaaatcgcatccgggttgttgcggttgtagtcgttacccgcggcaaagatcgtcagcacgccactgcgggccgcgtcgattgcgccttgatacgcgccaccggcaatcgtgccgaggatcggccggatgttattgaactgcgcctgcgcttcattgacggtgaaattcgggaacgccggatcgcggccgcccttggcgtactggtcgccgatgccgatgccccaactgttgttgatgatccgcgcaccgctggcgaccagggcatcccaaccggccttgtacaccgcgccgtcattgccgaggataatcccgtcttccgggcctgggtcaccgttttcggcgctgatgatctgcgcgttgaacgccacgccgtgcatcggcccgccgtcgcggtcgcctgcagcaataccgccgacgtgggtgccgtggttacccagcttgccgttggagcccagggacggcgtgccgtcgtagcgaaacgcatcgccggccttcaccgggatatacgggtcggtgtactggcgaatgccctcggtgacgatcgtcaccaccttgccggggctggcgaattccgggtgctgggcgtacaccggctggtcgaaaatgcccagcttgacgcccttgccggtgtagccggcggcataggcggcgtcggcatgcacagcgcccaggccccaatcggccttgaactcatcgctgcgccaactggcagcgtcgcccaacttgccggtttccacatagggcgcggcctgggcggtccccaggcttgccaggcagcacagcaacgcgccgtatggcacgcagctcaaggccttgagcgggtagcccgggcctgtgtgagtggcggtaattaaccctgacttacgtttgttcacggtgaccttccttagttttcttattgcacttttttggaaatccaaacgatcgttcccacgctccgcgtgggaatgcagccccggacgctctgcgtccaaacctgtgacgcagagcgtcacaagaggcattcccacgcggagcgtgggaacgatcctgttcaactcagaactgccagttcaggctcaaccccacgccctgggtgttctcccgcccacccaactgcccggtgtaatccaggttgacccgcgtgctcgggctcaacgccaaactcgcctgcacgcccaccaacgccgcatcgcgcagcaacggcgcactgcgcacggcaaatgacggcccgcctgctgcaaacgccaaatgttcttcggattcaaccgccgtcaggctgtgctgccagcccaacgagccggacagctccaaccgctgatggtcattgagcggcaaggttttcaacgcccgtacaccgagcgtgccgagcaccgcatcacggcgatcactgccacgttccagcgccgctgcgtcgcctttttcgtggaacgaatcactgtccagatgcacataagccaggttggcgaacggttccagcgccagcggctgcaagcgaatgcggtaagccgcctcggtaaacagctgggccgtgcgcgcgtcgagcttggccttttgtttgccgctgacctcgccgtattgcaggtcacgcttcacatcaccgcgatgccagctgtaggcgccgccgacgctgacgcgccagtcgcccagctcgcgcccggcatacgcaccaaagtggtagctgtcgatggacgccgaggaatgtgtgccgctgcccatgttcaacgcgctgtcgctgtaaccggcgaccacacccacgcgggtctgctcgtccagcgcgccgtcgaccccggccagcagcccgccaatcgaagtcgtcgagcccgccgtttcgctgcggctgtcggtcttgccccatgcgcccagcgccttgagccacaggttgctttcgccgttgaccggcacatggcgcaggcgctcgcccaccgcatcgcgcagttgcaggctgtcgttgatcaacatcgcgccaatcgccgggtagatttcgccggacaactgctgcaaaccttgctgggctgtggcgcgtgaatccgactgcaacaggctttcgtacaccgggttgcccgcgcccagttgctcggcggcagcggcgacattgcgctggttacgcgtggcggcgacgctggcgaacgtggcgtcgttgcgcaccacggctaactgcacgccgttggccgcgtagtcgagggtgccgcccacgaacaggtagtttggcaacacctgaccaaactggccctgaatgccaccggcggcctgcaggatgctgtactggcggccaatcaggctttgcgcctggctttggctgagcaacgtggggctgttttccagcgcgagggtcacggtgccgccgccgagtatggccttgccaccggcgacaatgcggtcgctgctggtgggcgtgagttccaccgcataggtggagccggcgccgaggttcacatcgcccgccacgttcaacgtgccgacggaattgcccggcgcgacgcggccgccgctgttcaccgacaacgccgcgatccgcccggaaccgccgagggtgccgctgtcatttacggtcactgccgaggtcaacgaaccgtttaccgccaacaggccgccgttgaccgtggtcgggccgcgataggtgctgtcgccgctgagcagcaagctgccggcgccggatttgatcaggctgccttcatacacgcggtttgcagcggcttggtcgcgcgcggtgccgaccgcgtagtcggtctggtcctgctggctggcgttggcggccacgccgttttgccagcctttgtcgatcagcgtctgttgccaggcggtgtgctcggcgcggtcttcggccaggcgctgcaacaacgcctggtcggagatgccattgctccacacatcgccctgcccggccgccaggttcacgtccatcgccccgagcaattgccccggcccgtgcattgcccggccaaggtccggcacgccccagccgacgatggcattgggtgcctgggtgatcgagccgtcgagctgcgtggcggtggtcaacagcacctgcaacgcctgcgcgttgttcatgtacgggtagcgctccatcaccagcgccaacgcgcccgtggcatgcggcgctgacatcgaggtgccggatttcaccccataaccgccgccgggcacggtgctgttgatcagcgcgccgggcgtggaaatgcaccagtacttggcgatgccgcacttgttgtatttctggttattcgccttgtccaggcccgacacggccagccaatggccctccagttccggctggaaatacggcagcgccgaacgcacgctggcattcgcgtagccgctattgccggcgctgaacacgttgatcacaccggccttggccacatccgctgccgcatccagccacgtgccctggttgtagtgctgggcgtaggccgcgtgcaggtcgccgagggtctggtagctgacattcggcggctggctgccccaactgttgttgatggcgcgcacaccggaatccaccaacgcgctgtacaccgccttgaagtatttggggtccggcgtcgggccgaacaggaagctgtcgttggcgttggtattgcccacatagacttgcgcgttgtaggccacgccgtgcatgcctacgccgtcgcgggccgcgcccatggtgccggtgacgtgggtgccgtgggaatcgttgttgggattgagcgcaccggtggtgctgaaggggctgccatccacataggtgccggtggcggtcaccgggtgaaaacggtctttggcggcttccgggtgatcggcatcgaacccggagtccaacgcgccgatcttcaccccactgccgctgatgccggcggcgtaggcttcgttcgccttcatgcggtccgggccccagtcgctctggtactcggcggaacgccagctggcgggattacccggttggccggtctcggtgtattgcgcctgtgccgcaacggacaacagcagcaaggagcccgcggtaaacggtttgaagcgcggtgaatcggtgatcatctaaaccatccttattgtttttataagtgctcatttcaccgggccgaaggcctcgtcgactttcgccaggtcggtgtcgcgcaagttgcccgcgtagtagtgcaatttggtccaggccatcaaatagtcgtaacgcgcctgggccaggtcgcggcgggtggtgtacagctgctgctctgcattcagcgcgtcgaggttgacccgctcgccgccgaggatgctttgcttggtcgacaccaccagcgcttcggccgaggtcagggccttttggtacgcgcgcaatttgctcacgcccgacaggcacgcactgaactggcgacgcagctcgatcagggtttcgcgggtcttgccttccagctcgtactcggcctgttccatgccgcggctggcctggcgggtggacgccgaaacgccgccaccggcatacaacggcacgctgatttcaatgccgatggtgttggtgtcgtagcgctggttgtaggtattgccgctgtcggactcctgcttgcgcgagctggcaaacgcggtgaccttgggtaaatgcccggcgcggttgcgttccacttcataacgcgccacttccacggcctggcgctgggacgccagcgtggggttattgctgatcgccagttcatgccaggtgtcgtagttggccggggtcagggtgaaggcggcaaagctttggttcagcggcgccaggtcgttgatgttgacgctctgcacaccgatcaacgcgcccagttcacgcaacgacgcatcctgctcatccagcgcctggatctcttcggcggtggccagctcgtaacgcgattcggcttcgagaatgtcggtgcgcgtgccctcgccttgctggaacaagtgctggttttgctggaactgctgctcgaaggccttcttcttggcgcgggcgatgtcgatctggtcctgggcgaacaacgcctgggtgtaataactcagcacccgcaccagcagcgcctggctcttgtcgcgaaaactttcatcggcaaacaacgactgggccacgcccttgcggtagttggcataggcttcgtagtcgaacaacggctgttgcaggctgaaggtcgagccataactgttgtagttgcggtcatcgcgataggtgccgccgcgcccgtccggcaggtgcgcctcggagttgttgcggcccttgttgtagttgtaagacagcttcggcagcagcccggcgcggccgatggtgcggttttccaggccggcatcgcgctccttgatcgcgccgagaaacaccgggtcgttacgcaacgcttgctcgtagacatcaaacgggcccatggccgcctgggccgacccgcacagcaaacacagagaaaggcacaccgacttcatgctcattcctcggtcaacgcagagccggcgcgatccagcagcggcttgaacaggtaattgagcaacgagcgctcgccagtgcgcacgaacatctcggcgggcatgcccggcttgatcaccaggccatgcagtttctccagcgcggcttcgctgacggtggtgcgcagcacgtagtacggctggccggttttttcatcgagcatctggtcggcggaaatcaggctgacttcgccgggcacacgcggggtgcggctctggttgaaggcggtgaagagaatgtccaccggcaagtgggtgccgaccttgtcgaccaagttcaccggcaaatgcccttccacttccaggcgtgtgccctggggcacgatttccagcagggtttcaccggcacgcaccacggcgccttcggtgtgcacgctgaggttgaccgcaatgccatcggccggcgcgttgatttcgctgtgctgcaggtcgaacccggcggaggtgagttgctgttccagggtcaggctgcgcagttgggcgtcggccaattggctgcgcacttccttttgatattcctcgctgtgctgctgcaacttcaggcgtgactcaaggatgccctgctccacgcggccgctttcgccggtgttctgtgccaggtcctgctgtacctgggacagttggcgctggtaatcgagcaggcggttgcgcgggatatagccgttgtcggccaaaggctgcaggttggccagttgatcgcgcagggattgggcctgggccgacaagtcactgcgcgcgcggcgcatgccattcagttgtgaggtggcgccgtcgatattggcgcgaatccccgcttgttcacgggcaaacgcttcgcggcggctgctgaacaattggcgctggccttccagcaccagcgccagggccgggtcggggttggcgctcagttcggctggaaagacgatgctggaacggttgtcgcgttcgctctgccaacgcgccgcactggcccaggccatgcggtactgggcttgcagcgattgcacatcggcctggttctgggtctggtcgaggcgaaacaacggctggccctgtttgaccagctcgccctccttcaccaggatccggctgaccacgccggggctgaaggtttgcacggccttgcgcttgcccgacaccaccaccgtgccttgcaccgggatgccttggtcgagtggggcgaggctggcccaaaggaaaaagccgccggcgccgacgatggtcagcaaccaactcatttttacgaaaaaaccggcgtcgcgttctttaaagcgtggttcaacggtaaggctgctcatgcgcctggattccttccggcttggtactgacgactgaaactcaccccaggcttttccttgggcgcttcctgctggcctgacaacgcgcgcagcacttcctggctcggcccgaacgcctgcaaacgcccgtcgttgagcaccagcaacttgtcggcctgggccagcgccgaggaccggtgcgtcaccagcaccacgctgctgccctgggccttcatctgcacaatggcactggccagtgccgcttcgccgacggtgtcgaggttggagttgggctcatccagcacgatcaaacgcggcccgccgtacagcgcacgggccagggccacgcgttgtttctggccaccggacaggccgccgccgttgtcgcccagcaccgtgtcgtaaccctgtggcagacgcaggatcagctcgtgcacaccggcttgctgcgcggctttcaccacgagttccgggtcggcgtcgcgaaaacgcgcgatgttgtcggcgatgctgccgctgaacagttcgatgtcctggggcaagtagccgatatgcgggccgaggtcgtcgcggtcccagcggtgaatgtcggcgccgtccaggcgcacggtgccggccagggtgggccacacaccaaccagcacgcgggccagggtggatttacccgaacccgacgcacccagcacgccaagcacttcgccggcgccgaggttgaagctgacttgctgcaaggtcgccattcgccgcccgggcgggcctgcgctgacctgctcgaaactcacctggccgttgggcgccggcaaggccatgggttcgacttccggcgggaattcacgcagcaaatcatcgagccgctgatacgccaacttggccgaactccactgcttccacaccgcaatcaactggtcgatggggctgagcacgcggcccatcaggatggaaccggcgatcatcatcccggcggtcatatcgcccttgatcaccaaaaaggcgcccaggcccagcaccaacgattgcaggcacaggcgcagggatttactcagcgacgtgatcaccgagccggtgtcgctggccttgttctggtaaccgaggaattgcgagtgcaccgcgaaccagcgtttgcgcaacgcgccgagcatgcccatggcctggatcgtttcggcgttgtgcaaatggctggtggccaactgggtggactgctgggaaaacgcgcccgcctcgcccaagggctttttggtcaggtattcattcaggcaggccagcgcgatcagcaacacggcgcctgccgtggccagcacgccgagccacacgttgaagacgaaaatcacgaagaggtagatgggaaaccacggcgcatcgaaaaacgcgaacaacgccggcccggtgatgaattggcggatcacggtgaggtcgcccaacgattgcccggcatgcccctggccgcgctgcaggttgcgttcaaacgcggctttgtacacgcgcaagttgaaacgccgttccaattggctgccgatgcggatcacgataaaactgcgcagcacttccagtgtgccgataaaggcaaagaagcccaccaccatcagcgtcaacatcaccagggtggtttcattctgggaggacaacacgcggtcatacacttgcagcatgtaaatcgacggcaccagcatcaacaggttaatcaatgcggtgaaacagccaatgctgatcaaaatactcttgtattcacccaacgcccggaataagggcgcaaccgcatgggacttcgccatatcgtctgatcttccctgaaacaatttacgcgcaatagttacccgcgccccaaacaagggcggtcaactattaaaatcgagttatatgtttataacttttaattagggtgttcgttgcaggacaacttcggggattgaagacgtctgccctttatattcgccttctttttcgcggttcaaatggataatgccggtgccttcggcgttcatcagccagattccgtccggggtcggcaaccagctccggagtttatcccccaaccatttttccgcgcaggcgacatcaccggccagcgcgttcgcctgttccagcaagtccaacgcgcacacccgatcctgctggtgcaactgccagtgcccggccaattgggcggtgctgggtaaaacttgactgctagccattgcgtgggctcctgccgacatgaacaacacctgtgaagcacaggcgatcagatgagaaaaacgcgccatcttctgctccatcctagaacgcggcgccggagcgccgcgcgctttacatcacgctacgatgtcgctggcaaccgcctggccaacggtggtgacgaggaaatccgccacgccgtgcccggagaagtccacagccaaggtgcccaggttagtgcccgaggcatagctcagcaccgcgtcgccggcatggccggtgaacgcgttgacgaaggtcaggcctgcacctttggtaatgccggacaggtcgatcttgtccgaacccgaggtgaagtcaaagatcttgtcggctgcgcctggcttggaatcggagctggcaccgaacacaaacgtgtcgttgccggcgccgccccacagttggtcagcaccgccaccaccgtagatgatgtcgttgccggcaccgcccttgatgatattggcggcgttgttaccaatgatcaggtcgttgcccgcaccaccgaacgcgttctcgacggtcacgcccttggcgatggacacgttgcccaccaggccgccaacgtcggagaacgagccttcattgaggttgatcttctggttttgggtaaagccggagaagtccagggtgtcattgccgccgccgtcccataccgagaacaccagcttgtcggcattggaggtggcgctgtagaaatcgcgcccggtgttggagttgaaaccgtaggtggtgtcaccggcgcgggtgctgtagttggcaccgtagagcttctggatcgcggcaatgtcgtcgatcagcgggccggaagcataggcctcgacgccgcctttggtgaagttctggttggtgttgctctcgctccagtaactcatgacgctgtagccacgcgtgtcctgtccatagtccgcgtctttgtacgaagggttgccggtcccggcgttgtagtcgccagggtgcgccaggcccagggtgtggccgatttcgtgggtcagggtctgccggccgtagttgttcacgtccggggtcttgttcggcgtgtagctgctgttggtcaggtaccacgacgtgccgtcgtagcctgcgccggtgccgggcaggtaggcgaaggctgctgcgccgtcctggccgccgctgtagttgccgaaggtcatgtgcgtgtcaccgccagacgcgctttcggtaaagctcacgttggcgacatccgcccaggattgcatggccagtacggcctgtgctttctgctgggcgttgaactggctgaacccggagatgccatgtttgttcatggtcgccgaggaagccgaggtcaggaaggtgtaggtcagatcgatcttgccgttgtggttcacatctttgtacgaggcgccatcacgcagcaggtggtccgctgcctgatccaccgtccaggacggtttgccattgaccgtgaggttgccgccacggtcatacagatggctgaagctatcgatttgcgagtaagcagtgctggcttgcgcggcagaaacaatagctttgtcttttacttttgacataaacgtacttccttgtttgcaagtgcatcagtctttggtcgataggaaccccgcgggcgagatcgtcctatcactcgcctcttttgaaggcgtatcgaaactgacacaacttgaaatctttcgtctacaaatatttccgcgatgaaaatgtgacgtggattcaagttaaggaagtcgcgggcagtgtttattggggacaactgcgtttgcgcaaatgcgccggcccgagtgatatttaaatattaaatagcagtaaagccgctcaacttgagcggcgcacttggataatggatccaatatattgtcacggtgtcattggcgacattaaagagccactacttagataattaattagagttgtcccctattacggggacacgctccaaccgcacttgtttagtgcggtcaataaggtctcgtccgccaggccggggaccctgacgccgtcttcggtggtcatgtcctcgccggccagcatggcgttgatgatcgcctcctccaccgcctccgccgctgcgctgaacaacggcgaaatatggtcgttattgagcatctgcaacgcgctgctcagcggcaggttcttgcgcccgtaatcggccggtggcagctcgcggttgccggtggcgaacgccaggaacaggtcgccactggaatcctcggtgccaccgccggtgcgcgcaatgccaatcgaggcgcgttgcgccaggcgctggcactggtgcggcagcaagggcgcgtcggtggcgatgatcaccacaatcgagcccatgcccggcgtgccacgcgcggcgaacggcgaagcaatgcccatcaggtggcggcccaccgggtaaccgtcgacacgcagttcctggcgcttgccgtggttggcctgcaccagcacgccgacggtccagccgccctcctcggtcggcaagcgccgtgacgcggtgccgatgccgcccttgaattcatggcagatcatcccggtgccgccgcccactgcgccttcctgcaccgggccactctcggcgttatccagcgcttggcgtacatgctcaggcttgacgtgctggccccagatatcgttaagcaggccgtcataggtttccatcaccaccggcatgcaccagtacaccgcagggtccgccaggcgctcgcgctccagggcgatcaaggtgtcacgcacaatgccgaggctgtgggtgttggtgatggccacgggcgtagtcagcagcccggcttcactgatccactcaaggccggtggcgtcgccattgccgttgagtacgtgatagccggcaaagcacggctggtggcgcgcctcgcccgcgcgcggctgcaccacggtgacgccggtgcgcacctgtttgccgtcgatacgcgtgttgagcgtactgtggccgaccctaacgcccggaacatcggtgatggcattcaattcgccgggcgtgcccagccccaacgtgatgcccaattgacgtgcacgcatacccactccttacaatttttgatacgccggactcaaccggccactgatgcaatacaaaatcaccgacagcgccagcaagccgatgatgatcatgatgtcgcgcactgacgcagcgtagatcaaggtgaccagcaggtaaccggcgcccagcaccgccaatagcgccggcagcggccacaacggcatgcgatagggatgctcgcggtcacgcagcagcacccggctcatcaatgcgcacaacgccaccgccagatacaccagcatgatcagcaacacgctgaaggacgtgaggtccgccaggttggagctgaaactcagcagcgccgagggaatggccaggaacaaggtcgccagccacggcgaatcccagcgcgggtgaatgcgcgtgaacaacgtgttgatgcgcggcgtccacagcgcatcgcggccgctgctgaacaccacgcggccaatctggatgacgatggcgacaatcgcgttgaacactgagaggaagatccccgcgctgaccagccgcgacagcgtttcattgccgtggctggtgagcaggtagccgatcggatcggggctgctgatcatcgcactcaacgacggcgcgccgatcaacagcgcggtgatgggcaccagttcgatcaccaccaccagccccaacgaccacaacaccgccttgtgcacgcctttgccgccgcacttcatgtcttcggccaacaacacggcaggcccgtaaccgttgtacgagaacaagccgataccgaccgcgccgatcaccaagccccacggcgccaggtgcagcacgccgttttcgacgatctgcggttgaaacagcacgctggccggctgcaccggattgccgaagccgatgcacacaatcaccagcagcgcggcgatttccagcaacaagcacgtgccggtgatccacgcgttgagcttgatattgaggatgcccagcgcgtagctgcacaccacgatgaccagggccacggtttgcgaatcgaaccgggtgccgagggcattgttcaggtaggtcgccgcgccggtggccaacaccggggggataaacagcaacatcaccaaaacggtcaggaacgtggcatacccggccatgccaccaaacacccgcttggcgtacacgtactcgccaccggcactgttgtgcgcacgccccagctccgcgtaacaaaaggcgaacatcaaggcgagcaagccggccatcacaaacgccaggaacacaccactgcccgcttgctggatggcaaacggggcaatcacaaacacggaactggccggcgttaccgcggaaacggtgatggcgaccacatcgaacacgctcagcgtgggtttgagcacgccgtctggcgcgggggaagcactcatatcgttatcctctgtcgttgtttttggtgtgaggcagaaacgaaaggtctgacggttgcgggatatgtttcccactcgatggtcgagaaagtaaacgctgcgtgtagcccggccaattcccctattggcgtactccccttgacggtacgcgccaaaagccgaacccttggccgatattttgagggtgggagcctgtgatatgagcctgttcagagaggtcggcatgcacgcgggcctgggccgcaccgtcgcgcacatcggcaccgagcggttctggaaacaactggtgctgttgctgcaccaatgcctgccgttcgataacgcgctggcgattttctaccctgccgacggcccgccccaggccctggaggaatacgacgcccagcccagcagcaagcccgcctcgatgctggtgtacctcaatggcctgtatttgctcgacccgttttaccaggcttgccgcgagggctatgccagcggcgtgtatcgactggaggaagtcgcgccggaccattttcgccagagtgaatacttcctcaactacttccacgacaacgtgcttgaggacgaggtgcagttcatcctgcaagtgccgggtgtggggactttgtcgttatcgctgggcatgcagcgccgattcagcgttgaggaaaccgggttgatgacgatgctggcagcctgggtgctgccgttgatgcagcagcattggcagcaaagcacccaacgtgcgccggcgatggacagtcagatccgcgatgcgttgagccatttcggcagcggcgtgctctcggagcgcgaactggaagtggcgcgcctggtgctgcgcgggttctcgtccaaagccatggccgagcgcttgaagatctcgccggacaccgtgaaggtgcaccggcgacacctgtacgcaaagctggatattgcctcacagccggagctgttttcgttgtttatccagtcgctggggcatgatctggaaaacccctgattcagcggttatgcagtgcttggacttgttgtggcgagcgggcttatcgtggcgagcgggcttgttgtggcgagcgggcttgccccgcgctggggcgcgaagcggccccagtcagaacaaatgcggtgaatcaggcagttctctgtggcaggttttggggctgcttcgcagcccaacgcggggcaagcccgctcgccacaacaagcccactcacctcaacaggcctgctcaccacagaaagcccactcaccacactgccagctcccagcttattcagcgcccggtacgaatggtgttccacacccgcgtacgaatccggtcgatgttcagcggcatggcctccagtgcaaacaacttgcccatcatttccgggctcgggtacaccttggtgtcggccttgattgccgggtctaccaggctgtcggccgcgctgttgccgttggcgtagtgcacgtagttagtgatgctggccatcacttccgggcgcagcaggtagttcatgaacgcatagccggctttttcgtcaggtgcatcggcgggcatggcgaccatgtcgaaccagatggcggcgccttccttgggaatgttgtagccgatgttcacgccgttcttggcttccttggcgcggctttcggcctgcaggatgtcaccggagaaacccacggccacgcagatgtcgccgttggccaggtcggcggtgtatttcgaggagtggaagtacgccacgtaaggccgcactttcatcagcaggtcttccgccttcttgtagtcctcggcctttttgctgtggtgcggcaggcccaggtagttaagcgctgcgggcagcagttccggaccgttgtcgaggattgccacgccgcacttctgcaacttggccatgttttccggcttgaagatcaggtcccaggaatccaccggcgcgttgtcgccgagcaccgccttgaccttgtcgatgttgtagccgatgccggtgctgccccacaggtacgggaaaccgtgggcgttgcccgggtcgttgttttccagagccttgagcagcaccgggttgaggtttttccagtttggcagctggctcttgtcgagcttcttcagggcgccgccctggatctgccgggccatgaagtggttggacgggaacaccacgtcgtagccggatttgccggtcatcaacttaccgtcgagggtttcgttgctgtcgtacacgtcgtaggtgaaaccgatgccggtttctttctggaaattcttggtggtgtccggcgcaatgtagtccgaccagttgtagatcttcaccgtctcggcggcctggctgatagaggccaccaacatcaagggcaacagggcaatggctttcatggttcgatttcctggcggttttagggctgtttttatggcaggcgatcaaggatcaaagcgttacagaatcaatacgtaggtcttgcgcacggtttcctggatatcccagatgccagtgctgttggccggcaacatcagtgcatcgccggcttgtaggtgaaccacttcaccgttgtcgggggtgaaggtgcagcggccctggataaagtggcaaaactcctgggatttgatctgcctacgccagcgccccggggtgcatgcccagatgccggtttcgacgccatcgctgcgctccacactcaaggtggaggccacggcgatgggctcgcccaagggcacggccaccggtgaggcgtccggcaagtgggcattcagcgtgtctttgaagtgagtgatgctcatgggttttcccgtgtgagtgaaacggcttagtgcatgaaaccttccatgaacccggccacgccggtcgccaacttgcggcgccaaggggcggtgttggggttggccaacacctggtcttcatggacaaaactgcgaatgatcgcgttgtagcccaaccaacggcacggctcgggctcccaggctttgagggcgtccaggccgcgctcgcggatcacccagggctgggtggtgagcggcgtgtcgaggcccagaatcaagtcagccagggtgcgcccgcccaggttggtggcgcctacgccctcgccgccataaccgccggacagcgcgatgccggttttgtggtcgcagagcatgtgcgggcggaaattgcgcgacatgccgaggttgccgccccacgagtgggtaatccgcacgtttttgagctgtgggaagagttcgccaaacaggtagcgacgcagttcgacttcgctgctggtcaggtcgaagttgtggcgcagcttaccggcgaactggtagccgccacgggcaccgaacaccaggcgattgccggcggagcgctggccgtaagtgacctggcggctgctttcgccgaacgcctggccatgctccaggccgatttcagcccaggtgctggcgggcagcggctcggtggcgacaatcaggctttgtaccggcaactgatagcgacccaacggtggcaacgtggtcgcgtagccttccaccgccggcaccacccaagccgcgcgcacacaggctttggcggtgcgcaggctgccggactgccaatgggtgacggggctgttttcatagatcgtcacgcccatgctctccaccacccgcgccaggccgcgcaccagcttggccgggttgatggtcgccacatgcggtgcataaatgccgccataaggcctggcaatgcggatttgttcggccagctgttgtgggctgagccagcggtaatcgtcctcggtcaagccctgggcatggagtttgtcgaggtagcgacgcaggctgccttcctgctcggggtagcgcgcggcgcagtacagcgcgccgcccttgcggtagtcgcaatcaatgccttcgcgggccagcacctgggcgacttcatcgggaataccgtgcagcaggtcaaaggaggcgcggcgttgctgcggcgaaagcccggccagcaagcggtcttcgcccagcaggttgcccatcagccaaccgccgttgcggccggaggcgccgaaacctgcggtctgcgcctcgataatcgcaattttcagctcaggcgcctggcgcttcaggtagtaggcggtccacaggccggtgtaaccggcgccgatgatggccacgttgacgtccaggtcatgctccagggacggccgcgccaccagtgggtcattcagctggtccatccataaactgatactgcgccatgccggcatgccaagctccccaccctcatttcgataggctggatcctagagcgcggcgttatgggctgtcttgcgcgcgtgcacgcagggaaatttgtttgacgtaggccttgggcgattggccggtgtgctggcgaaacgcgctgtagaacgccgacagcgaattgaaaccggcggcgaatgccaggtcatcgacctttatcggcggctgggcgctgtccagcgcggcgagcaaatgctggagcctggcctggttgacgtagcggtagaagctctgccccagcacctggttcagcaggtaggaaatttgattacggctgtagccacactccttggccacccgctgcaggtccagttccgggtccagatacggttgtttaagttggaagtattgctgcaagtcattggccatatgccccaattgctggggcgacaggcccaggcggctgaccgtggggcgcatcgcctgggttggctgctcgtgcaccagcgaggcgtattcgttgactcgccagatcagcccgtcgcgcacggtgatggcttcgctggtgcgaaacgacaccaggccctgaccgccgcgcaaggtgatgcggtactggatgaacgccgtgtcgccgtcggcgcggatgcggtcggtgtgctcgatcgcctcgtcggcgccacgcggcatgctggcttgcaggtattcacgcagttcggcgtagccgatgacgcggttctgaaagaaatcgtggtactggatttcagggtggtagtaggacatcacgccatccaggtcacgatggcgccaacacaagtgatgacgcaagaccagctcgccggtggcttgggtgttctggcaatcatccgctggggcgatggtggtcatgtagggctcgacggcggataaacggctgagagtgccgaattttaacggcgcgttcaatggtcaatgggcacagctaaatagtggcgttttgcctagtttggggtaggacatgacgcacatcaaattaatcgcaaacaactgccgaacgggcgcaaaaaagtctccttggaggcgcgaacgagtgctatttttgaagttcttcgacgccaggaccagtgaaggtcatggccccctgccgcgagctaaaggaagcgctcaatgaacaaggtgggcaacatgaataaagtgacgttccccaacgcctgccagctgatgcgctggcattttcatccgatgggtttcgaggggagcatggacgcccctggcagcatggtcgctcgattgtttgaccgagagagcggtgagacgttgatagccattgccggcattccctgcgcgaccgtgatgaatgcggccgatgtggagcgcattatcgaggcggtggaggatgagttggagtgttttgtgccgtcgctgtcgttgcgggcgtgacgacccatgtgggagctggcttgccggcgatggcatcacctcggtgtgtcagtgatacctgggtgatgcaatcgcaggcaagccagctcccacagaagcccgctcccacatttgatttatgtctatgcactagctgcgctgatcgtcaaaaaacgcctttttcccctctacacgctccgatgccctgggcacattcacgccctggccttcgggtttttccacataccaatagcaatggctcacggctcgggtgatgcccacgtaggccaggcgcagcacctcgtctttttgtgcagaatcatagggctcgctgtcaccgtccttacccaggccggccatacggtaaacctgatttttatacggcgagctggtcacatgctggcaatccccaagcaggaatacggcatccgcctgcaggcctttggcactgtgatacgtcagttgtttcaaccgacgcgccgctggcggcaagctggaatccacattaactacagactgaatatgctcttgaatcagtaacttatcgctactttttcgataaagcattaacaccgaatcgcccttttgatagtgctccaacagccgccgacccagcgcggcgtcatcccgctcaagcaccgtcacaggcaccaaagccttgggctcgccactggccttggcctttttgccggggatcgccggtgcggcccgcacaatatgctcggcagcgtcgatgatgtgctggtggctgcggtagttctcgctcagcatcacgcgggtggtggtcggtgacgggaattcgttgttgaattccatgaagtacttgggcgaactgccgcgccagccgtagatcgactgccagtcgtcgcccacgcacagcaaggacgaacgctgcgcgccacggcccacgtgcatcgccgggccacggctgcgtatttcacgcaggctggcgcgaatccacgagacgatctgcggcgagacgtcctggaactcgtcgatcatcaagtgcgacatcggccgcaacagtgggtcactgagcagtttgaggttttccggggtgttttcgccgaacagcgagaacatgcggttgtaggtcatgatcggcggcgattggtcgagcagatggtcttccagggctttccagaaaatgctcagggcttcaaagaagcaccggtctggatcgtctttggcgaagctcatctggccgacggcggtcggcacgtccaacccaaggttctcgataaacccggcggccatgacaaaactgtccagcagcggggccgaggtcagctcgcctttcaccttgtagtcaaaacccggcccggcagtggcatcaccggcgaggctgcttaaaagacgcttagaggactcataactatccagccatatcaaaggcttacgacagaatgcttgaaacaaggtgcgtttaactgcccactcagcgcgcactgaaagctttgagttgggccgactgatctgggcgttttcccgcgaatcgaaacccagcatcacccaggcgtccagctcgggaatgtagccgtggcaatgaaactgcgcgccattgatttcgaaggtctggcggctgggttcgatacccttgatcggccaggcaccggcgcgaaaccacaagtcttcgatcacatcgcagagttcttcatcgcgcttggcggccaactcagtcacggcgatgcgcttttgcacatccgggtggtcacgttccagctctttgagttgcagaccatggcgcgccaatggcgccatcaattcacggaagcgctcgtgtcggctatgcaactggtggtagcaggtattcatctgttggcgctgggcgtcactaatgcgcaggtcgaacgggttgctgtcggcatcctcgaatccgttgctgaggttttcaaacgcctgcagccgttcaaaccccggcaagctgcgcaccatcggcagaatgcgcgagtggaaggtgcgcaccacggcctgagcttctttagcgccaaggggttgaccccacaggctgagaatttccatgagcttgtggatgaagtccttgcgcgactcgcgggtgaacgtcaccacggtcatcgagctgagctcaaagcccaggtaatgggtgagcagcaggatccgcagcaccagcgaagtcgatttgcccgcgcccgccccggcgatgactgacgtcgagggcgtgtcgctgaaaatcattttccattgcgcggcgctcggctgtgcgtgggccggcagcaagcgcgccacgtcggccttcatgcgcttcttgacctcggcggtgagcggcagacgccagtcgtcgaacaggctgtcgtccacgcccggtgcgcggtgttcatccgggcggaagtcgcgaatcagcaagacctgccgaccctcttcaatgccgtcagccttgccctcgcggtagccatactccacaccggcctcgtgcccactgcgaaaaccgtcggcctggccatgcagccaggagaaccgatgctgcgcacgcaggcgcgtgaggccatggccaaataaacgcgcggccaggcgtttgagcagcggcatttctgccagagggcgaagctcagggggcaaatcaggcgtttgttgcggcacgcggactccagcgatgaggttggttttagcgaaggcgccatggtcgccggaatcggcgcgcagttccagccaattgctttgccgtcatgcagttaagcgatgaagtgaaagtcaaaacgccagcaaccaatcgaattgttagatcggaatcaggcattttttacgctttttatcgatcatgcactgctggatcatggcagcatcaacaggagactctcatgctcgaacttcgacctttcaacaccctgggtggcgcccaccatggttggcttgacgcccatcaccacttttcatttgccgagtaccacgaccccaagcgcatgcactggggcaacctgcgggtatggaacgacgacatcatcgcgccgggcaccggtttcccgcagcacccgcaccgcgacatggaaatcatcacctatgtgcgcgaaggcgccatcagccatgccgacaacctcggcaacaagggccgcaccgaggctggcgatgtgcaggtgatgagcgccggcaccggcattgcccacagtgaatacaacctggaagcgacgccgaccaagatctttcagatctggattattccgaatgaagccggcctgccgccgtcttggggtgccaaaccgtttccaaagggtgaccgtgaagggtttgtgaccttggccagcggcaaagccggcgacaacgaaagcctgcgcattcgcgctgacgcacgcctggtggcggctaatctgaaagctggggaaacggctgagtacccgctggacagcggacgccgcgcctacctggtgccggcgacaggcgtgattgaagtcaatggcttgcgtgcgcaagctcgagacggtgtcgcggttgaggatgagcaggtgttgcgggtaaccgcgattgaggacagcgagatcgtgctggtggatttggcctgatccaaaccccccagcccaaaatgactgtgggagcaggctagcctgctcccacctttactgcagcgagtcagttattcggaaatggcgccgtctaccaacacctgcgcctcttccaccagttgcttgaggtggccttcgccaataaagctctcggcgtagatcttgtagatgtcttcggtacccgatggccgcgcggcaaaccagccgttttcagtcatcaccttcaggccgccgattgcctggttgttgcccggcgcgtggctgaggatttgctggatgctttcgccggccaattgcgtggaagtcacctgctccggcgccaatttgcccagcagggctttctgcgccggggtggccttggcgtcgacacgaatcgcaaacggctcgcccagggcgtcggtcaggccacggtagatctggctcgggtcctggcctttgcgcgaggtcatttctgccgccagcaaggccgggatcaggccgtccttgtcggtgctccataccgtgccgtccttgcgcaggaacgatgcaccggcgctttcttcaccgccaaagcccagcgagccttcgaacaagccatcggcaaaccacttgaagcccaccggcacttcgtacagacgacggccaatacgcgcggcgacgcggtcaatcaggccactgctgaccacggtcttgcccacggccgcatcggcgcgccactgcggacggttctggaacaggtagtcgatggacaccgccaggtaattgttcggcgccagcaggccaccggacggcgtgacgatgccgtggcggtcgtggtccgggtcgcaggcgaaggccacgtcgaaacgttccttcaggccgatcaggccttgcatcgcgtagctggaggacgggtccatacgaatctggccgtcccagtcgacgctcatgaagcggaaggtggaatcgacttcggtgttaaccacgtccaggttcaagcggtagtgctcggcaatcgccgaccagtagcgcacccctgctccgcccaacggatcgacgcccaggcgcaggtcggcgctgcggatggcgtccatgtcgatcacattgaccaggtcagccacgtagctgttgaggtagtcatggcggtgggtggtatcggccttgagtgcctgggcgtgggtgatgcgcttgacgccggcgagcttattggccagcagttcgttggccttggcttcgatccacttggtaacgtgagtgtcagccgggccgccgttgggcgggttgtacttgtagccgccgctttgaggcgggttatgcgacggtgtgatgacaatgccgtcggccaaaccgctggtgcggccacggttgtagcaaatgatcgcgtgggaaatcgccggggtcggcgtgtattcatcgccttcggccagcatcacgtgcacgccgttggcagccagcacttccacggcactggcaccggctggtgtcgacagcgcatgggtatccagaccgacaaacaaagggccattgatgccttgggcttcacggtacaggcaaatggcctggctgatcgcgagcacatgccattcgttgaagctcagctcgaacgagctgccacggtgcccggacgtgccaaaagccacgcgctgggtggagatcgctgcatcaggctggccggtgtaataggccgtgaccagtcgcgggatatccaccagcaactgagctggcgccggcttgcccgcaaaaggactgattgtcatgcataaacctcgaaagaagggtttggagaaaaaacgacagtttactgagagttggactactgcgcgacggtatcgatcctacgcagacaagagaaatttcatgcattcagccgagttgcgcctgccgcagtgcctcacccagtgcagccagggcgatttccaggttcggctgcccgtgaaaggtgtgactcaaacgcacatgctggctgtgcaggcctccgaggctgaagagttcacccggcgccaccaccacttggcgggccagcagatgctggaacacttggcgcatgtccaccgcatggacagagcccagccagaacgtggcgccgccgctgggcatgcgataggtcacttgatcacccaggtggtggtccaggcgctggctcatctcgcctgcttgctcgcgcaatagctggcgcaaggtgttcaggtgctggtcgatttgcccgctgtggtagagccgcgcaatcgcgcgctggcgaatcgaggacaaccgaaacgagcgcaacaggaattgacgctgcaactcgccgctcatgtgccgggacagcaggtagccatacggcgcctctggcccgagtatcttctcgaaacaggaaaacaccaccagacggtcggggttgaccaggtcgcgcagcgcggcctgttgcggctggaaacccagctcgctgtaggtgtcgttttccagcaaccaacacccgtattgttcaagcaaccgcgcgacttccaggcgttcgaaaggctgcatggcaacccccgagggcaggctgaccgctgatgagagcaacaccagctgcacggtttcctcgatcagcgtgccttcgagcgccggcaggtccaggcggccatcgggcgcccatggcaactcgatgatgcgcacccccgcgtcctgcagcaggcgcaggatcagccagtcgcagggagactcgacaattaccgtggagccgcgcaaacccagcacctcaatcagaatgtcgagcacgcctcgcaggtcggcgccgatgtacacgtcgtcggcgtgccagcagcggctgggcgaagaggtgtaccgcgccgccaacgccgcacgcagctcccaaaccccgcagggctgggaccacgattgcaagtggcgcggatgctggcgcaccagctcgcgctcgaggcgcagcaacgttgcgtccagcgaggccagcagcgcgggctcatcggcgctgagcaccaccatgccagggcggcgggcggcgacgtaaaggcgctcgagcagatctccgctgggcaacgtcgaagggctgccggagagtggccaggcgtaatagccggacttggccaccgaatacacccggccttctttttccaacagtgagtaggcgtactggatggtggagatcgatacattcaggcgttgggatagctggcgcaaagacggcagtttcacccgcgtatcggtactgacctcgttgatcaagttaatcatgtagcggtagaccgcctgataggcgaaatccgcctgccgctcaccacgcagcgtcatcgcccggacagctggaaggccagatcgccgtcggccatagaccgctcgtgacgcccgtaatgggcacggccgcccggcacgagcgtcatcggccgtttgcggtacaggtgctgcagcaatggcagcggcaccccgctggtgtcggcgacccattgttgcaacatctcggcggccggcttgccctgcagcaccttgtgcagttcaggcagagccaccaacatgccggggtggcactggcgcaggtaaccttccaggcgttcaccgtgatgaatgaacggtgaaaacaacaggcagatcagttggccttcatccaggccgaagaactgctcggcaaggttgctcgacaaggcacgcccttcgcggctgacggcctgggctatcagcgcgtcgggaatctgccggcgacgcaggtactccgccgcctgccgcaagaaaccttccaccccttcctggtaatccaactcgcgcaggcactcggcctgcaggccgcgcaggtgcgccatcaacaatggattggcgaaggttgggtgactgaaatgaaagcccagcgggtccggcgtataggccatgaactcgctgagcacaggcgcacagccacggtcggtgccctcaagcaagtcagcaacgccgatatacgccaagtggcggtgcccaccggcgctggcgtcggcctttggcacatagtgctcgccaaacagatcgcggtagaaatcgtcgctccattcgtccatacggcggaacaacccggtgagcgatgcaggcttgcccgtgggcgccttgtcttccttggcctgcgcggattttttcaaccaggcgagcaactgcccctgcttgcgcgcggaatcgccgctgaccaacgcgtgcaccccgccatcccaggcggtaacacgctggtagaaatcacccaatgccaggtaggtgtcattgcacagcgttgcgcgcacatcgccggcggtcaggtgcccgatcatcacccgctggcgctggctggattcacgccctggcgtcgataccgggcgctggtagttaaagggcaacacctgttgattttccaccatcagcagctcaacccggtcgtcgtcgtggaaaaacaatcggctgtaaccacgatggatggtgtcgagggtctcctgtgtcatgcccacgtggcgcagcgtagcgacccgcagctggaacgtcctgggcgctcgcccggcgatacttaattgggcggcacgcaacagcgccagggtataggtgctgacttccccgccgccgtgggccaccagcaccttgtaatcgcctatctgttccatgccacccgccgccacgacaatacgctggatcaacaattgaagtgcggtgcgttccgcgcgcgtgaaatacccaatcaaccgttgctgaacttgttgataaacataattcatcgcctgttcgtgaatagcgctcatagttctactacctgagttgaaatatcagtttcaaacaactaccgagcgtagttgctcgatctattgcatctgtaagaatgttgcccgcctgccgtgctcgcgaagcacgaacactagcaccctgcaacaaatcgacataagcggcgcacccggccgtccgtggagtgttccgacgggctaatgcctctacgccgaggagtgtggcgcctttcgcgacaaccctaggaagattccgacagcttcctacagcgctttaacccgaaattaaaagatttgcctgacaaatataatttgccaaatgttgatcctcgcttgcgcgctgtttgaaagctgccctgaaaatacccgcatcctcgggcgggggcagaggctgcactattagttgcagaaagtgcctgctgcagtatcaataaatcattcattactcagtccttgagttcaaagtgaagactcaattatcagggctggaattatgattaacagatacagaacttgtagaaaaaccagctcagatgatcatccggcgaaaggcggataacgcagacacaacaacgccgcactgagtttcagggcggcgccggggagaaaggtatcgtttacaggaccgagcggcccgttatcgcgtcgggcaaggcgcaggttaagccctgtcaaatggcgcatttgccccatgcgccaagggtttggaacactcgtttgcgaatattcctacatatcaaacagcttcaacctgcaatgcaacgcgctcgcggcacgggcattcatccatataacggtgcgcttccacgaactggttgaacggaaacaccgtcgttttcagcggcaccagcacgcgatcagccgtcaactggttgatatcacgcaaggcacgctgcaacgcgacctgatcctgaatgatgcccagctccggcttaccggtgaagttgccgatgcagtgcacaaagaactgaatgttcttctggaacgccgcgcaggccgggaatggcgtctggttgccaccttgcaggccgtaaagtaccaggctgccacgcggcgccagcacatcgccgagcaacgacatctgcgggccacccaagccatcgaacaccacatctacgccgcggttgtcggtgaacttgttgatctgcataagcaggtcctgctcttcggtgacaatcaccttttccgccccgagggacagcaggtactcacgctcggcactgtccttggtggcagcaatcacccgcacacccaaggccttgcccagttgtacaaacgaggggccggcgcagtggctggcgtcggtgaccaaggcaaattgcccaggcttgacccgtgccaggtccacataggcaaagtaggcaatcagcagcggcgtgtagtgcacgctggcttcaatcgggctcaagacatccgggtagcgggtcaaggccgaacggggcaggacgatctgttcgccatacaccgggtaatcattggggctttcggccggaaaactggccactttatcgcccactgccaagtcatccacgccgtcgccgagggcaaccactaccccggccatctcatggccaaggccggacggcagacgtgcatgggaagacgccaggttctggcgccacaaaatgtcataccagctgatgccaatcgcgtcgacacgcacctgcacttcgcccggtgcgggctgcgcggctacatgctcttcgcacttgagcacctcggccggaccaaacttgtgaaaacggatcgtgcgggacatcgcaaacctcgtcaaagtaacctctaatgccatgaactctatctgggctttccgggtaaggccaccggtcgccgttaatagtcgacatgcctgtcattgattccgcaactgagcaattgacctcagcgcgtgtagaaaaactcaattgggccgtaggaaaactcaattagccggtgcagagtaccagcctttgcccgtaagattcatgccggtcatgcttctaaatggaaccttagggctcttgtatgaccgctctcgtcaagcaagctgactcttccaggacacaagatgaaccgtaacgacctgcgtcgtgtcgacctgaacctcttgatcgtattcgaaaccttgatgcatgagcgcagcgtgacccgtgccgccgagaagctgtttctcggccagccggccatcagcgcggccctgtcgcgcctgcgtggtctgttcgacgacccgctgtttgtgcgcaccgggcgcagcatggagccctcggcacgcgcggtggaaatcttcgccctactctctccggccctggattcgatttccaccgccgtcagccgcgccgccgaattcgacccggccaccagcacggccgtgttccgtatcggcctctccgacgacgtcgaattcgccctgctgccccaactgctcaaacgcctgcgcgccgaagcccctggcattgtgctggtggtgcgccgcgtcaactacatcctgatgccgggcctgctggcctccggcgagatctccatcggcgtcagctacaccgccgacctgccggccaacgccaagcgcaaggtactgcggcgcagcctgccgaaactgctgcgcgccgacagcgtgcccggctcgctgagcctggacgacttctgctcacgcccccacgcgctggtgtcattcgccggcgacttgagtgggtttatcgatgaagagctggaaaagctcgatcgcaaacgccacgtggtcttggccgtaccgcaattcaacgggctgggaactttgctggcgggcactgacatcctcgcaaccgtaccggattatgcggctgaggcgctgacgtctgcaggtggtttgcgggcagaagacccgccactgccggtgcgctcgtttgaattgcacatggcgtggcgtgggtcgcaggataatgatccgggggaacggtggttgcggtcgcggattcagatgttttttggggaccctgagagtctctaggggccggatggcgggctgtttatccgatcacttctgccttttcaaggaccatggagatccatccacctccagtgcattgctacattgggggcatatctgagggcatgctttggatggtttaaaaaggatgcccccagcctgaggccaagcaggctattgatgagggtgaatggactgaagaagatatgagccctcagccctaccccgtatcaatggtcgagtcgtagtgagcgcgccactagccgcactgaacaaatgcgtgcgaatgtaaaaaaatatgacggcataatgcctcgtcaatgccccctcctccgccccatgcaaggaatgccggtgaaacgcatccaacgagatttcgtaaccctcttcaactgcctctggtatcgcgactttcccgtgacagaggagcactccatggccaaccctgccaactggactattcatatcggcctggtggtcaggcaatgcgcgaccctgctcggcgctcgcgcactgttcgagcaaggcggccgtaccgatgcagtcatacgttttccggaacaaaccctggcctatgtggaatgggaatggaaacgcgcccataccgatattaatgagttcgaaaagctgctgaaacgcgccgatgatgcagtgtttcagaccttcatcggctacaccagggtcaatgaactgcagatggcgctggagcgcatacacggcgtttgggaacacgcggacaagccattgctggtatttctcgtgacctatgaatggcacgggcgcagtcgctatttcaaggaactgaaaacctacgaattcgccaggggccgctacaagcacgttcgcagccagccagcattgccctggctggtcaaccgcaagacctacaacaacgtcggcgaggatgcttgaaggtgaacaacgtccaagccctgaagctggtcgatgcggtgttcgccgacattctactggcacgctctgccgatgatttttcggccatcgtctcccagcgccccgaccttcatgtcaatcgactggaccgtaaggactacccggaactgcggctctcgatcaacagcgatgagattgccaccctggtagccgacgggctgctgaccgacgagggcgagctccacccccgaatcagcgccaggacgctgtcaccgctggaaaagctgctctattccgtcgcctggaagaacggcgacctgccgaaggtgacgcacatcgtcgaaggagtgcgcggcgtccatgccgacactgcacggaaaaacggcccgggacaggtgttccatcagtttggccgccaccttgccgacaagcgcgagcccatcatcgaccagcatgtcctgcgtgctttcctgctatggcgcgccgatcgcaacgacgaaaaaaagatggactccatccgccggatcacgttgctcaacaaccaggtctctgggatcaacgattacaagagctggctgaaaaccgaatgcttcgacccgcaactgaaagagtcagcggattacctgatgcacatcgacagcacgctgttcgccctaggcaaaaccatcaagctgggaaacacctcgatgcggtggtcgcgcaggtagtccgccatcccgcctagcactataggcaaatgggtatctttatgactaacagcaacggcaagggtggcggcgaagtgcttggtcaagagcggcgccggcgctggagccccgagcagaagctgccatggtgcaagagcctggagcctgggcagagcgtctcggtagccgccaggcgcaacggtatcaatgccaaccagcttttcctgtggagcaagctttaccagaaggcagcttgtcggcagtcagcgccggtgaagccgtcctttaggcctctgagctgaactatgcgctaaagcaaatccttgagctgcggccgtctgtgctggctatctacctattcatgccacggtcagtcttgcccaagcaggtagggcaattccgcatcagcgccacatcatgcagaagaaagcgcccgtaccgggcgctcgacgtggctgtttgccaacaaccaacggtctacaacgaccatacctccgaaactgcgtggactgccgtacattttcctctaatttaataccacaccgaagaggtcagttgcttcaccagcaacagaacacgtcaaataaaattatttacaatgagaggcataaaaatctcatctgaattttcttctagattctcaccaacacgacaatccacagttgtatatatcgacgcatttgtaaacctgacgcaagaccttccttcggattttcgctcaaggagagttttcattgcgtctgcgggcaatttagctttcaactgagcaagggcgctcagcccgaaatctagcgaaacaacatagctgtcaccaccaggcaacgcagtactacttccagttgtgaacatattgccatcaagctgggcaatgaaacttatgggaacatctgggaagattagatgctcgaccttatgaaagccaagcctcttgagatgtaggccaaggtcctttgccaacttaaactcataattcaatgagttttctggacccaaaatcctcttcagctcatctagatactgaggcaacagagccattgcaagatgcaatatagggtccggcttacttacattaaaaagcacaaactcccggccattacacaatgcgaacattggcacacgaatctcactatgaatagcataagaataagcctgttcaacgtgagcccctgaagtgatattttcgcccggcgcctttgcttcaagaagccatgaatacctaccacttacttcaaaaaggtaatctgggatacaggtaatcttttttcgagagctaccaatcgatacgaacggatgaacaagcggcttactacgaacaattttatatggcttactagctgaataccctaggcacttcaatataggaagaataatttcctctctaacagagtcctccttgaaatctggatcatcaagctcctccaatttaaaatctttgatcggattaaaactctcctcaattctcatcgagcctccaaatttcagccattaaaaaatagtcataactcagacatttaatggagcgcagagtgccgaatgacgaagcttttgtcgtcaaccccttacgcttactttcaaaaaacaccatcaaataatttattctaactggcaatttcgccatacgtcccttgccacctaaaccaattattctctcgagtgtttagccgcactaatctcatcgaacccggatagcaagcgcacatgcaggcttgaactccatagccttctttaactccccagattgcaattgacgtgaagcctctccactgcaagacggtagcaaccttactttaaccattggtgataactctcacatccgagccggatacgctcttaatgtacgagtaactggtgccgagcacagctagctgatcagcggagattttggctgccgagatggctggttggacgatcacaaaacggaaaatcatctcgtgatcgtggcacttattgcgcagcagctctaaatcgacgggttcgcccttgaggatcctgtcaaacccttttgacaacgagtactgatagcgctccagcaatcggttaaagaacttttcttcggtgtgcagccacttcacggagcgtgatgcctgaccgcagacctcgtagacgtcggacactcgggcgcccggttgattcgcgccaggacagtacttgcagtggtacaggtcgacaaagatggcatccttgctttccttgatcgccaccaaatcggcgatctcgccggcgccatcatcgttgaaaatgaacgtgtaatcgttctcgattttgctataagtgaacccctgaactgtgtccgggttgcgttccgccctcatcgactcgctgtggatctgggttgtgccccagtcccacggttcgatcaaggcgaccggcagctttaggtccaaactgttgggggagtagtagcggtagttgccttcgaccatcgaaccatcgacggccagcagtaccagcgggttgctatccaggtactgctcgaacgagctctcttcagcggagacgatcttgacccctgggcaggaaaatttgtaggcgtcatccaacagtcggatcgtgatatccggtaattgacgcgccgtaccatcgactgccgttgcgctgatgggcacttgcagggtcaatgcatctactcgctgaggcttgcccaattccacatccagcaagttgaacacctcagccacgtacgccagcgaaatcttctgctcattttcaatcaggatcgacgccggccaatcggcatagaacaaccccgtcggccacgccccctcaatcttttccgagcgaattacatccttgagtatttcggacgggttgatcgtcgcgtcgttgagcttgtgcgaggcacgcttgcaccactcgatccagtcgttgatgctggaagcgttcatctcccagatcttgcccttgtgcgaacagccaacggtagtgcgctggccatcttcgtagccggtggcgaagatgttggactttctcgccgtgccgttctcgatttcactgatgacggtattgatgtcgcgcccaacatgcatggtgaaacgcagatccttgcgcatgcgcgaaaggcccacgttttgcagcttcatgagtttaatgccgtgtagggtgcggaaggtcggctcgccgctgatgcgccgggaatccttggcgatcaggctcaggaaacggttcgcttgcgactcatccccggaagaatggacgaacagcgtcttgtcggactcatggtagtacgccaggtagaggatccagttggtgtccatgatcgtcgacgtctgcgcccagccgacgggcgtttcgcgccgcgtcaccatgatgatggtgtcggcctcgtcgttgatggacaggagctgcagcgactctttcttctgcgagaagtgcttggccttctcaggtcgccagtcgtcaagctccacgtggtaggcgaccgcactgatcttggggttggggttcaagccgaaaatgtcctcggcatcggcatcctcaggaaactgttcggtgaatgtctccttttcgatctcgcgggcgattttgtcctggctgacatcgcgaatcaccgcactccagtcggcactttccttgtacagcaccgccatctggtaatcgactttctggttggcgatattggagacgaacttggcgtcaccgagcgtatcatcgactcgtgttagacgaccgataaactgcagggtaacggcgggactgcggtgctggtcgtggatggccgcaatcttcagctccggcaagtcgaagccttcgcccagcatgtccacacagacgatgatcttgtatttcttctcgacgatttcacccagtagcctagcccggttcggcactttgctgtggataaggatgggcgaaagatcctcatgctgcttatacagctcaaacagtgcggcggcacgtttttgcgaccgggcacgtaccatcagcaggtggttgaacccctgcgcgcggtcgtctcgcaacagctcgaccgccttgtcagccaccacctggtcggccagttccaggttgtactcgcgcaccggatggaactcgatcgccttgaagtagccatcgatctgggcatccttcagcgggtagttgtagatgatcttgccatccaacggctggttgtcctcccggaacggagtggcggtgaattgcaggcagggcttgtctttgaacgcagttttcaccctgtcccaggtcagggcggccacatgatgcgcttcatcgatgatcaggtgactgcacaacgccgccaaggcctccaaggccggttggtcgaatcgctgtagcgcttgcggcgtggcgacgatcacattggcatcagccagctgttggacctcttcagcggccagacctgagccgatagcccgcaccaccgggttgagtgcggtagccgaaacggcgccgatctcccgcaacttcttcagttcatggcatttgtcggccagttgggaacgcaacgcgtcagagggcaccagcacaagggtcctggccaatcgcccggcgaccagcaacccgagcatggtgtcggttttgccagtgccggtcggcattacgattgttgcggtcgtggtgggggccatcaccaagtgccccagggcggcatacagcgcagccagttgcggcttgcgcaaacccggcgtctgggtttcccgcacatccagattgaaattgaacagatgctgctgccaactgcgatagacgtctgcgtacttccctgcttcaacggccattacgggtacccgattggaggatgaggatcagcctgcctagctaatggctacatgctaccagcgaagagctggcgtggtgtaggcctgccagacaccaatcccctgccctagctaaccaatcatccggctatcccttatgcatcccagcctgcagtacactgaaagccatcaacgaccaccttgctccgcttcagaaatcgccaatgctgatcgtctgcgcacccgtcgcgactgggggcaaaattgggggcacagcttcaaaattccatcctgaaactaccgccctagagccaagtaaaaatgttttttggggcccctgatagcctttgattaaactccactaaaatcggcgattgcagagcctgagtacaacacggctactggactgaagtgggcggatcgtgccgcatagccatagtgatctcggtgtgtcgcgccatctcccggcccaggtcgtaggtcatgctcttgcgcattgccagcatcttcgtgcccccttgccagctgtttcaggtcaggctctgacgcgcggatttagaatcgtccagcagccactcacccaagcgctccttggccaaggtcgattttttaccgacccagatcaccacgccatccggcctgacgatgactccctcgccagcggacaagctgttattgtgcgaatcctcgctgatagatgccgtttgcaaccccggaaaatcacgtcgaagatcggcggccagtgctttggcacgatgatgtaccaggacaaaccgccctgctcgcagcaactgggtcaagctctgtcgtggtaatcgctcaccctcggggagcaggctcaacaggggtaaacgtcggcccaccaagcgatgatcgcctcggcgccgcacactgtcatagcgcacgccctctcccgccagtgcactgaccaccttctgcgccacatacggggcccgtgtcgcctgcaagccgatccagtgaatcagacggcctatagggccggaagccgtattgaatcggaaaagcagatccgtgttgcgcaaggctgccgccgcaataggcctacgctcggcctcgtaactctccagaagatccatcggcaatgtggcctggatcacacccgccagcttccaggcgaggttcgccgcgtcaccgatccccatctgcaaaccttgccccccggcggggacgtgggtgtgagcagcatctcccagcagaaataccctcccctggcgataatgagtcgccaggcgctgctggctgcggtaacgagcgctccacagcacctgcaccaatccgaaatcggttcccagaatatctttcatccctccggctatttcctcgtgggtgaccggctgtttgaccggagtatccatacgttcgttgtcttcgatactgacgcgataactgccatcgggtaatggaaacagggcaaccagccccctggagaccgaccttgcatggactgcaggtgaaggcggatttctcaagacaacgtccgccaccaccaacgaatgcttgtagtcctgcccgacaaacgaaatattgaggagttggcggacagaactgttgaccccatcagcccccagcacccagtcgtagcggctttgctgcacgctgccggtctcgctgtgttccagggttacctcaacgtgtaaatcgccggcatccagagcctttagcgcatacccacgcttcagattcacccccttgcgattgacccaatcagtcaacaccgactcggtctgagactgtgggatgatcaccatgtggggatactcacaagggagtttggaaaatgagagcgttcggcccgccttgtcacccaacggcgcgcttgcccagacgatcccccgacgtatcatctcatctgccacgccccaggcattgagcaactccagggtcacgggctccaagccaaaggcccgggaatggggagaggcagccggtcttttatcgatgagatcaaccgctatacccaactcggccagagctgcagccacagccaacccgacgggccccgcccccacgaccaggacctgtttatttttaacgaccatgatcacccacctctccacagcaggggcggaacgtggcgacaatgacgtgctggtcggtgacgctcgtttccatgctctgcagcccggccgtttgcgcgagctggattacctcatgctctgatcgataatctgccagtgagcccagcagccagttgatcaatgtggtcaatccccagcccgcaggcaggttctccaccaggcagaaaaggccctgaggcttgagcacgcgacggacctcattcaggctgacagacttgtcagcccaatggccgaacgacatcgagcacaccaccagatccatgctttgcgaggggaatggcaaggcttcggcaactcctttgacgaacgaggcgaagggacgtcgtttggcggcctcgtcgaccatgccctgagccgggtcgacgccttcgaagcgcgcctcaggccacagagcgaacatgcgttcgatcaatgcgccggtaccacaaccgatgtccagaacacgctccggtctcgaggtgcacatccatcggctcaacattcgcagacagtcgtcatgggcctggctcagtttggtaccgtacttctcttcatacgtcggcgcgatacggctgaacgtccgcacaaaacctggatttccattgcctttcccgccagaaaatacgttagacattattgaacatccatatatcaacagttatccgccaaggaccatagtagagaaaatccatcccatccaaataaaaattaaataagtggggctaaccgcaatccagggaaactctgaaaaggcccgctacttgtcgacgcggctgtctggaggccgcatagttactgaacttactattaaaagactgggctttttcagagccccaccggatgttggctccttgtccatcatttcgggggcactgtaacattctgttacctggctatcgcttgacttttaatctgaacgggcaattataggtctaaccgcaacagccccacggcgcttaagttcgaaaaaagtagctgcaccttgctcaactgcatcttgtaataaggggcactttacaagccgcataagacataaattttatgctgactccccaaacaagcacgacaagtaaaaaacacttgtccaataccaaggagggtatacggtgcaagcttctttacgtcaaaaagttctctgcttacagcagtctatcgatcccagccagccaggcatgttacttgaagtcgcttttcatgtgatcacccatctttctacttcgcagttggtatcgcgtatcgagagagtggtcgagcgacatgcgtctttacggcagcgctttgtcatgcgcaatggcacttactggattgaacaagccccaccgcaacaacgacgctactgcgtggtacgcacctatgatgaagcatcgaccgatgcactgctggcgccgagccgcgagcacatcggggttgagtctgagcgtttgttccgcgccgaagtcgttgagcgcagcgacggacaacgctacttggtcttccgaattcatcacatcatcgccgacctgtggtctgtcggcctcctgattcgagactttgccgaagactgtatggaccgctccagcatcaccctggcgtcaagaccgattgccccgttgatcgaccctgagttctggcggcaccaaatgtcacaggacactccgttttccttgcccatggcctccctggaacagcacacggaccgccgcatggtgctgtcttcgttcgttattgatcaggagagcagcgctgacctggcccgcctggccacagcctgcgcggtaaccccgtacaccgtaatgctcgccgcacaagtattggcgctgtccagaatcggccagagtggccgtctgtcacttgcggtgacgttccatggccgcaaccggggcaacaaggatgcggtaggttacttcgccaatacgcttgccgtgcctttcgatgtcagcgaatgcagcgtgggcgagtttgtcaaacgcaccgccaagcgcctggatgaggcctcaaaagccagcgtcggtgccggttatcccgaattggcagagttcatgacgccgctgggatgggctgcgaccgccccgaccaatgcggtgatttaccagcaggatatgccaggcatgccaagaggattggcggcggctctgctgggattgggcacggtgcagttgggcgagatggcgctgaccgcggaacaggcaccgcccagcatcggcccgtttgccactgcgctgctgctgacgcgccacgacggcaagctgcatggccgggtcgaggtcgatcctgcgcagcatcccggttggctggcagaggcgttagccagacagttcgctgtgatcctgcgggaaatggtgcgtgatccacaggccagactgtcagccttgccagcgtgcctgttacaccaaccaaaatacccgagccaagcgcggccggcgcctgcgtcagaaacattggtagccacctttctccggcaagtcgccatcacgccggacaagcccgcgctgcgtacgccgcaggccagcatcagctatagcgaattggccagtcgagtcgccaggctctcggcagccttgcgcgtacgcggcttcaaacctgaacagaccctggcaatactcctgcctcgcgatatcaatctggtacccgctctgctggcgatcatggcctgcggtggcagttatgtgccactcagtgacgcgaaccccgccgaactcaaccgttcgattctgaccagggcccgttgccgcgcgattctcacggatcaggagggtttgacccgtttcgctcacttggcgccctgctggtccttgagcgacctgctgtcgatgcccgacgccccgctgcaggaccagtccaagcttcaagccaaggcctatatcctatttaccagcggctccaccggtgaaccaaaaggcgtggcgatcacccatgccaatgccgccaacctgctgcgttgggcggctctcgattgtggccccgagtacctggcgcaaacactggcggcaacccccactacgttcgatctttcgattttcgagatgtttgctccccttatggtcggtggctgcgtacagcccgtttcctcggtcatggcgctgatcgacaatccggccctgctaaagggcacaacactgatcaatacggtgccgtcggtggccgacgctttgttgcagcatgatgtactggtgccttccttgcgcatgctcaacctcgcgggagaacccctgaaccgggatctttacctgcggcttcaggcaaaactgcccgccacacgcatcgtcaacctctacggcccgacggaaacaacaacctattccaccgccctggtgatcgagcccgcacaacaagagatcaccatcggttttccactgtatggcacctgggtggatgtcgttgatcaaaacatgcaaagcgtcggtatcggtgtacctggcgagttgatcattcatggacacggcgtggcgcaaggctatgtcagcgaccccgtgcgtagcgccgcttctttcctgccggcatccgatggcttgcgttgctaccgcacgggagaccgtgtccgctggttgcccgatggccgcctggactttatcggtcgagaggatgatcaggtcaaagttcgcggtttccgggtcgagttggggcctgttcaggcggcactgcatgccattgagacgattcatgaatccgcagtagtcgttgtgccgaaagggcagcagcgcagcatcgtggcgttcatcgtcctcaaagcgccgagcgaagatgaagcggtgcagcgcaataacatcaaacaacacttactcggcgtactcccctattacgcactaccggacaagtttatttttgttaaagcactgccaagaaacacacatggaaaaatcgacagaacgctgctcttgcaacatgaaccccagactgagcaagaaagcgccatgcgagatgcgaccgacatcgaacatcgcatcgccaactgctggcaaaccatcatcggacaccccgtccaactccacgaaaacttcctggacattggcggccactcgctttcgcttacgcatttaacaggcctattgagaaaagaatttaatattcatatttctctacacgacctctggatcaggccaaccatagaacaacaggccgacttcattcataagttgcaaaattcggtattgacaaaacctgccgccgcgccaatcccgcgacttgaccgaaagatctctcatcattaatcaggagtaccgcatgagcgtcgatacatgcaggactgcaactttccctgcgtcatacggccaggaacagatctggtttctgaacgaactaaacccgcactctcaactggcttataccctggcgatgaaagtatctatcgccggggaattgaacacactgcggttgcagcgtgcggtcaaccaagtggtggcctcccaggaaattttgagaacatcattcgcctataaaaaccagaagttgagccaggtcatttcaccctccgcgacactgcccattcgcagcgcgcactgcattgacgatgtacctgggctgcaacgcctgatcaacatggaagcccagcgtggctggtcgctgagcagcgcgccactgtaccgcttgctgctgataaaaaccggcgaccagcaacatgagctggtcatctgcacccaccatatcgtctgcgatggcatctcgctgcaactgctgctgcaaaaaatagtcagcgcctatcaaggccaaagcgatgggcgggtgctcacaagtccggatgaagagaccctgcaattcgtcgattatgcggcctggtcaaggcagcacgaatatgccggtctcgagtactggcgccagcaactggccgacgccccgacaatcctggatatttcgacaaaaaccggccgaagtgagcaacagacatttctcggcgcgcgaattcccgtcgagttcagccaccaccaatggcaagcattgcgccagatattcagaccccagggtatctcctgcgcggcggtgttcctggcggcctactgcgtcgtcctgcaccgcctggccgagcaggacgacattctgatcgggctgccaacttcaaatcgcctgcgtccggagttggcacaggtgatcggctacctgtccaatctgtgcgtgtttcgcagccagtatgctcacgaccagagcgtcacagactttcttcaacaggttcaattgaaccttacccaactgatcgagcacggggagacgcctttccagcaagtactggaaagtgttgagcatacccggcaagccggtgtgacgccgttgtgccaagtactgtttggttatgagcaggacgttcaacgcacgctggatatcggcgacctgcaattgacggtctcggatgtggacacgggggccgcacgcctggatctatcgctgttcttgttcgaggaccacgaactcaacgtttgcggttttctggaatatgccacggaccgtatcgacgccgcatctgcgcaaaacatggtgcgcatgctcagcagcgtgctacgcgagttcgttgcggcgccgcaggcgccgctcagcgaagtacagctgggggcggcggattcccaagcccagacgcctgcgatcgcaccagcattcccaagcgtgccggctcgtctgttcgccttggcagacagtcaccccaatgcgaccgcgctgcgtgacgagcaaggtgaactgacctatgcgcaagtttgccaacagattctgcaggcagcggccactctgcgagcccagggggcgaaacctggaaccctgatcgcggtcatcggcgagcgcggtaacccctggttgatcgccatgttggcgatctggcaagtcggcggtatctatgtgccattgtccaaggacctgcccgaacagcgcctgcaaggcatcctggcggaactcgaaggggccatactgattaccgacgacaccacgccggaacgcttccggcaacgtgtgacgctgcccatgcacgccttatgggccgatggcgcaacgcatcacgagcggcagacgacggacgccagccggctgtctggctacatgatgtacacctcgggatcgaccggtaaaccgaaaggcgtgcatgtcagccaggccaacctggtcgcgaccctgagcgcattcggccagctgctgcaggtgaaacccagcgatcggatgctcgcactgacgaccttctccttcgacatttcgctgctcgagctgctgcttcccctggtccagggcgccagcgtgcaaatcgctgtcgcacaggctcaacgcgatgcggaaaagctcgcgggctatctcgcagaccctcggatcacgcttgttcaggccacaccggtgacctggagactattactgtcgacaggctggcagccacgggaaagcctgaccctgctgtgcggtggcgaagcgctgccacaggatctggcggacaggttgtgcttgccgggcatgaccttgtggaacctctacggccccaccgaaacaacaatctggtccacggcctgccgcctgcaaccgggtgcgccggtgcaactgggccatcccattgcaggtacgcaaatagccctggtggatcggaacctgcgcagcgtgcccagaggggttatcggtgaactgctgatttgcggccccggcgtcagccagggctactatcgcaacccggttgaaacagccaagcggttcgtaccggacccgcatggttcaggtaagcgcgcctatctgaccggcgaccggatgcgcatgcagcaggatggttcgctggcctatatcggccgacgtgacgaccagatcaagctgcgcggccaccgtatcgagctgggagagatcgagacagcgttacgaaaactgcccggcgtacgggatgctgccgcccaactccatgatcaggacccaagtcgaggcatacaggcctttgtccagctttgcgcaacggtcgatgagagcctcatcgatataggccagtggctggaaacactgcgccaaacgttgcctgaggcgtggctgcctactgagtattacaggatcgatggcatccctcttacctacaacggcaaacgcgacaggaagcgcctcctgcaccaggccgtcaggctgcaaacactcagtctgagggtggctcccagcagtgacaccgagacccgggtgcagcagatctggtgcgagctgctcggtctcgaggatatcggcgttacggatgattttttccagttaggcggccactccattctggtggcgcgcatggtcgagcgcatcgaaaccgcgtttggacggcgcgtacctatcgcagatatctatttttctccgacgatcgcccgtgtggcggcgacgctggactccatgacatttgaacaaggactggccgcacacagcgttaaaggcgattgggagttcaccgccatcagccttcaacacaacgccgacagcacagccgccgctcaggagagatgaatcatgcacagccccactatcgatactttcgaggccgcactgcgctcgttgcccgctgcccgcgacgcacttggtgcctatcccttgtccagcgaacaaaagcgcctctggttactggcccaactggcgggcacggcaacgttgccggtaacggtgcgttatgcattcaccggcacggtggaccttgctgtcgtgcagcagaacctgagcgcgtggatcgcacacagcgagtccttacgcagccttttcgtcgaagtactggaacgccccgtcaggcttctgatgcctacgggcctggtgaaactggagtacttcgatcgcccgccatccgatgccgatatggccgagctcataggcgccgcctttgaactcgacaaagggccgttgctgcgtgcgttcatcactcgaaccgctgcacaacagcatgaattgcatctggtcggccatcctattgtcgtggacgaaccttccctgcagcgcattgcccaaaccctcttccagaccgaacccgatcatcagtaccccgccgtcggtgcgatcgccgaggtattccagcgcgaacagacactggcacaggatgcgcaaatcaccgaacaatggcagcaatggggaataggccttcaggcgcctgcggcaaccgaaattccgaccgaaaacccccgccccgctatcaagggctcagatcgtcaagtacatgaagcccttactgcatggggcgaccaacccgtagcagaggccgaaattgtcagcagttggctgaccgtgctgatgcgctggcagggatcgcaatcggcgctttgcgcaatcaaggtgcgcgacaaggcgcatgccaacttgatcggcccactgcaaacctacctgccagtccgcgttgatatgccggatggcagcaccctggcacaactgcgactccaggtggaggaacagctcaatggcaacgaccatccgtccttttccacgctgctggaagtttgcccaccaaagcgggacctgagtcgcaccccctacttccaaaccggcctgcagttcattgcgcacgatgttgaacagcgcgacttccatgccggcaacttgacgcgcctgccaacgaagcagccaagcagcgaccttgacctgttcatttcctgctgggtaagcgacggcacgcttggcctgacgctggattatgattgcgccgtgctgaattcgagccaggtcgaggttctggcccaggcgctcatcagcgtattgtcagcgcccggtgaacagccaatcgcaaccgttgcgctgatgggccagcaaatgcagcaaaccgtcctggctcaggcccgcggcccccgcacgacgcagccgcaactgacgctgaccgaatgggtcgccgccagcacggaaaaatccccgctggcggttgcggtgatcgaccacggccagcagctcagctatgcagagttatgggcaagagctgcactggtagcggcgaacatcagccagcatgtggcaaagcctcggagcatcatcgctgtagcactgcccagatcggctgaatttattgcagcgctgctgggggtagtgcgagcaggtcatgcgttcttgcccatcgatccccgcctgcccaccgaccgcatccagttcctgattgaaaacagtggctgtgagttggtcattacctctgatcagcaatccgtggagggttggccgcaggtcgccaggatacgaatggaggcgcttgatccagacattcgctgggtggcgccgaaggggctcagccacagcgatgccgcctacctgatctatacctccggcagcaccggcgttccgaagggagtcgttgtcgagcaccggcaagtagtgaataacatcttgtggcggcaacgaacctggccgctgacggcacaggacaacgtgctgcataaccattcgttcagcttcgatcccagcgtctgggcgttgttctggccgctgctgaccggtggcaccatagtgctggcggatgtcagaaccatggaggacagcaccgccctcctcgacctgatgatccgccatgatgtcagcgttctgggtggcgtaccgagccttctcggtacgctgatcgatcatccattcgccaatgattgccgggcggtcaagctggtgctcagtggcggcgaagtcctcaaccccgaactggcacacaaaattcaaaaggtctggcaggccgacgtcgccaacctctatggccctaccgaagcgaccatcgatgcgctgtatttttcgatcgacaaaaatgctgccggcgccatcccgattggctatccaatcgacaataccgacgcttatatcgtcgacctcgatctcaacccagtcccgccaggcgttccgggagaaatcatgcttgctggccagaacctggcgcgcggctatttgggcaaacctgcgcaaaccgcgcagcgcttcctgcccaacccatttggcaacggacgcgtgtatgcaacgggcgatttgggacgacgctggtcatcgggggccatcagttacctgggccgacgcgaccaacaggtgaagattcgcgggcatcgcattgagcttaacgaagtcgctcatctgttgtgccaggcgcttgagctgaaggaagccatcgtcttcgcccagcatgctggaaccgaacaggcacgcctggtggcggccatcgagcaacagccaggcctgcacagtgagggtatcaaacaggaattgctgcgccacttgccagcctatctgatccctagccagctcctgctattggatgaactgccaagaaccgccaccggcaaggtcgacatgctcaagcttgatcagttggcagcccctcagctcaatgacgccgggggcacggaatgccgtgcgccacgtaccgaccttgaacaatcggtcatgacggatttcgcccaagtactcggcctcactgcggtaacgccggacacggatttcttcgagcaaggcggcaactcgattctactcacgcgcctggcaggcaccttgtctgccaaataccaggtgcagattccactgcatgagtttttcctgactccgaccccggcagcggtggcgcaggcaattgaaatctaccgtcgcgaaggcctcacggcactcctgtcacgccagcatgcacaaacgctggagcaggacatctacctggaagaacacattcggccggatggcttaccacatgccaactggtaccagccttctgtcgtgtttctgaccggagccaccggctacctgggactgtacctgatcgaacagttgctcaagcgcaccaccagccgcgtcatctgcctgtgccgtgcaaaggatgccgagcatgccaaggccaggattctggaaggcctgaaaacctaccgcatcgacgtaggcagcgaactgcaccgggtggagtacctcacgggcgacctggcgttgccgcacctgggcctgagcgagcatcaatggcaaacgctggccgaagaggtcgatgtgatttatcacaacggcgccttggtcaactttgtctacccctacagcgcactcaaggcgaccaacgtgggaggcacgcaggccattctggaattggcctgcaccgctcgactcaagagtgttcagtatgtctccaccgtggatacgctcctggcgacgcatgtcccccgcccttttatcgaggacgatgcccccctgcgttccgccgtcggcgtaccagtgggctacacaggcagcaagtgggtggcagaaggggtggccaatcttggcctgcgtcgcggcattccggtcagcatcttccgcccgggcttgatcctgggccataccgaaacgggtgcctcgcagagcatcgactacctgctggtggcgctacggggtttcttgcccatgggcatcgtgccggattacccacgcatcttcgacatcgtgcccgtggactacgtcgccgcggcgatcgtgcacatatcgatgcaaccgcagggcagggacaaattcttccacctgttcaacccggcgccggtcaccatccgccagttctgcgactggattcgcgaattcggttacgagttcaagttggtcgacttcgaacacggtcggcagcaggcattgagcgtaccgcccgggcacctgctgtacccgttggtccccctgatcagggatgccgatccgctgccccaccgcgcgctggaccctgactacatccatgaagtgaaccccgcactggaatgcaagcaaaccttagagctgctggcctcctcggacatcaccctgtcgaaaaccacaaaggcttacgcgcacacaattttgcgctacctgatagacaccggcttcatggccaagcctggcgtgtagcggattgagcacaaacaggacgaatatcatggaatcgatagcctttcccattgcacataagcccttcatcctgggctgcccggaaaacctgccggccaccgagcgggcgcttgccccttctgcggcgatggcgcggcaggttttggagtacctcgaagcgtgcccccaggcgaaaaacctcgagcagtacctcgggacgctgcgtgaagtcctggcgcacctgccttgtgcttccaccggactgatgaccgatgatccacgggaaaaccaggaaaaccgcgacaacgatttcgccttcggtattgaacgacaccagggcgacactgtgaccctgatggtcaaggccacccttgatgcagcgattcaaacgggcgagttggtccaacgcagcggcactagcctggatcactcggagtggagcgacatgatgtcagtcgcacaggtgattctgcagacgattgccgaccctcgggttatgcccgaatcccgtttgacgttccaggcaccgaaaagcaaggtcgaagaagatgaccaggacccgctgcgacgctgggtgcgtggccacctgctgttcatggtcctgtgccaaggcatgagcctgtgtaccaacctcctgatcagcgcggcccacgacaaggacctcgaactggcgtgtgcacaggctaatcgcctgattcaactgatgaacatctcgcgcatcacgcttgagtttgcaaccgacctgaactcacaacagtacgtcagccagattcgcccgacgctcatgccgccgatcgcgccgcccaagatgagtggcatcaactggcgtgaccatgtggtgatgattcgttggatgcgccagtccaccgatgcctggaacttcattgagcaggcctaccctcaactggctgaacggatgcgaaccacattggcgcaggtctacagcgctcatcggggggtctgcgaaaagttcgtaggcgaagaaaacaccagtttgttggccaaggaaaacgccactaatacggccggccaggtgttggaaaacctgaagaaatcgagattgaaatacctcaagacaaaaggttgcgccggtgcgggataagccctgactgcgcctcgcccccatcaaaaccggaccgatattcgggaaaaaaaaggagagaagcatgccgacatttctgggagacgacgacgcagtgccatgcgtggtcgtcgttaacgccgacaaacactattcgatttggccaagcgcgagagacattccatcaggttggtccgaagaaggattcaaggggtcacgttcagactgcttggaacatatcgcgcaaatctggccagagccgacggcatagatacaacgtgatgcaaaaaatgcgggaaacatcaactaaccaaagcaaggaagaaaaatgacttcaactcatcgcaccactgatcaagtcaagcctgctgttctggatatgccaggcctgtcgggcattcttttcggccacgccgcattccaatacctgcgggccagctgcgaattggatctgttcgagcatgtcagcgacctgcgcgaagccaccaaggagagcatcagcagccgactgaagttgcaggaacgcgccgccgatattctgctgctgggcgcgacctccctgggcatgctggtcaaggaaaacggcatctaccgcaatgccgatgtggttgaggatttgatggccacggacgactggcaacgtttcaaggataccgtggcctttgaaaactatatcgtctatgaagggcagctggactttaccgagtccctgcagaaaaacactaacgtcggccttcagcgtttcccgggcgaagggcgggacctctatcaccgcctgcatcagaatcctaagctggaaaacgtgttctaccgctacatgcgctcgtggtctgaactggccaaccaggacctggtcaagcacctcgacctgtcacgcgtgaaaaaattgctcgacgcgggtggcggtgatgcggtcaacgccatcgccctggccaaacacaatgagcaactgaacgtgacggtactggatatcgacaactccattccggtcactcagggcaaaatcaatgattccgggctcagccaccgggtgaaagcccaggcattggatatcctgcaccaacccttccctgaaggttacgactgcattctcttcgcccaccaattggtgatatggaccctcgaagaaaacacccacatgctgcgcaaggcctacgatgcgctaccagaaggcggacgcgtggtcatcttcaactccatgtccaacgatgaaggcgacggcccggtcatggccgcactggacagcgtctactttgcctgtctacccgccgagggcggcatgatctattcctggaaacagtatgaggtctgcctggcggaagccggcttcaaaaaccccgtacgcacctcgattccaggctggaccccacacggcatcatcgtggcctacaagtaattttgcctcctccgcccctactggggccggaggagtcatttcaacatttgcgtcattgacgccacctggcgatagggacacccacatggcacgttcacccgagacaaatagtgcgatgccgcaacagataagacagcttttatacagccaactgatttcgcaatcgattcaaaccttctgtgaactgcgcctgcctgatgttctgcaagcagctggccagcctacctccatcgaacggcttgctgagcagacacacactcatatcagcgccctgtcacgcttgttgaaagcgttgaaaccattcgggctagtgaaagaaaccgacgaaggtttttccttgaccgatctcggcgccagtctgacccacgacgcctttgcttccgctcaacccagtgctttgttgatcaatggtgaaatgggccaagcctggcgtggcatggcgcagacaatccgaaccggtgaatccagtttcaagatgcactatggcatcagcctgttcgagtattttgaacagcacccggaacgccgggccatttttgaccgctcccaagacatgggactggacctggagatcccggaaatcctggagaacatcaacctgaatgacggtgagaacattgtcgatgtagggggtggttcagggcatttgctgatgcacatgctggacaagtggccagaaagcacaggcatacttttcgacttacccgtcgcggcaaaaatcgcgcagcaacatctgcacaaatctggaaaagcaggctgctttgaaatcgtcgcaggggatttttttaagagcctgccggacagtggcagcgtttacttgctgtcccatgtcttgcacgactggggcgacgaagactgcaaggccattttggccacctgccggcggagcatgccggacaatgcgctgttggttgtagtggacttggtgattgaccagagtgaaagtgcccagcccaaccccacgggcgcaatgatggatctttacatgctgtccttgttcggtatcgccggaggcaaagagcgcaacgaggatgaattcagaaccctcattgaaaacagcggcttcaacgtcaaacaagtgaagcgcctgccaagtggaaacggcatcatcttcgcctacccaaaataaatgatcctcattgcccctcgccactttccaggggggctattttattctcgggtgatttccccccctaatgatcacaaggaagacacatgtcgacgctggtttactacgtagcagcaaccctggatggttatatcgccactcaacaacacaaactggattggctggagaactttgccctgggggatgacgcaacggcctatgatgatttttatcagacgatcggagcagtggtcatgggatcgcagacctatgaatggatcatgtcgaacgctcccgatgactggccctaccaggacgtacccgcctttgtcatgagcaaccggaatctgtcagcccccgccaatttggacatcaccttcttacgcggcgatgccagtgccatcgcggtcagggccaggcaagcggcgaagggcaagaatgtctggctggtcggtggcggcaaaacggcggcctgttttgccaacgcaggggaattacaacagctgttcatcaccactattccaacctttatcggcaccggcgttccggtactgcccgtagaccgtgcgcttgaagtggttctcagagaacaacgcacgctgcagagcggtgccatggaatgcatcctggacgtgaaaaaagcggattaacgtctacaagacaatcgtgtatcgaaactcgcaacgtccaaacccaagggaaaaaccagtgaagcgattggtattgagtttatgtttgttggctgttatcgctctcgccagtgttcaaggaataaggatggtgaaacccgctaccctgacagccgccgatgctcgcgatatcggctatctgaatgtacgcgatagcctttccgtcattgccgcctccccccaccccaccgcctcacctcgccaggccgttgtcaggcattatttgcaggaaacgattgcgggcatgggttaccaggtggttgagcaaccctttctatttaccatcgagagcatggtgaaccggcagaaaaccctctatgccgagttgaacgagcagcagcgccaagcgttcgatgctgagctggcccgggtgggcgcggacagttttgaaaaagaagtgcggattcgctccggcctactggaaggcgacagcggccagggaaccaacttgatagcctcacaccgcgtaccgggagcgaccgcgacggtcctgttcatggcgcattacgacagcgtcggcaccgctcccggtgccagtgacgatggcatggccgtcgcctcgatactccaactgatgcgggaaaccataacccgcagcgatgccaaaaataacgttgtctttctactcaccgatggcgaagaactgggcttgctcggagcggagcactacgtctcgcagctcagcacgcctgaacgtgaagccatccgcctggtgttgaactttgaagcccggggtaaccagggcatccctttactgttcgagacatcccagaaggactacgccctgatcaggactcttaacgcaggggttcgggacatcatatccttctcattcacgcccttgatttacaagatgctacaaaacgacaccgactttacggtgttcaggaaaaagaacatcgcggggttgaattttgcagtcgtggagggttttcagcactaccaccacatgagcgacaccgtggagaaccttgcgccagagaccttgtttcgctaccaaaagacagtgcgtgaagtgggcaaccactttatccagggtatcgacctctcctccctgagtgctgatgaggacgcaacctatttcccactgccaggcggcacgctgttggtactcaacttacccaccctgtatgcgctgggcatgggcgcgttcgtgctctgcggtctttgggcgcaacgctgccgcactcgccgacagcatcagggcaagaattgcgtactgcgccccatggctattgccctgttcggcattgcctgcgcagcacttgtattctacgtcccgagcattgcctatctattcgtcatccccagtctgcttctggcttgcgccatgttgtcgcgaagcctcttcatctcctattcgatcatgctgctgggcgcttatgcctgcgggatactctacgcgcctatcgtctacctgatttcatcaggccttaaaatggcgatcattgccggggtcattgcactactcccgctctgcctgctggccgtgggactggccggcgtcatcgcacgatcgagagactgtcgaacccgcgactagcaagacccgataaaacgtcgcttcaaacgccagataacgtgcctcgtcagccaggcgtggaaccatctggtggcggcaaatgtgcataaggtgggaacgcagcccatcgcgctctgcgcctcaaaaagccgacgcagagcgcccgctgcaactcgcccaccccaagcaccgcgcctcaacagataatcaggctcaagggaattccaccttgcaacctgaaagagcaatcgagcgtccgtcggacacaacaaactgatcaccgtcaattcgggcaagcagcaatccacgggcttttgctccggcctcaactgcctcccgccacccctctatatcaccatggtaagagagagcatggaactgaagcccctccggcagatgaattttacagctgtcagaaacaaccccaccgcgggtggcccttatctcacctgccgagtccaggagggcgttgaactgcttctttgccttactctttccatcatcctggtagtaaacaaactctacgccctcaacagggttcaagccgggtacggcacgctgcccgcgctgctcgatggtgccgcctaagactttctccaacgcatcccgatcactgctcattacagacctcacttagccgccggggtaatgacaaacttgatgttttttatccccgcatcggtaaatatttttgagtaataactggccaactccgggctgttcgtatggtaaatggcaccgccatcaaagcctgaagaatacttcttcgcttgatccaccatttttgtctgctccgccgcagaccacggcttggtgcctgccgagcttgccgggttgcgaatggagtcactccaatcatccacaaactttgcttcgatcgcggttctcttaccaccgataacggcgacatcgtcggccacaccactgacaactttcccatccaccactgttctgaactgacgctcttcaaatgcagtagtaccaccatacattccgcgcactccgccctcgtagctctgcgccttgtcaatggaacgactcccgctgacagtaatagggttggtcgtctccagcgcagccccgcccgcatttggactacctcccgaacccgggttgatagggcatggtcccgtattgtgcacccacgttttcagtttgcccacatagaaggtatgaccgatatcgaccgtgaggttgtaggacttgccttgcggttggaacagctccaaagaggtaacacgtgtcgatacgttctcgcttgcaccgtcccctagagactggagcaaatcgcccggctcaaggtcaatcacggggataaagtcgtgctttgccggaacgtagaaaggatgcgacggcgttaccagcaacgtttcactctcagcggcaccgtctgcacggatgctcgtgagtctgagcttgtagataggctggtcggagcgtttgtgagtcgccagaatggccgccgcaaatggctcaccgccgttttcaggcttgctccagacgatatcgccaatattgagcgtttcgatcgccttggcccccgaaggggtggctaccatggtgccggcagcgaagcagcacggtcctttgccaccccctggattcacaccgaagccatcggcatccttcgagaccccgctaccggttttcccacctttaacgacacctgcaacaactttggtcccccagccctcggtcagtaacgtagtgcccatgttgctgatcatggcggctctttcggccacgctgagcttgcgacctgccgcatcgtcgagccaggaagtcttgttctcccactccttgagattggcgctctcggcgggcgtcaaccagccttccttgatgtacttggccgtaatgatctggtcatcggtcacataggtattgccccaagggtcatacccttgagccggttgcgcgatcagccctggattgcccaccagcatcccggtcatgtcataggaaactttgttccggtagaagctgaccaactcctgcgcaaccgggtcgtccatggcaatggtgttggctttgaggccttcgacacaggcgcgggtttcacacaggtcgatcaactgcgaacgttcggccgagatcttttcaaacttgcctatcaggtcgcgctgcttcgcttcggtgcaattgccaccggccttgcacgccttcagctcgttaagcaatcgctcggcggtcgggtgatcaaggctgttgaacttggtcgcctgctgggtgacccagcccgccactgcctggtctttatccgagccgcctgcggctgccgagaccgttacgccgatcaactgggaggtcatcgccagcagttgatcatgcatgtcgcccacaaagatcttgtcgcccaccgaggcgacaaaggcctcattggcaccggctgccaaggccccagtccggaagctgcctccggccgcttccgcgatcaggccaccgacaatcgcgtgtgcgccgaccttggccggaaccccggtgaactcaagctgagtacccaaccggttatagatggaggccgacaggacatccgcagccgcactgatactggcctgtgccagattgttcttgaggctgccaccattgatcgcagtgttggtaaccgcaccaaagcccttttctgccaaggtgtagccagcaaacttggtcaggccgtcggtgctggccagttcaaaaccgtgggtcgctttaccggcattttcggcagaaacaccgaacgccttgtccagaacacccgatgcaaagcccgcaaccagcccgctggtcaaataccccttgaggctttccgtcgaagtgacatccttgagcactgcgcccaggttgcccttgttgtttatcgtgctgaccaccgactgaaccacggcagcggtgtaggctgccgatgccgccgcgccaatcgcggcggcggtggtcgcactgatgcccacggctgtggcagccccgcttgcgctggtgccaacgacagtggccgttcccgaacctgcggtcagcaccgtcacgataatcacgaccgccagcatcgcgcccatgcccatgccggagttgctgtacttgaaggactcgtgaacctccttcacgcgttgccaatcgacgtccccgcgtttatcggcttctttgagccaggccagttgagggtcggcctggaccatcgcatcaatggtctggctgactgtcttctggtcaatctgcttgatgtcgatgtgcagaccttttgcggcagtgatcgccaggtcgcccttgctgatcaattcgctctgacgcagggtttcgtcggtatgtcccttacccttcgaggagttccacgcgaggctgtttttactcttctcgtggctttcctggttcaggtccttgacggcctcaaaggtaatcgagccctcgctgttgagtatcaagtctgcgccgctttcaagtttcgcggcctgataacgctgatcgccaccgctgatcagtgtcagatcactgcccgtggtgatctgggtgccgacatgggtgatctttgtcacctcatcgcgcctggtctgcttgcgcccccaactgcccttgctctttttgtcatacagcgagtaatcggtgtcctgagccgccaacacatccagctgcccagccgctgcgaggtaggcctcgttgccggcattgatccggctcgagatcagcgtcatatctttgccagcgttgaaagtcacgtcttgcccggcgcttacgacactggaaatctgtttgacgtggtcttcctgagccgtaaccttcttggacttggaatacgaatggctttcatcggcagccgaagccaccgtaaggttttcacctgcgccgaaatcgatgttccgatttgcctctatctggctggcaaccactgccagatcacgccccgtctggatagagaggtcacgccccaccgtcagatcagagccgtattgggtaacgctgctgctctgggcaccggccaccacgctgttgtgctgctcggtggcggcaataaaggcatcccggcctgcggtgatcgttgtgtcaccgccgctttgcagtgtgctgccagtgctgacgaaatctcgcgcagccttgatggtcaggtcgttcgcagcttctattcgagacccgctgtcgacatactcgctgtgtgtgttttcgcccttgtagcgtatgtcggtgccggtcaccatacgctggttgatcacgtccccggcaatcgcggtcatgctcacatcgcgccccgcgatgacgccgcccgctttgttgatgatgtcgttaccggccagcaagtccagacggttaccggcctcgatcagccccgtgttgaccagatcattgccggccgtggccgccaggttgttgctggcacgcagcgtaccggcgttgttcaggtctttgcccgcgatcagcgtaacgtccgagccttggatcaaggctccattcggtgccaggcggttggtggcctgggccaggtacagcaccggcaccaagaccttttcgccattcacctcatgctcttcgagccagacgatatcgtgggtcagcgccgcgacctgttgtgatgtgaggctgacacccaccgacagttcgagctgctgcttactctggatggcgttgtccatcaagtacttgtagagcgcttcgtcggaggtctggccatcgataaaacgttgaccggtgcgcgcgaccaccgcctgctggatcagcttctgttcatagaaaccatcgcccaggcgcttggcgctttcatcagggttgtagccgaggttcgccagcaggtagtccgaactcatgaactgcttgaggtcggtcagcaccgggttggtttcgatcaggtacttatgcggattggaccgacccgaagtgtccggcaagccctgcacgcgattgataacctggttgcccaccgaggacaccaagccgccctgccccggcagttggacactgccggtatcgcccggtgcgctgacagtgatcacgctgcccgaaacaccgccgcccgtggcctgacgggtattttgttcgagctgaagattgctcgcagcgatccgcgccgcatcattgaactgcaggttgcgcgcctggacgtcatccgccccctgttggcgctgggcattgctgactgccgcgctgcccatgctccaggtctggggccccgcgttggcctggttagcctgcgtcgccgaaccgccctgcccactcaggcggaacaggccgttttgtccggttggcaggctgaatccgggtagaaccaggggattgacctgctgcttggcaaggtccggcggcaactgagcattgagccggatcacaacgggcgtgccggtgcccgccgcttgcgtgctctggactttgttggcgcccgaactgaccccgtaatcctggtgaatgacgctgttgttcagattctgcgacgcagtaatcgaaaccttgccacctgcctggataattgcactgcgcccggccccactgccatctctggaaacttcaacgtcaccggtctgggtgtacgactgcaattgagccggcagcgctatcaagttattaggatcgtactgggcctgttggttcagcccataccgagtaccgaaggccaatgtggttatcaactggccggtgacggcatccctgaaccgaacagccggagctgtggttccggggcttcctacagggacagggcgctggtaggtctcggcaatcgccttgctcaggccgccagcgtcattgatgtagtagatgttcgggtagtcaggatcatttcgcgcgttgtagctgaccacctggttgacgaaggcaagggccgtggtgtttggaatcgcttgtgtgcgataactgcgcgtgcgctcgatgatgccgcccatcgatcctatattggtcaggttgcttgcctggatggaaatgttgccgcctgcgctgacggtacttttgctattgagaaagttgccgccgctgaaaacaaagtctgtgccggctgaaagcagggccgccgcactggtgtcgttgtcctgcccttcgtaagtctcacgaacggcaatggcgaggtcataatcccctcccgcacagtccagacatttgacggcaatagttgctgagaccagtttgcgccccaggctaaaaccttctgtgcggttttccacgctggcggcatttatgctgaatctgccccgactctccaacgacccggagatattggtcacttgagccgactggacctgccccccatagccttcaatactgacgttgcccaggctgtagagctgtgccgtatggttagtgaaaccgttgacctgtagcgttgtgtcgccgccactgaagatcaggccattttcgttgagtaagccaggggtgttcagcaccaggttggcattgctgcccaaagttgcgtagttgttgatcgacccggcgttcaccctcatcccggcagccgaagtgattcggccatagttgttcacctgcccaccgacgttgatcagcgtatcggcccctccggcgatactgccggtgctgccaaggttcaacgcggcggcggtcaggcccagcgtattcaaactggtataacgtccttggccgttgtagctgccactcaggttcaggttggccgtcccatcgctggcgatcagcccatcgttgttccaattgccgccgttgccggtcaggctgtccgaggccagcagttgtccacccgccgtctggttgagggtgttgacgttcaccttcaggcgcccggcctggatcacgctgctgttggtccagctgtccgccgtgagcgtgaggccaccgcgggtcaccaggctgccgccggcattggtgatattgccggtgctgatatcaaaggtgccgttgcccacatgcagcaggctgccgcccaggttctggaagctgccggcgttaagggtcaggtcgctgttggcggtttccagcttgccgttgcggttgtcgaacaggccgccgatctggaaatcggtcttgccgctggtgcccagcgcacggatctgaccggactggttgtcgaggctggctgcacgtacgcgcagggtgctgtcgctttcaatgatacccagacgattgttcagcgcgccgttgaggctgaggtcgatgcgctggccggcgatctgcccgccgttgtcgccgctgttgtcgaaggtgttgccgctgacctgcatcaggcccttggcgtaaaggccgccattgcggttatcgaaggcggcggtggtgaccagggcatcgccgctctgcgccgcgatccgcccgccgtagttgtcgatcccgcccagggcgctgaggttcaggcgctgagcctgaatgatgccgccctggcgattgttgttcaggtcatagccgtttttcagcacgccgacaatacgggtttcaagggcgcccttgacgctggccagggtgccgccacggttgtcgaggttggccgcgctgacgttcaggtcgccattctgggcaatcagcctgccgctctggttgtcgatagcgccgctgaccgtcaagttcagcgcgccctgcccttgcaaggcgcccttgccgttggcgaggctcgtggcgtcgacgcgcacgtcaccgttctggctgtagatcaggccgtcgttgttgttctggactgcgccagtgctgttgatgacgaggttgtcattggccgcgacggtcccgcgattgcggttatccaggctgccggtgagcaggctcagcaagccctggctgaccagttggccgccctggttgccgatctcgctgctgcgactgatcaccaacggcccggcactggcgagcttgccgttggtgttggtcagggaaccgagcagatcgaggctgaccgcgcccttgccgctcagggtaccgttactgttgtccagcgtgctgccggtgaaatccagggcctgttgcgcgctgatgctggcgctgttgttcagggccatggcttgcagtgtcaaggtagcggcgctgtcgatggagccgccttgggcgttggtcaacagaccgctgaccgtcaggcgctgggccgcgccactggacagaatcccggcgctgttgtcgaggctggtcgcgttgacggtcaaggccgactggctgaccagcgcaccggcgttgctgttgaacaacgccccactgacgttgacatcaatgttgccgctgcggctggacaaggtgccgctgttgcggttgtccaggctcgcgccgttgacggccagcccctgccagccggaaatcaggccgccctggttgatcaggctattggcggtcacgcccagctggttgctgctgatcagcttgccggcgctgttgtccagcgcgcgcccgacgaggttgaagctctggctgctggagagttcgccacccccgttgttcaggtcgcgcaggcgagtgagggtcaaggcgcccttggcgttgagcaggccgttgcggttgtccagatcaccccccgccaggtcaaggcggatggcctggtcgccgagcagacgaccttcgttttgggccagggcgccgaggctcaggtcgatatcgcccttggccgagacctcaccgccattgccggagtccaggcgggtagcgttgatcgtcaggccgccctggctgttgatcaggccccggccactgttgttcagggccatcgcgttgagggtcaccgcgccggcaccgagcaaggtgccgccctggttgtcgaagtcggcgctgctgagcgtcaaggcttgcgcggcgttgatcaggccctggctgcgattgctcagttgaccacgggtggtcaggtcgaggtcgccacggctggtgacggtaccgccactgttatcgaggctggcggcgcggatatcgagcgcggcggcgccgatcaggcccttgaggttgatcagtgcctggttgatccgcagggtcacggcctgattgctcagcagtttgccattgctgttgtccaggatgtcggcggtcagtgcgaaggcctgggcactggagatttcaccgccctggttgttcacgtccttgaggttgttgagcagcaatgacggcgcgttgatcagaccgttctggttgttcaactggccgttgttcaggtccaggctcagtgccgtgttgctgaagagcttgccattctgctggtccaggccggtgatgctggcgaccagggccttgtcgctgccgatgcggccgatctggttgctgacctgccctgccgtgagggtgaggctgtcgctgctgctcaggctgccggtgcgattgtcataggcgccggtactgagagtgaccgcacctttaccgctgattactcccagctgagtgttgtcgaggctggcactgctcaggttgacgcggctgtcactgaccaggcgcccgcccctgttgcccaatgctccgttggccttgaccgtgagcgccccgccactcgacaggctgccggcggtgttggtcagctcgacgctgctgacgtcaagctggccttcgctgctgatcaggcccccgctgttgtcgacgccagcgccgagggtgagtcgtgcatcaccgccgctgagtagttggccgccggtattgtcgaaggtctggccgtccagcgtgacgccggtcttgcccttgagcagtcccaggttacggttgagtacctcggccatttcgagtgttagcgtcgtatcggcaaggagcttgccgctgtcgctattgtccaggcgcttgccggtcaggcggatatcggcactgctggagagttcaccgccgcggttgtcgatagcgtcgacatccagtttcagcgcttttgtcgcccctaccagaccgttctcgcggttatccacggaagctgcgttcagggtcagcgcgccgctggcgatcagcttgccgttgcgattgtccagagcggcaatgttcgccgtgacatcggccttgccggagacggcgccgttgctgttatccaggctgttggccgccaacagaagcgcgccgtcacccaccagagtgccgcccgtgttgatcaacgacccgctcacactcaggtcgaccgcaccccggctgctgataaggccttggctgttgtccaggcgggtgctacgactgtccagggcagccgcggccaccaggcccttgatgttgctcagcgcctgatcgatacgcagggtcagccccccgttgctcagcagcttgccgttgctgttgtcgaggcttttggcggccagggcaaacgcttgggcactggagatttcaccgccccggttgaccacctcgtcgaggtttttcagcaccagcagcgggccgttgatcaggccgccgctgttgtccaggcgtccgttgtgcaggtccaggctcagttgggtcttgctgaacagttcgccgccctgctggtcgaggtcggtgacgctggcggtcagctccctggtactggcaatacggccggtagcaccattgctgacgtgggtcgccgtcaggtccaggcggtcgtcgctggtcaggcggccgccctggctgttgtcgagggtgccggtggtgacgcggatggcacccttgccactgatcaggcctttgcggctgttgtcgaggctgctgctggcgagtaccaggccctggtccgtgaggatcgaaccaccctggttgagcacgtcaccaaggctgtcgatcgacaggtcggcggcactgccgagcttgcccgccgtgttgtccaggctgccgaccttgagccccagggcgccttcgctgctgagccagccggtgttgttgagcagcgcgccatcgaggcggatatccaggccctggagcgcggagaggttcccgccgcggttatccagggtcgagccgttcaggttgacgatgcccttggcgaacaggcggccagtgttctggttgatcacttgcgccacgacaaggccgaggtcggtctcggtcagcagcttgccgccatcgctgttatccaggcgctgcccgctgacactgacgctgctgcgggtgctggatagctcgccggcacggttgtcgatctgcccgacattgacggtcaggccctgggtgctggcgaccgtaccgccattgcggttgtcgaggctcttgccagtgagcagcaaggaaccctgggccactaacgcaccgccctgctggctcaggctgtcgatgctcgcctggaggtcgccctggctggcaatacggccttgggtgttggcaacctccttggccttgagattgaccgggccgactgcgctgagcaggccgccgctgttgtccaggcgggtgccttccaagtcaaaggccgccttggcgacaagattgcccttgtcgcgattgtccaactgatcgaccagcagcttgaggtccttgtcggcctggatcaggccgccacgattgtccgccgaagcgctgcgcaaggtcaggtggtccttgcccgccagactgccgccacggttgtccaggctgccgatgttcagttcgatgctgcccgtggcgcgcagcttgccctgttcgcggttatcgaatgcgccgctgagggtggcgctcagcttgccgtccgccgcaagcactgtgcccgccgcgcggttgtcgaggctggcggcggccagggtcagagccttgccggaacccagggtcccagcgtggttatccaaggcaccgcttaggtcgatgttcaagcccagatcgccggtgatctgccctcgagtattgtccagggtgacggccttcagggtggcttcagccaggctggaaatttccccgtcgcgattgcccagcgcgccgacgttgaccaccagttcgccgtcactggagatcaggccgccttggctattgagcagttggtcggcgttgatgccgaggctgccggcgctgaggatgcggccttggttttggttgtcgatctgcgtggcgttcagctgtgcagcgcgttgagcgctcagcgtaccgccttggttggcgagttcgccggtgttgacgctgaggtcgcggctggcgatcacagtcttgccggtgttgtcgagagcctgcgcggtcaggctcacgtcgccttggttgttgcggctgttatcggggttgacgcccgcttcgataatgccgttgttggtcaaccagccaccagcgtccagcgtgatgctgtctttagcggcgagggtttgttggttggtcagtgcgccctgggttttgatcgccaaatccgtaccggcgtagaccgcgcctttggcctcgacactctgcgccttcacgttaaccgccgtaccggccgaggtctggcccatgactacattgccagcggcatcgatttggatatcaccaccggcgaccatgtcacccgacagccgcacgcccacaccggcttcggtgccgaccagcttcaccgcgcccacatacatgccgccgagcgccgacgaatcaatcgccaaatccggcgcctggctgccgtccgctgcgcgtgccgtggcattcaaggttcgcgcgtcgacgtcgttgcgaccggcaacgatggtgagttttttcgcctgaatctgcgcgttgatggtggtcgcgcgggtgatgatttcgaactggtcgacgttgctcgcattcaggccggcgccttcgatggcaacgctgcctttatcgacttgataacggctgatctggccgttttcgatcaccgctttaccggtggtgagcgtggcttg

SEQ ID NO: 26 - DNA, 280519 bp, Pseudomonas poae FL10F
ggcttcagaggcggcggtggtggtttcggcggcggtggtgcttcaggtggctggtaatgacaataactagaaaggggcatcgacaaccatggcattactgagtgagcacgagcaacggcaagtcgccgaggcgatcgcccgcgtcgaaaaaaacaccgatgccgaactggtgacggtgctggcggcccgtgccgacgattacgcctatatcccgctgttgtgggccagcctgatcgccctggtggtgcccggcgtggtgcattacttgtcgggttacctgaccatgtacaccttgttgttggcgcagtgggcgacattcatcgtgttgtgcctggtgtttcgcctgcccaaggtcaccacccgcttgatcccgcgttcggtacggcactggcgcgcgtccaacctggcgcgccggcagtttctggaacagaacctgcaccacacagtcggcggcaccggcgtgctgatttttgtcagcgaggcggagcgctacgtggagatcctggtggacgagggtatttccaagcggctggatgacagcagttgggatggcatcgtcacggcgtttacccagcaggtgaaacaggggcagacgttggccggttttattgcctgtattgacgcgtgtggggagttgctgaaggtgcatgtgccggtgacgcagacgcgtaatgagctgccgaaccgcctgatcgtgctggaatagccaggcaacaaatttctaattgtgggagcgggcttgctcgcgaatgcggtgtatcagtcgccgaatatatcgactgacattgcgcattcgcgagcaagcccgctcccacattggggtttgcgttgcccaaaccaatgaccgttgatcaaataaccccgtgccctaaacccttatcccccctaaaatgcccggcattcccagcccgaggcgtttttgttcatgtccgtcaccgctcaacctgcccgccctgcgccggatcatcacgcccagttcatcgaactgctgagcgcaagcctggcgcagaacgcgtttatcaagctggtgctggccaagtacgtcggtgaggaagccgagttgcaacggctgatcatcaaacccgtgacggtcaaggagcaggcgtgcctgtccttcgtctaccgctacaaaacccgcgacatcaccaagaacttgcccctggccgatggcgtggcggcgattgccgcgctgctgccggcgtcgttcaagaacgcgcacttgctgtcgctgaccgacgaagcccagctggaatacagcaagaagaacaaaagctcgctgttcaaaagcaagccgcagcaattgcgtgaggcgccgtccgccgagcacaaccgcgagaagaatcgcttcctcgacctgagccggccattcctcgccgaccttggcgtgaccgatgccaagcaagcgttgatcccgtcgatgtcgcgcaagtggaagcagatcaacaagttcatcgaagtgttcagccatgcgctgacctcgtcgccgctgaagctcgaccagccggtgcgcgtcgccgactttggttcgggcaagggctacctgacgttcgccattcacgattacctgcgcaacaccctccaggctgagggcgaagtgaccggcgtggaattgcgcgaagacatggtgaccctgtgcaacaccgccgccgcgcgcctggaacatccggggctggtgttcaagtgcggtgacgtgcgcagcgtggcgccgagcgagctggacgtgatgatcgccctgcatgcctgtgacattgccaccgactacgcgatccacaccggcatccgctccggcgcgtcgatcatcatgtgctcgccgtgctgccacaaacagattcgcctgcagatccagagcccggtgctgctcaagccgatgctgcaatacggcctgcacctgggccagcaggcggaaatggtcaccgacagcctgcgcgcgttgtacctcgaagcctgcggttacgagaccaaggtgttcgagttcatctcgttggagcacaccaacaagaacaagatgatcctcgcggtgaaacgcaacgagccggtagacaatgcgcagttgctggagaaaatccaggaattgaaggcgttctaccacatcagcgagcactgcctggaaaccctgttgcgcgcggatggctatttaggctgaacacagaaccaaaatgtgggagctgggcttgtgtgggagctggcttgtgtgggagcgggcttgcccgcgatggcatcagcgcggtttagctgaagaccgagttgcttgcatcgcaggcaagccagctcccacacaagccagctcccacattagattgagtcagcctttactatcggcgcaggctgcaccgccgtcttgcgccccagcatgaccgtcacgatcaccccacaggcaaacagccacgtaatcggctcgatatgttcaccaaagaacaacgccgaaaaggcgatggtgaagaagatctgcaacagctgaatctggctgacccgcgcaatcccgcccatggccaagccggcgtaccaggcgaagaagcccaggaattgcgagaacagcgacacataaccgaacgcccaccaggtgcgcatggaaattgcgccctgatgctgcgccgccaagtaccacaccgggccgatcaacacgggtgtggacagcaccaacgcccagcagatcacctgccagccgcccatctccttggccaaccggccgccttcggcatagcccaggccacccacggcaatcgcgccgagcatcaacaaatcccccgcctggatactgcccgcaccggtgatcaacgcataactcagcaccaatgcactgcccagcgccgcacaggcccagaaggctttagacggccgctcgtgggacagccacgccgcgtacagtgccacgcacagtggctgcaggccgttgaccagcgcgccatgggaggccggcaaggtttgcatggcccaggccgacagcaccgggaaaccgaggatcacgccggcgatcaccaggcataagccgcgtacctggcgccaggtcggccagcgctcgcggcgccatagcaacagcgccgccgccgggaccgccgcgaacaaggcgcggcccaggccgttgagcaatgggtggatttcctgcacgacgatgcgggtgaagggcagcgtgaggctgaagatgatgacgcccagcaggccgagggccatgccggtgttttcgcgcgaactcatgatggggaccgaaatctggagggcttcaaggaacgcccatctagccacaacccccggtgatcgggggcctacagatgggtgcggatttatccgtacagtttcggcaggctctggggataacctgtgtgagctggcttgcctgcgatagcatcaccgcggtctatgagtaagaccgaggtgcctgtatcgcaggcaagccagctcccacattgaccgtgccagccttagaaaaaccgcgtgatgctgatcttcgcatcacggcccttggtgtaggcgcggtcgccgctcaaggccgggcggaagttgttgttgaacaggttgtccacggtgaaattcacctcggtgcctttcaggtaagcctgttgcggtttccatttggcgaacaggccttgggtgttgtaggccttgttgccgtattggtcgtagaacaggtcgcccacactgctgcccgggccgccggaatatttgtcactcggcaagcgatcggtcgcgccgatgaactggcccatccagcccacctgggcatcccaggccggaatattggtgcccagtaccagcacccatttggtcggtggaatatcgcgggccggtacatcggggccccatgggttggtgtaggcgccttcgtgttcgcccttggcgtaggcgaacgacaccgaaccgaacaggtaggtggagttgtagaacgattccagctcaaagcccttgatggtcaggccgccgatattgcggtagttggacatcgctcccggcgggcaggcgttggaaatcgtgccgccattgacggcctggttctggcagccgacgccggttgccttgaaaatttcgtcttcgaccttgttgtggaacaaggtggtgcgcacttgcaggttgtcatcctgagcgatcaggtgatcgaagctgaagacgctgcccacggtgatcgaggtgatgcgctccgggtccaggtcgacgctggtggccgtgcggctgcccaggccttgcacctcgtattgttcgtcgatgaccggcgcgcgccaggtcttgctccagttggcgaacagccccaggtgcggggtgacgttccagaacagcgccaggcgcggcgaccagccggtgtaggtgcggtcactgtaatcgtggccaacggccgggtcgggattgttgtagtacggcgcgtcgttgccttcgccgcgattgcgcacatggtcgtagcgcagcgacggcgtgatggtcagatcgcccaccgtgaccgcatcctggacaaagaaactgttggtatcgaccttgccgtggggcatgaaacccggctggaaatgcccgtagttgtagcgcgcggtgttgtaggtggaaccgggcatccacatttcggtttcgcggatgtgcttgcgaatttgcccgccgacggtcaccgcgtgttgcagcggcccggtgtcaaacaggctgacgttgcggatgtcgaggttcttgtcggtgtagccggtgtccatctggcgcccgccggtggccagctggaaaaacgcggtggcgtcacgggcgtcggtctggtcggtgttggactgcgaatacttgacggtcaggtccaccagcgggttgtccagcggcgtgtattcatacttgcccgaccacgtggtgtcggtggtgtcgcggtgcgctaaaaaacgtttcaacgcgttttcgtagccgtagcggttgatgttggcctgggtcggcggcgtcgggtagctggcggcggaaaagggtgtccagcgattgctgtgggagcgcgagtaggacaagccaacgctgtgctcttcggtgaagtgcgcattgaccttgaacagtttgccgtccacgtcctgggcgctgttgggcaggcgctgagggttgatggggtactcgttgttctcgttcggcaacttggcggcgaccttcatatcgccgccgtcgcgttgggtcaggtaggccagcgcgtcgaagcggccgtcgtcggtacggccatacacggcgctgctgtagacctgttcgtggtcgttgctggagtaaccatatttgagcatcgcgccgctgttgcggccgtcctgcagcaggtccggggcatctttggtggtcatgttgaccgtgccgccaaacccgccgttgccggtgaacggcgagttggggcctttctccacttcgatgcttttgatcagctcgggctcgataaagactgtgccttgctggtagcgctcgaagccggtcttggtggcgccgtcgacggtcatcggcacgtcttcggcatcgccgaaaccacggatgttgatggtctggccgccgggtttcagcgagccgccctggcttacgccgggcaaggtctgcagcaggctggggatgttattggactggtaacggtcgatgtcggcctgggtcatggtcgagcggttgacggtgctggagtcgacttcgttaccggtgccgatcacgctgagcgcgtccagttggatggcgccgctgtgggtagtcttgccctcgtcggggcgtaccacgtaggtgctgccgactttgatcagggtgaattcgccatttttcagcaaggtgcgaatcgccacttccggggtgaagtcgccattgagtgccggcgcttgcacgttcttgagcagtgtttcatcgaacagcagctggatttttgcctgctgcgccacttggctcagggacgtggccagcgactgggcgggcagttgcaacgtgaacgactcggcctgggcgctgaggctgaatgccaggcaggtggcgatcagggtcggtcgaagaaacaggtacgaagcgtggcaaggcgcgcgaaacatggaatcccccggggtggccaagtggccgaaaaggtgtgcgtatcaaacacagtcgggaggaagacggggcaggccaaaaaatccacacatgcgaatgcaaaatattctcaagtgagtgcctggcgcaattatttgcgcggttcgattctgacaacgccatcggctgaggccacggttttcaacggtagcagggcaggcagggcgttgagcagggcgtccggatcattcacatcgaggttgcccgagaccttcaattgcgccacggacttgctgacttgcagcggtgcctggggccggtagaggctcagctcatcaatcaggctggccaggtcgcggttgcgaaaggacagatgcccgctgcgccaatccgccacttcttcagccgtgagggtttggtgttgcacagtgcccttggcgtagctgtaggtggcgcgttgctgggcgccgagcaaggttaccgggcttttggcgtccggctcgaaggccacttggccatgggccacgctgaccaccagttgctgctggctgcggcgcacatcgaaaccggtgccgaccacgcgcacgttggcctcgccggcttgcacatacagcgggcgctccttgtcggcagcgacttcgatgtacagctggcccttgtccagatgaaggatgcgttgctgggcgctgaattccacccgcacgcgcgtattggcattcacgtacaacgtgctgccatcgggcaggtttaacgtacgcatgcctttggcatgcgcggcaatctggctgtggtagagctcgcgaggcgcaccgatgtgcgtggccaacagcgcacagaccagcgcagcagccacagccagggcagggcgccaggccgaaggtttgcgcttgggcagcggcagcggtttgttcaattgctgcagttggccgaggtcggcccacagttgttcgaactcggcataggcgcgggcatgtgcaggctcggcctgccaggcggcaaaagccttgcggtcggctcgccccgcttcgctacggttgcgggcaaaccagctggcggcttgggcatcgatggagtcgctcgcttcgatgtccagggcgtcgatgtcgctcaggcggttcattctggctgctccgtgccgggttcttgttgaaggcgtcgcttgcaatgcagcagggcaaaagcgatgtgcttttccaccatgctggtcgaaatacccatgcgctcggcgatctgcgcctggctcaggccttcgaagcggtgcagcataagggcttctcgcctgcggggcgagagttcggcgaggacttctttcaactgttccaggcgttgcaagcgctgcgcggcggccatgggctcgttttgctcatcggtgaccggctcggcgtccctttcggccgggtcaaggtggacggtctgccgtaccttctgtttacgccagtgatcgcgcaacaggttgcgcgccatctggaataaaaacgcccgtggctgctcgaccttggcccggtcgcggtaatccagccattgggcaaagacatcctgggtcatgtccgccgcgtcgctggcgttgtccgtgcgtttgcgcaggaaatacagaatatctgcataaaacccgcgaaaggcatcggccgacaacgggtcgggcttgggacgagacatggatatccttcttgacgaagtacgacgtagaaaagtcgcgaatgatatcgagaattattgtcatttgtctctatgtaaagcgtgtacccaatcaaatgtgggagctggcttgcctgcgatggcgatggtgactgcaccaccgctatcgcaggcaagccagctcccacaggcggccacgcctctatcgtaacaatgtccttagttgctcgatccccgcttcacccaacggaaacaccggtaagcgtggatcacccgcttccaacccggtcaaccgcaacccagccttgatcgtcgccggcaaaccacccttgaggatgaattccagcagcggcaattggcgatagaacagttcccgcgccagcgtcaggtcgttggccagcaccgcgtcatacaacgccaggttgagctgcgggatcaggttcggcgccgccgtgcaccaacctttggcgccggctgcgaaggcttccagggccagcgggttgcagccgttgtagaacggcacgtcgctgtggcgatgcaactggtgcatgcgctgaatatccccggtgctctccttgaccatggtcacgttcgccacctgcttgacgatgcgcaggatcaagtccaccgacatgtcggtgccgctggtggccgggttgttatagagcatgatcggcacgccgacgctgtcgccaatcgccgcataatgggcgaggatttccgcctcgctgagtttccaataggacgcgggcagcaccatcaccacatcggcgccattggcctcggcgtaacgcgcacggcgcacggccttggcggtggtcaggtcggacacgctgacaatcgtcggcacgcgcctggcgatttttgccaggctgtaggcgctgacttcgtcccactcggcatcgctcaaatacgcaccttcgcccgtgctgcccaagggcgcgatggcgtgcacgccgctgttgatcaagcggtcgatggagcggccgagggcgtcaaggtcaatgcgctggccgtcggcactgaacggggtgatggtgtagccgatgatgccgtgaatagttgggttggacataaaagagtctccgttcggaatagggctatcagttcaggcaatcggcgtgttggcgcaggttctgccgggcgtagtagttgaacgcggcgccgtggcgcttgggcttggagatccagtcatgcgcctcgcggcccagttccggcaggatcggcttgatcgtaccggctgccatcgccagcaactgcaacttggccgcgcgctcgatcaactgcgcgatcacgcaggcttcttcgatgctcgccccggtggacagctggccgtggtgcgagagcaggatcgcgcgtttgtcgcccagcgccgtggtgatgatttcaccttcttcgttgcccaccggaacgcccggccaggcctccagaaatgcacagtcttcatacagcgggcagaggtccatgtgcgacacctgcagcggcacttcgagcatcgacagcgcggcgatatgcgtgggatgcgtatggatgatgcagttcacatccggccgcccacggtacacccaggtgtgaaaccggttggccgggttgggaatgccgtggccttccagcacttcaaggtcttcgttgaccagcaacaaattgctggcagtgatctcatcaaaacccaggcccagttgctgagtgtaataggtgccgggcgtgggcccgcgcgcggtgatctgcccggccaggccggagtcgtggccgtgttcaaacaaaatgcggcacgtgagcgccagcttttgccggtcggtccacgtattatccgccagggtgttttgcatctgcatcagtgcttgcttgaccagttggtctttggggagtgctaatgtcttggccatatcggtgtcctttgggtggtgcatggacgtcgggtttgctgctctcccgctgctcgcaaggtcgttgggtgaacgcaaatgacactaaagatgctatatgacactttgtgtcattagcaagtgaagcgctggcttttctgcatggattaatcgcagcacatgtctatccgtttgaaattactgagaaaaaaacttggcgtgaccctggagtccctggctgaaaaatccgggatgaccaagagttatctgtccaaggtcgaacgcgggctcaacacgccgtcaattgcggccgcgttgaaactggccaaggcgttgaacgtgaaggttgaagaactgttcagcgaagacaacgtcagcctcgacagctacagcctggtgcgcagccacgagcggcctgacactgcgccgggttatgcggtgttggcccatcaggtcagtgagcgcagcctgctgccgttcatcatctacccgccggcggagttcaccgacaagacgttcaaggagcacgtgggagaggagtttctgttcgtgcatgaaggccaggtggaagtggatttcatgagcgaacgagtaatcctgaatcggggtgatgcgctgcacttcaatgcgcaaaagccccaccggattcgctcggtgggcgaggtgcaggcgcagttgttggtggtggtgcacagctcagaagagtgagtgcaatcgctatttgaaatgcgatcagtgtgggagctggcttgcctgcgatagcggtgtatcagtgacagatgtgcaagctgacccaccgttatcgcaggcaagccagctcccacagtagattgcctgtgttctgaagatcagcgttcgacgggaacggataacgccgaattacccaacggatgcgtgcgcgccgcaaagaacttcagcgccacaccgctgccctcgaacagctccgaataccggcgcttctgctggcgaataaacccatcgctgcgccccgacaccgagatcgccagcgtcgtcagcctagcctggcgcaacgcatccaccaggtgcttatcctgcggcccaaggtcatggccgaagatgcacagcgcaccctcatggctgagcaactgctcataacagaacgacaaatagtccgagctgcggatggtcttgagcttctcttccaccttgccttcgctgacaaacagcggcacgtcgtccaacgtcttgattgtgttattgatcgcaaaactgctgagcaaggtgctgtcggtggacggcaatttacgcgcggtgccgtcgaggttacgcaccaagtgcaggccgccgtgcaggtagaggatgcgcgtggcgtcggtgcgcgtgttgcgcaggtcgaagctggcgtcggcgctgctgaacaggtcgtcgatgcctggcgtgtgcaggatcgcccaatagttgagcaggtcgtaattgctggtgaaaacggtggggtagcgggccagctcggcgttgatcgtcgccagcgtcgagggttgcaccagccgccacggaatgtgcacggcgtggatggtgttgatcaacgcttccttgatcgcgtaatagcggttgcgcggcgccgccgagctgaccgccagggccttgttgacccggctggtggttttcaaggcgcccaacgcctgctcgaaactgcgggtttgcagggcgtcgaacacactcagctcggaagggctgagaggtttttcttcgacggtgcgcgcgttttcgaacagcgaatcgtaggcaaagtcttcccaaatcgtgcggcttgcgccgttgccgatcagaatcccactgaagtcgatggcgctgcgcagcgcgctccagtcttcaaggtgggcgtcaatatcctggaaatccttcattgcggcgggtctactcgaattcggctggacggtgactttatcacgagcgggcgttgatcctgatcaagatgccgcaggcacgtcaggttgatcctgtaggcataacgcctctgaggattgaccatgagcagcacctttttcatccccgccgtcaacatcatgggcaccgactgcctcgacgaagccatgatcgccatccgcaactacggctttcgcaaggcgctgatcgtcaccgacgtgggcctggccaaggcgggcgtggccagcctgatcgccgagaaactggcgatgcaggacatcgactcggtgatctacgacggcgccaagcccaaccccaatgtcgaaaacgtcgagaacggcctggcgctgttgcagcgcagcgcctgcgatttcgtggtgtctttgggcggcggctcgccccatgactgcgccaagggcatcgcgctgtgcgccaccaatggcgggcatatcggcgactacgaaggcgtcgatcagtcgagcaaaccgcagctgccactggtggccatcaacaccaccgccggcacggccagcgagatgacgcgcttctgcatcatcactgacgaaacccgccacgtgaaaatggccatcgtcgaccgcaacgtcacgccgctgctgtcggtcaacgacccggcgctgatggtcggcatgcccaagggcctcaccgccgccaccggcatggacgcgctgactcacgccatcgaagcctacgtgtccaccgccgccaacccgattaccgatgcctgcgccatcaaggccatcgagctgatcagcgccaacctgcgcctggcggtacgcgatggcagcgacaaggccgcgcgggaaaacatggcgtacgcgcagttcctcgccggcatggccttcaacaacgcgtccctgggctttgtgcacgccatggcccaccaactcggcggcctttacgacctgccacacggcgtgtgcaacgcggtgttgctaccccatgtgcaaagtttcaacgccagcgtgtgcgccaagcgcttgagtgacgtggcgcgcgcattgggcgccgatatcaagggcattaccccggaagagggcgcccaggccgccattgccgcgattcgcaccttggcccacgacgttgagatcccggccgggttgcgcgaattgggcgccaagttgcaggacattccgctgctggccaccaatgcgttgaaggatgcgtgcggcctgaccaacccacggcgggcggatcagcgccagatcgaggagatctttcgcaacgctttctaaagggggcagtcgcacgctgcaagcggtaagctacaagctgaacggcatttaactaaagcatgaagcttgcggcttgccgctgaggtccccccatgagagttctgttatttggcgccaccggcatggtcggtcagggcgtgctgcgcgagtgcctgttggccgctgacgtgcaggaagtcgtggctgtcggccgtacggccttgacccaggaacacggcaagctgcaccaggtgctgcacagcgacatgctggatttccagccgctggaaaacctgctgcaaggctttgatgcgtgcttcttctgcctcggcgtttcgtcggcgggcatgaatgaaaccaagtacacccacctcacctatgacctgaccttggtcgcggccagtacgttggcgcggctcaacccacagatgacgtttatctacgtatccggcgccggcaccgacagctccgaggcgggcaaatcgatgtgggcgcgggtcaagggcaagaccgaaaacgctttgctgcgcctgccgttcaaggcggtgtacctgttccggcccggggtgattcagccgttgcatggcgtgcgctcgaaaacgccgttgtaccaatccttctattccgtactcgggccgctgctcacatttgtgcgtcggctcaaacccggctgggtcgtcagcaccgagaccgtcggccaggcgatgctggcagccgtacgccatggcgcgccgcaggcggtggtggagcaggccgagatcaatcgactggccgccgagcgcagctgatgttgcacaagagcctggtgcgtcgcctcgacctgatcacgctgcagctgttcgtggccgtgttcgaggagggcacgctgacccgcgccgccgcccgcgaagcgattgcggtgtcggcggcgagcaagcgcctgatggagctggaacaggtgctgggcgtgagcctgttcgtgcgccgggccaagggcatggacctcaccgctgcgggtgaaaccctgttgcaccatgcgcggcagatgctgttcaacgtcgagaaaatgggcctggagctgggcgagcacagccatggcgtgcgcggttatgtgcgcatgctggccaacctgtcggcgatcattcaattccttccggaagacctgcgggatttttccgcgctgcaccccgaagtcaaaaccgatctggaagagcgccccagcaacggcgtggtgcagggcgtgctggatggcgtggccgacctgggcatctgctccagcgacaccgacaccaaaggcctgcccagcgtgacctatcgccacgacaagctggtggtgctgatgccggcggatcacccgttggccagccgccacaccctggccttcgccgaaaccctcgacagcgactacgtcggcctgcatgccgccagctcgatcaacatgcgcacccacgccgccgcgcgcgaggccggcaagatgctgcgcctgcgcatccatgtgccggggtttgatgccatgtgccgcatggtccaggcgaatatgggcatcggtatcctgccgcaaaaagcctacgaactgttcggccacgcgctggggttgcacgcggtgccgctgacggatgcgtggtcggatcgccgcttgattctggtggtgcgcgatgaggcgcaattgtcgccggtgagtcgtttgttgtttgaatacctgcgcaggccgttaacgtaattcagacgtggagggccaataggtatctacacaactgccgatgcacggaacccgatcttttgtggcgagcgggcttgccccgcgttgggctgcgaagcggccccaaaacctgacgaccgagttccatttggatgaactcggcgcctgtaatggggctgctacgcagcccaacgcggggcaagcccgctcgccacggaggattgttgtgtagatacctatgctcatcgcaggcgagttgtcgttcgcgtttcgcgaacgctccttgccaactgacggttggatttgtgctgtttcagtcctctagtcttggccacacattccaagaataagaggcacaccccatgacggctccattgagcggtatcaaggtgattgagatcggcaccctgattgccgcgccgttcgccgcccggatgatggccgagtttggcgccgaggtgatcaagatcgaagccatgggccagggcgacccgcttcgcaaatggcgaaagctgcacgaaggcacctcactgtggtggtacctgcaatcgcgcaacaagaagtcgctggcgctggacctcaagtcgccgcaaggcctgggcttgatcaagcaactgctgggcgacgccgacgtgctgatcgaaaacctgcgccccggtggcctggaaaaactcggcctgggctgggacgtgttgcacgcgctcaaccccaagctgaccctggtgcgcatctccggctacggccagaccggcccttaccgtgatcgcccaggcttcggtgccatcggcgaggccatgggcggcattcgctacaccaccggcaacccggattcgccaccggcgcgggttggcgtgagcctgggcgattccctggcgtcactgcacggcgtgatcggcgcactgatgtcgctgctgcgggtcaagaccgggcagggcgacgggcagatagtcgatgtgtccctggccgaaagcgtgttcaacctgatggaaagcctggtgcccgaatacgacatgctcggccatgtgcgtgagcgtagcggtggcgccttgcccggcatcgcgccgtccaacacttacctgaccgccgacggcgcctacgtggtcattgccggtaacagcgacccgatctacaagcgtctgatgatgaccatcggccgcgccgacctggccgaggcgccggagtttgcccacaacgatggccgcgcggcgaaaagtggcttgctggatgcggcgatcacccactggaccagcagccagcccatcgaccaggtgctcgccgccctggaagccgccgaagtgccggccgggcgcatctactcagtggccgatatcgtcagcgacccgcactaccatgcgcgtgacatgctgctcaatgccgagctgcccggtggcgtgtcggtgaagatgcccggcatcgtgcccaagctctccgaaacccctggcgcggtgaactggcaaggcccggccctgggccaacacaccgatgacatcctcactggccttgggttgaccgaggctgatatccaacgcctgaaaacctcgggagtggtgcaatgatcactgactattgcgacccgctgatcgtgcaggaagtgtccccgcgcgatggcctgcaaatcgaaccgacctgggtagaaaccgccgacaagatcacgttgatcaacgaactgtccctggcaggtttttcgcgaatcgaagcgggttcgttcgtctcgcccaaggcgattccggcgttgcgcgatggcgaacacgtgttccagggcatcgcgcgcaagcccggtgtgatctatgtggcgttgatccccaacctcaagggcgcccagcgcgccatcgagtcccgcgccgatgagctgaacctggtgatgtccgccagccagacccacaacctggcgaatatgcgcatgcgttgcgaggcgtcattggccgcgtttgaagacatcgtcagcttcgccagcgactacccggtgcgcctcaacggcagcatcgccaccaccttcggctgcccgttcgaaggcaagattgatgaagaccgcgtgctgcaaatcgttgatgcctaccgccagttgggcatccagggcatcaccctggccgacaccaccggcatggccaacccgcgccaggttgaacgcctggtcacgcgtgtattgcagcatgtgcctgccagcgatctgaccctgcattttcacaacacccgcggcctgggcttgtgcaatgtgctggcggcctacgaggccggcgcccgacgttttgatgcggccttaggcggcctcggcggttgcccgtttgcgccgggagcctcgggcaatatctgcactgaagatctggtcaacctgtgcgacgaggtcgggattcacaccggcatcgatctgccgcacctgttgcacatgtctcgccgtctgccggcgctgcttggccacgaactgcccggccaggtcgccaaggccgggcgcaatagcgacctgcatccgccacccggctacatcgccacgctgtaacgccgcaccagacaacaaaaacaatcgggcgccgttgagcagcccgctggagagaaagcatgagcactaatacgttagaggcaggcctgcgcccggctgctgagatcgatgccgaaaaagccctggtcagcaaggtcgcctggcgcctgatgccgctgatcatggtgtgctacctgttcgcgttttttgaccgcatcaacatcagcttcgccaagttccagctgcaaaccgatttgagcctgagcgacaccgcttacggcctgggcgccggtttgttcgtggtgggttatgtgatttttgaagtgccgagcaacatgatgctgtacaaggtcggcgcgcgtcgctggatcgcgcggatcatgatgtcgtggggcctggccacggcggcgatggtatttgtcaccgccgaatggcagttctacggcctgcgtttcatcattggcgcgatggaggcggggtttgcgccgggcgtgctgtattacctgacgttgtggttcccgcagcacttccgtgggcgcatcacctcgctgctgttcctggcgtccgctttcgcggggttggtcggcgcaccgttctccggcctggtgttggagcatctcgacggcgtgctgcaaatgcgcggctggcattggttgtttttgcttggcggcttgccgtgcatcggcctgggctttctggtgctgacgttgctcaaggaccgaattgaagacgcgcagtggctgacaccagcggaaaagaccttgctgtccagccgaatcgccaagcatgagccgaactcacacggtggttcgctgctgtcggcgatccgcattcctggcttcttgatgctcgggtttatctacttcctgatccaggtcgcgtcttacggcctcaacttctgggcgccacaattgatccgcagcgccggcacccaaagcccggtgatgatcggcttgctgactgcgattccctatgtgtgcggtgcgatcagcatggtggtgatcgggcggctgtctgatgccaccggcgaacggcgcaagtttgtctgcggcttagtcgtattgggtgcggtgggattcttctgcgccgggatttttgccgaccacaccaccttcctgatcatcgccctgggcatgttgggcgcgggcatcatcgcctcgatcccgaccttctggaccctgccgcccaaattgctggctggcgccggtgcgggtgccgccggaggcatcgcggtgatcaacaccttggggcagttcggcggcattgtcagcccggtgatggtggggcgcatcaaagacctcactggcagcaccacgccggcgctgtacgtgatcggcgtgtgcgcgctgttggcggcggcgctgctgctgtggggcttgccgcagaaattgcgcacgctggacaagggctgatcagcccgccgtcgccaatgctcgggcaggcgtgctgctgaactgaatcaacaccacgccacccatcaacaacaacgcccccagcacgcggggcgttgtcagctgacgctccaccaggccgaacagcccgaagtgatcgagcagcagcgaagcgagaatctgcccggccatggccaaggcaataaaccccgacgcgccgagcttgggcagcagcatcaacgccagggaaataaagcacacgccaaaagcaccaccggcccacatccacagcggcgccttagtaataaacgccaggctcggcagcggtagacgcagtgccagaatcaccggcagcagcacgataatgctcaccagcagagaggccagggtggcccacagcggatggccgagcccgcgcccgaggttggcgttgatcgcgctttgaaacggcaccacggcgccagcgataaccgcgagtgccaataaaaccacccagtgcagcgtcgtcatagcaaatctcccagaggttttgctggactctaggctattcgtcgcgcaaatttaaattccaagttcttatgctgagcatgcagctgatgaatgatctgcgtcgcatcgacctcaacctgctggtgattctggatgccttgctcagcgagcaacacgttacccgtgcggctgagcgtctgcacttgagccagccggccgtcagccatgcgttggcgcgtttgcgggacttactgaatgacccgttgctggtgcgccagggcggcgcgttggtgcctaccgcgcgggcgttggaattggcggcgccactgacggaagccctggcccaggtgcaggcgctgctggcgccgaaccggtttgatccagcgtcgaccaaacgcaggtttcgcgtggcgatgtcggactacagcgcggcgattttcctaccggagttggttcgcgttctgcgccacgaagccccgggcatcgacctgcaaatcatccaggccagccgcgaaggcatggtggacggcgtactcaatggcgacctcgacctggccgctggcgttttcccggacatgcccgctgagttgcgcaccacgcccttgttcgaggagcattacacctgcctggtcgaccgccacagcctgccggccagtggcgtgctcgacctgcccacctacctgtcgcgcccgcatgtgctgctggaaatgcgtggcagcggcacgccggagatcgagcgggcgttgacggctattcgtgagcgccgacacgtggcgatcagcctgccgcattggggcgtggcgccgcagttgatccagggcaccgacctgattctgacggtgtcatcgcggggcttgctcaacatcgatcagcagcacctgttggccgtgccgccgccgtttcatatcccatcgtttgccgttgagctggcatggcatgcgcggcggggcggggattcagggttgcagtggttgatggggcaggtgcaggctgtagtgtccgacgatcattgataacagggaaaacaaaaaatgctctcaggcttcaaccacctgacccttgccgtcaccgatttaaaccgcagcgtcagcttctatcatgacctgctgcaacttcagctcgacgccacgtgggacaacggcgcctacctctcgttgcccggtttgtggctgtgtttgtcgctcgacccgttgcgcccgacggcaccggcggccgaatacactcattacgcgttcacggcggatgcctgcagtttcaccgctatggtagagcgtctgcgagccgccaaagtgcaagaatggcgcgacaaccgcagtgaaggtgcttcgttctactttctcgaccccgatgggcacaagctcgaagtgcatgtgggcgacatggcatcgcggctgcaagcgtgtagggccaagccgtatgcaggcatgaagttttacccttagcgccagaacgtgcagaatccctgcacctctcaaccgtccgtcagagtcgcgcccatgaccccatccttgctgttcgccgtcctcgcttcaggttttatttacgggattacgccgggtcctggcgtgctggccgtgttcggcatcggtgctgcgcgcggccgtcgcgccggcgcaggttttttgtgcgggcatctgctcggtgacgtggtgtggtgcagtaccgcgctgatcgccattgtgggcgcgcgtgaagtgggcagcagtgcgtttgatgtacttggcgtactcagtggtttgtacctgttctggctcggctggcgcgccattcgcacccagcgtcgcagcagcgatgcgcctcagggcgcggcgcggcatccgttctggcacggcattctgttcggcctgaccaaccccaaggcttacccggtggcggtagcgacatttacggcgcttttgtccagccgtgccgaactgctgacctgggcgatgctgccgtcgctgatcttcctgagctttattggtggcctgctggcctacgcgattctgatcggcgtggtgggcgcgcagcgtgtgcgcacggtgtatcagcgccatgaaatcctgatcaccaagctctgcggcgtgatgtttatcggcttcgccattaatgccctggcgcacgcgttgccgggcctttttggcagcaaaccggcttgatgtgatcacgaccgttcgtcgcactgggaagttttttctaaacctttgccgccctgaaaattcgaattcagggcggggtgtatgtcctcgcacttatttttgccctggaggaacccatcatgagccgcatggctatccggttacgcaccgccagtttcgcgatgctgctgggcctcggcgccagcaatgctttcgcccagtcgcctgctgaattcatcgagcaggcttcggccaaaggcatggccgatatcgaaaccagtcgcatggcccacgccaagacctcgtcccaggaaatcaaggattacaccattgaggtgatcaacgaacgcaccctggccaatcagcacttggcagcgattgccaagaagctcgacctgccagtggcgccgcgcgagaagatcgtcgacaaggctgaaaccctgatgcctgagctcaaggacggcgactcctttgacgccgcctacaccgcgcagcaggtcaaggaaaacgaagacgctatcgcactgttcaagaaagaaggtgcggcgtcggatgtgccagagataaaagccctggtggacgagacgctgcctaagctggaagagcgtttgcaaaaagcccgcgccctggcgtcgacctacggtaaaggtcatcaaggcgacggttgaatccggcacttgaaacaagaacggcggttggatgatttccaaccgccgtttttttatgcctggttcagatcggttttgttctgcacggcatcgtccactgtttcaccgcaactgctgttgaggctgacgctgccggtggcgccaatactgcggtattcattacgcagtttttccagctctttgcgatccaggccatccaggctcaacaccgcgttctgcgcatccttggagacgcgcagcaattcgtcgatcttgatgtgcaggatgtcattgtcgcggttttgcgtgttctggatcaggaacaccatcaggaaggtaatgatggtggtcgaggtgttgatgatcagctgccaggtgtcgttgtagtggaagtacggcccgctcaggctccacagaaaaatcaatgcaacggccgcatagaacgtccgggcactgcctgcccagcgggacagagattgggagactgcggagaatttcatgaccgttttttcctttacaggtgggtgatgaaattatggaccgcaggcgtgcattgaaatttctttttacaattaagccagtgaacaaagttgtacgtttttgtcgcgcacgccttagatcgccagttccgcttggcccttgccttccagcgcaagcaaatactgcttggcttgcagaccaccggcaaatccggtcagaccgcctgacgcacctatcacccggtggcagggcgcaatgatcgagatcggattgcgcccgttggcagcgcccaccgcccgcacggccttggggttgccgatctgctgggcgatctggctgtagctgcgggtttcgccaaaagggatggtcagcagtgcctgccagacctgtttttgaaacgcggtgccggtgaagtccagctccagctcgaattggttgcgggtgccggcgaagtattcacacaactgacgctcggcttccactagcaccgggctgtcgttggcttcatgcaactcacccaaaggcacgcggttggcgcgttctttttcccacaggatggcgttgagcttgccgttgcgcgccaccagggtgagctggccgacgggggagggcatgaacttgtattgatagggcatgatcgggctccttggcgtgggatggtattggaatctagagcaccttgttcaattggaaactacgtttcttgcgattgaattcggttagatcatcggtcctgttgcaatactttcaacgcagcggacgccagaaaccccgaacgacttttttcttccgggtggttcagcacatattcatcaatgcggttcaacagataacccggcaaggtaatgttgagcttctgcgctttgcccaggtatttggtgacatcaatgtccaccacagcccaggtgcagccggcgtattggggattcgctgcgtgcaaggtaactttttgcgccgtgggaatcggcgcgccatcttccgcgaggatctcgaaatgcccctcgatggcctcccgggccatggccatggcctcgtccaggtcatcgccagctgagtagcagccgggaatgtccgggacttccacgccccaggcgtggtcctcgtcaccggttgaaattgcgatggggtaaagcatgtttattgccctccaggggacgtcagctcaacagggcctgtttcaaaatgctcttggcagtcttgtccaacaggtccttctttggatgaggaatcgtcaccagccccggttttgtcgggtgcttgaagtgatgatgactgcctcgggtgcgcaccagataccagccgtccgcaacgatgtgacctatcaaatatcggctatccacaacacctccttgtggtgtgtgttggtggtgactataaccactgaataaaaattatcaacactctacctaccgacggtcgatgaccggcgttactgtaatcgttgaatgaagtgtatgagcgcctgggaatggcgccggagagacgtattgcggggtttttcgaggtgttacgcggtgtgtgaaacctgctcgagaacggccagaaatgcttcagccaatacacttttccgggttgccggcgtcagtgccagcaattgcgcacaggcatctgcttcgatcatcggtttataagtcacgcccttgttcatcaagctttgcgtacattcaggcaccagtgccacaccttgcccggcggcaaccagtgcaatgatcgaggtgatctgccgcccggtcggcccggcacgcaggggcacgccatggtgtcggtacagctgctcaatggactggttcagccccgacccataatctggcgggaacaggatcaacggataggcattgagctgggccaggctgacgtcggccagtgcggccaacgggctgtcactggacaccgccgccactaaccgctcttcacccagcgacaatgcgtggacgtctgcggtttgtggcaacagccggctcagtccgatatccagccgcccatccgccacctgtgcgcccaggctgcccgaggcgcactccaccaaggtcagctgcacctcgggaaagcgctgggcgaaggcctggatcgcctggctgaacaggtccgataaagcgattgaactgacataaccgagtgccaattggcctgcagtgcccgccgccaatttgccagcgatcacctgcgccagttcaacctgctccaacacgccgcgcgcgtagggcaagaacgcacggccctgggcggtgagggacaccgtccggctggtgcgatcaaacagcttgaagcccagctccgtctccaacgcagaaatctgtcgggtcagcggcggctgggccaagtgcaggcgaagtgccgcgcggccgaagtgcaattcttcggcgaccgtcagaaagtaacgcagcttgcgtaggtcgagcatcctgatccttgggtattgatcggttcgaaatcggtattggtttaagacccgtcggccattctataaagaccgtacaaaataaaacgagaggtttcatgagagcgcgcctgcattgtgcccgcctggccctgtttctgtgtggctgcgcggcgtttctgaatctctatgcgacccagagcatcctgcaaactttcgccgcgcagtttcatatcagcgccaaggaagcggggtggagcatcacggtcaccaccttggccgtggcgatcactgcgccctttgtcagccgactgacggggcgctttgagcagcgcacagtgatcgccgtggccgcgctgttgttggcgctgccggcgctgatgaccgcctatgccgacagctttgcccaagtactggtgtggcggtttgtgcaaggcatgttgatacccgtggtgttcgccaccagcgtggcctacatcggcgaccgttggcgtggcgcaacggtgaccgaggtcaccagcctttatgtggcgggcactgtgttgggtgggttcgccgggcgtttcgtcaccggcgtgatgactgagtatgtcggctggcgggaagcctttgagatgctgtcggcacttagcctgatggtcggtgggtttattcaatttctgctgcccgctaaccagccgcgaagcgagcggcgcaaagtctcttcctcaggcgtgtttcgccaacctttgctggcagcgtacgccgtaggtttttgcgtgttgttctcccaggtcgcggcgtttacctacgccggtttgtaccttggcctaccaccgttcagcctggggcctgcagcgttgggcacgctttacatggtgttcctgctggccttgatcgtaattcctgtcgcagggcgcctcagcaaagctcggccccacgccgaactgctggcggttgccgccgtgcttggcgtcagtggttcggtgctgaccctggcaccgtcgctgtggtgcatcgtggtgggtttggcgctcagttccactggcgtgtttctcgcccaggccgccgccaatgccttcatcagcgccaccgccggtgacaataaatcgggcgcggtgggggtttaccttacgtgttattacctgggtggcagttgcggtgccatcgtccctgcgttgatctgggagcattggggctgggcgggctgcgtggcgctgattgtcggttttcaaatgttgaccctgctgatcgccctgaccggctggaagccccttaaacctgagctgatccaaacgccatgaacgacaccgtggccttgcctgccaacgaaacatccagccgccgccgttcgctgatcgccggctgcagcgcccatgcggtgcatgatggcctgactgacgtgatctatgtgctgctgccgatctggcaagcgcagttcgctctttcgtacgcccaaatcggccttttgcgcggtgcttattccgggatgatggccgtgttccaactcatggccagccgcgccgccaaacgctggggccgcgtaccgttgctggtcggcggcactgcgctggcgggtgtggcgtacttactggtcgggcaagccacagggctggtgatgttgctgttggcgttgctgctcggtgggttgggcgccagcacccaacacccgctggcgtcctcgatgatcaccgacgcttatgaggacggcggcggggtcaagcaggccttgtcccagtacaacttctccggcgacatcggtaaaaccctgattccgggtttgatcggcttgttactcaccgtcatcagctggcgcgccagtgcgacgttgctggggctgcttggcttggtggcagcggggttgttgtggtggttggtgcctgcgcaggttgccgaatccggggtcacaaaaaaagccagggcgcgcagtgggacggggtcagttacagggttacgcgccctgatcctcaccggcaccctcgacagcgctgtgcgcatgggctttctgacctttctgccatttttgctgcaagccaaaggcgcaggaacagccggcatcggcctggcgctgacgatgctgttcattggcggcgcgttcggcaaattgctctgcggctacctcggtgcccgcatcggcatgatgaaaaccgtctggctgacggaaaccagcacggcgctgctgatcgtcgccgccgtgtacctgccgttgagtggcttgatggtgatgttgccgctgctgggcttggcgctgaacggcacgtcttcggtgctgtacggcgcagtgcccgacttggcaggcgcaggcaagcgcgagcaagccttcgcggtgttctacaccggcacgattggcggcggcgcgctggcaccggtggtgtttggcggcgtgggggatgcgctgggtgtaccggtggcggtgatggtgctggcggggatgttgttggtgacgttgccgttggcgtgggtggtgcagcgggggacgaatgagtcgagttgaccctggcaattacatgatgcgcaatctatccattcgattatgcaggacacgcacgaccttaattccatacgtgctgatctgaaaataaatcgtgtgcctctcaatgatttggtggcggtagcctgggcggatgtcgtcgcaggctggggcagcctttggctgttgcgtcagttgctcgaacgccttcgtcatgatgtctatgtaacggttggcctgttcgactccccacgtctgagcgctgtaaaaccagatgccttcaaggtctcgctctgctgcgggtgtaagtcggtattcagccatgggtttttaacattcgtctcttgaacgcatcggggttgaatgggcgaggttcgccgctggactcgccttccctcaacgcagctcggatggattcaatctcagcgctacgttcttgttcgcgcctgatcaaatcgcggatgtattcgctatcgttggtgtaatggcctgcttctatctgcgccttgatccagccgtcttgttggtcggtaacggtgatggttttacgtacggttcccattgggaaatcttcctgccattaagtgatagcgtaaaatctatcatactattggtgccaaatcgtgcgcttgggatgattggtcgtgtcagcaggccgatatcaaaaagctctttctcagagcatcgttgcgattaagttcgggagaatgacgcgaatgaagaattgatttcaaacgatctttatggggttttattacttggaattgccggtgtctctttgcggccccttcaaaacgatgtgctcaacgtaaacggaacccgcaacgcaccaatcggcccttcccgaacaccgcacatttcatcgtgcacacagtgctgcaccagcacgcacgggaacggcggaactcgttgcaacaggtcgcgcaaatgcgtggtggagccgatgcgcataggcttgccaacatcgtccaccagcgtcagctcggcatgctccagcctgactcgcgcaatgtagaagccaccctccagcgacagcaactccagctcgcgtacctcgccgttaacggccaattcggtcagcattttcaagttcatgattcagcctcactgtgagccattcattggcgacggaagaacaacgtgacctggccaaattcgacgccgaatttggtcatgctggaacggttgatcaaggtgtcgtcgtccatcaagtacatccagtcatcaaagctgacctcgtagaccgagccgtccaccggcaggttgagacgatagcgccaacgcagtgcgttgcctgccacttcgccgatcgcctcgccgaccacatcgcccgctcgaccgcgccagcgtcccgggccatccggtgtcagcgtccatactcgctgttggcgcgtgccatcgctgtagaggaagcgctcgtcgagaatcaaggcgtcgccctcgcgtcggctggcgatattgacctcaaagcgcttggccacttcccccgagcgcttctggaaaatcccccaggccttgacgggcttgctgaagaagcgctccaggtccagttgtggcttctggtcggcgtaatgatcgacgcctacgttgccgcaactgctcacactcaacaccagcaacaatgaaaccaatagacgtgtcatggccagattccgtgaacgtgatggtgcgcggcgaagcgccaacgcttgtcactgatacttgtacattaatattgatttgtacaggtttgcgcgagacgaatggcgaattgttcaaatcgcgcccataaaaaaaccggccaccaagggccggtttttttatgcatcctgcgccagaaccttcctgacgcaagcgctgaatctgagtggagcgggtagagggaatcgaaccctcgtcggaagcttgggaagctactgttctaccattaaactatacccgctcagagcggctgactttgtaccagatgttcgtcgggatttgaagtttttcttcgaaaaatgtgcgggttgcatccaccaggctcctgtgggcgctggcttgcctgcgatagcatcgccgggccgtgactgaccgaccacggcgcctgcatcgtgggcaagcccggctcccacatgagcggtgacttcagattgcaaacgcatgttgcgtctggccttggtgataacgcaagcgactcacctgccgctgcggttgcaaaaagcccaccactgcatcacggctgtcgcggcaggccgctttgtgctccatgtccagaaagtgcccggtggcctggatggtgctgaagctgctgttcgccacgtgctggccaaacagcttggcgtcctcggcgctggtgtattcgtcccattcgccatttaaaaacagcactggaatattgatctgccgggcggccttgaggtagcacaagcggtcgctgttaagcacatggctgatgtgaaagtgcatctgcccatattcgtgctcggccaggctgctcacgtgtttgtaattgaaacgtttgaacagcgacggcaggtgcttgccgatggtgctgttgaccaggtggccgacgcggtcgcggtcgaggttgccgaggtagtcgacgccgcgctcaaggtagtcgcgcatcggcgcgttgatcaccggcgagaacgagctgatcaccgccttttccacgcggcggggccgatgggccagggcaaccagcgtggccgcaccgccccaggaaaacgacagcacgtgttcggcggcgaagtggtcgataagctccagcagaatctggccttcgacttctttcgtcagcatctgctcatggcggttatggattttggagcggccagcgtagggctggtcgtacaaaaccacattgaactgcgggtacaggcttttcacggtttggccgaaagaggccgtggtggccatggagccgttgaccaggatgatggtcttttcagcagcatccgcgcgatagaactccgtgtaaacccgatactgaccctgtatatccaacacagcgatttctggcctcatgtcgtaagactcctggcaagcgggtagggcgcgcagatcactctgcacgagctttatgacaggtaggcatacgcctggaagatgagcgcccatgccggtccgatgacggttggccgacggctgttgttatggcgggctgtttgcctgagaggcccgtggatcaagcgcgggcgcggcaaggtgtttcttggaggttataggcgactcgccagtcataatttggctgacgtcttgattcaagcagtagaggtgctacctcgcaaggcgccgaactggttttttgccatcaccggccgaacggtcgtcagacttgtgcgatttcgtcgtcggtcaacgcccgatattcgcccggcgccagtaaatcatccagcaccaaagcccccatgcgctcgcggtgcaagccgatcaccttgttatcgaaatgcccgaacatgcgcttcacctggtggtaacggccttcgacgatgctcagccgcgccgtcttcgggcccaacaattccagttcggcgggttgggtggtgaggtcttcaaaggcgaagtacacaccggctgcaaacgtcaccgcgtactccggggtgatgacctgctcggtttccacgcggtaaaccttgggcagcttggtttgcggctgggtcaggcgtcgcgaccattggccgtcgttggtgatcagcatcagcccggtggtgttgaaatccagacgaccggcgatatgcagctcgtccttgtccggttcatccagcaagtcgagcaccgtcgggtgctgcgggtcggtggtggcactcacacagcctggaggtttgtgcagcatgaaatagcgcgccggtttgccgacttgcagcacctcatcgtcaacgcacacgcggctgaactcgcgcacttcatggtgtggatcgctgacgaccacgccatcgaccgtcacgcgtcgctcaaccagcagcaggcgcacttgctggcggttgaaacgcggcaggttgctgaggaaacgatcaacgcgcattacgtttgctcggccccacgcaattgcgcctccacctgggcacaccgtgggcacaggcaagcggtgttgcgcagttcatccggcagggctgcaagcaccgccgggtcgatggtgacgctgtagcaccagcaggcttgatcggcggtgcgcgggtcggccagggtgcagtcgttgcgggcaccgcaggcggggcaaagggttggggtggtcatgtcggttcgtgctgtatcgcgcagttccccgcacgatacagcgccgccgcgctattgcaagctgcgcaggtagccgcgccagccgccgaagtggctgatgtccacggcgcccgccaggccgtagggttcgcagatgaagccggtttcccagcgcccgtccgccagttgcaccttgccaagccccaatggcgcggggatgccggtcaggaatgagccgagttcggcgctcggtagttcccacacttccacttcgatggctacaccgttttcgctgacgcgcagcatgcccggccgatagggcggccctccggccagggcgaacagttgatagtccgccgagctgtgggtgcgctcgagcaagcgcgccccacggcgcagcaattgaccgttaagcgccagcccttgcaggtgcgcgccgcacaccaccaaccgcgtgtggtcatggctggcggggcctggcggcgcgctgagcgaagcatcctgctggcgctgcagtgcatccgccacgcccagcaggtattgatcggtaaacgcccggccaaacaccgtcacgccccatggcaacccgttctccatgaaaccgctgggcacggcgacggcagcgtagtccagcaggttcatgaagttggtgtagtagcccagttcggcattgcgcagcaccggttcggcacgcagttcttcgaggctcaccgggcgaccgatggtcggcgtcagcacgcaatcgagcccgtccagcaagcggtcacagtgcgcttttaacgtttgcagacggtattgcgcgcggaaggtatcaacgccgctcaccgcaggcgccttggccagcacggcacgaatcaccggcagcaccgcgtcgggctcacgcgccatcagttcaccggcgacgctgtagcgctcggccacccacggtccttcatagagcaggcgcgcggcttcgaggaagggcgacaggtccagcgtgacgggttcgccgcccagcgcaatcaaacgctcgatggcctgctggaacagctgtgggccttgctcgcagccaaagaattccaggtcctgagtacgcgggacgccaaagcgaaacggcctcggcgcaccaaacgccgaggcgtcattccacgccgggttctggcggctgtaggcgtccagcgggtcgagcgtggcggtcaacgccagcaattggctggcttcgcgcgcggtgcgggtaaaggtggtgacgcaatccagcgtgcggcacgccggcaccacacccgccgtggagatcagccctttgctcgccttgagccccaccaggttattcagcgcggcgggcacacgcccggaaccggcggtgtcggtgcccagggcaaaactcgcgacgcccagggcgacggccagcgacgagccggcactggaaccgcccgacgggtactcgggcagcacgctgttcgggcaagcgccatacggcgaacggctgccattgagcccggtggcgaactgatcgaggttggtcttgcccaacggcaccgcgcccaaggcgatcaactgctcgacaatcgtcgcgctgcgcggcggcacataggcaaacgccgggcacgccgccgtggtgggaatgcccgccaggtcgatattgtccttgatcgcaaacggcacgccgaacagcggcagttcagacggctcacgggcgtccagtgcggccaggtagggctccagttccgccacgctgagcaggtggataaacaggtgataatcggggttcaactgcgcggctttttcgcgcagttgcagcagtaattcgcgcggcgtggtgtcgccgctgaggtaggcattgcgcaggttgtccagttgcagattcatggcttgtccgcctgtgtaaaaagaaaagtcagtcacgttccagcaccaccacccgttgcccggcgccaatgccgctgccgggttgcaccgggatctcgcgcacggtgccggcgaagggcgccaccaccggaatttccattttcatggactcaagaatcaccagcacgtcgccggccgcaacccggtctccggtcgtcacctgcacctgccagaggttgccggcgatcgggctgtcgacgctgacctcgttggccagcagcggcgtggcttcgcccagcggcgcggccagttcttcactgtcgtaatgcgcctggccgctggcgatccagcgctcgcgctcggcattgaacgcgtgctgttgatgctcacgaaacgcgccgatgctcgacgcttcccgcgctagaaacgcctggtaatcggccaggttcaattggctgtgttcgatgctcaatgtgaagcggcccaacgggaaatcacggcggatctgcaccagttcatccgcactcaccggatagaagcgaatctggtcaaagaaccgcagcaaccacggcttgccgtcaaacgccgcgacttcgcgatagcggttccacatctgcaacgtgcgccccacaaactgataaccgcccgggccttccatgccgtagacacacaggtaggcgccgccgatgcccaccgagttttcagcggtccaggtgcgcgccgggttgtatttggtggtgaccaagcgatgacgcgggtccagtggcgtggccaccggcgcgccgaggtagacgtcgcccaggcccatcaccaggtagctggcgtcgaacacggtatggcgcacttcgtcgaggttggccaggtcgttgatacgccggatgaactccaggttgctcgggcaccacggcgcgtccttgcgcacggtagtcatgtatttctcgatcgccaactggcacgccgggtcgtcccacgacaacggcaagtgcacaatgcgcgagggcacttgcaggttttgcgtggcgcacacggcggcccactcggtggtgatcagcggcagcaaatcggccaggggcagttgttcgggctggtagtggatttgcagcgagcggatgccgggggtcaggtcgatcacgccctgcaaggcgcgggcttgcagggcttgcatcagcgcgtgggcacgaaagcgcagcaccaggtcgagttcgggcgcgccgatttccaatagcaaatgggtgtcgccggcgaggcgcgcgacgaggcgggtgtcgtcttgcccaatctccaacaccaccggcgactcgatcttatgtggaccttgctcaatgtgggagccgggcttgcccgcgatggcatccatgcggtctgcctgcagtaccgagttgtctgcatcgccggcaagccagctcccacattgatcccatttcaaggcgaggtcgcgggcggttttgaggtccacgggctggaagcgaatcttgtcacctgccttgagttgcccgagctgccacaagtccgcctcaatcaccgtcaccgggcacacaaacccacccaggctcggcccgtccggccccagaatcaccggcatgtcgccggtaaaatccaccgccccaatcgcatagggattgtcatgaatgttcgacggatgcagccccgcttcgccgccgtccgtgcgtgcccacgctggcttggggccgatcagccgcacgccggtgcggctggagttgaaatgcacttcccactgggtggcgaagaaggtgtcgatgtactccggcaggaagtattccggcgcgccgtgggggccgtaaatgacccgcagcgtgcgcacgtccgtcagcggttcggcgatcaactgctgcccggcgctggcgtctgccaatggcaaaacatgcaacacatcacccgcgcgtaaagcccgcccgccgtgcccgccaaactggccgagggtgaaggtgcttttgctgcccaggtagtccggcacttgcagcccgccacgcaggcacaggtaactgcgcgcacccgaacctgcgagtgtgccaaggctcaataccgcgcccggttctatcagcagcgcggtgttcatcggcaccgttagatcattcaacaacagtgggatttctgccccggtgacggcgatcaccgccgcacaattgaagcgcaacaatggcccgctcatggtgatttccagcgccgccgcgccgtcgctgttgcccagcagacgattgcccaggcgcagcgcccggctgtccatcggccctgagggcggcacgccgacggcccagtagccgaggcgcccgggataatcctgcacactggtttgcgtgccggcactgagcacttcaaaggtgtttgcgcggtagaccaggtcttccaggcaacgcgtccacgggcggccgctggcgaagggcggggcgagcaggatctggcgcaggaaatcgcggttggtttccacgccgtagagctggctgtcgctcaatgcctgatgcaaccccaggcgcgcctgttcgcgggtcggcgcccaacggatgagcttggcgatcatcgggtcgaagtacggcgcaatctcgcagccggcttctacccacgtgtcgatccgcagcccatcggccaccgggaagtccacgcgggtcaacaggcctgggctcggctggaaatccttgcccgggtcttccgcatacagccgcgcctgaatcgcatggccgtgggggttcaaatccagtgtattgagcggcggcatttcgcccgccgccagctgcaccatccagcgcaccaggtcgacgccccagacttgctcggtcacgccatgttccacctgcagccgcgtgttcacttcgagaaagtagaagcggccgtcggcgctgtcaaagatgaattccacggtgccggcactgcggtaatttaccgccttggtcagggtgatggcggccgcacacaaggcctcggccatgccgtcgggcaggttcggcgcgggggtttcctcaaggactttctggttacgccgctgcacggaacagtcgcgcacaccgagggcgatgacgtcgcccgcgccgtcgccgaacacctgcacttcgaggtggcgagcgtgctcgatgtacttctcgataaacacaccggcgtcgctgaaattgttctgccccaggcgtttgaccgcctcgaacgactcgctcaattcggccgcgctgcggcacacgcgcatgccgatgccgccaccgccggcagtgcttttgagcatcaccgggtagcccagcgtgtcggcggccaacagcgcagtgtcgaggctgtcgagcagttcggtgccttccagtaatggaatgtgatggtgcttggccaaggcgcgcgcggtgtgtttgaggccgaacacacgcagctgttcgggcgttggcccgacgaaggcgataccggcgctttcacaggcttcggcgaaggtggcgttttccgagagaaagccgtagccggggtggatggccgtggcgccagaggccttggcaatagcgaggattttttccaccgccaggtaggtgccggctgccgcgccttcaccgaggctgtaggcttcatcagcttgctggatatgcaggctggccgcgtcggcttcggcgtacacggcgatgcccttgacgtgcagttcacgcaacgtgcgcaggatgcggcaggcgatggcgccacggttggcgatcaacagtttttcgaacatggcaaaaccctgcgggccgtcccgcaaaaggataaacactgcggtcgtccggagtgcatgcggtcagtgtgggagccgggcttgcccgcgatggcggtgggtcagttaagccacttttagctgataggccgctatcgcaggcaagccagctcccacaattgatctctattgtttgtgcaggcactgcccggcgcgggcttggcacagggcgaacaaccacttacgcaaccgtttcattttcagttccataccaataactccgcaggggttgggttgtaggcgttgcacgggttgttcagttgcgggcagttggaaatcagcacgatcacgtccatctcggcgcgcaaatcgacgtatttgccaggggcggaaatgccgtcttcaaaggtcagcccgccatcggcggtgaccggcacgttcatgaagaaattgatgttcggcccgatgtcgcctttacccaggcgcccgtcgtgggcgcaggcgcgcaggtagttgtcgcggcagctgtgcatgtagcgtttttccagggcgtagcgcacggtgttgctctcttgggcgcaggcgccgccgagggtgtcgtggcgcccgcaggtgtcttccacgatggtcagcatcggttggccgaggttggaatacagcacgctgccggtgctcaggtacacgcggttttgccgacgcaaggtgcgctgcacgtcgtagcgttccttggggttttggcggctgtagaacaacgtgtcgacggcctggttgccctcaaggtcaaggatgcgcagggtctggccggccttgacctccatcagccacggctcgccggcgggaatggtcgcgcggtacaccgcggcgtcgggttgtttcagtgcgatagacatggcagctcctcaggcgaacaggcggtcggtgttgataaagccgcgctcgttttccgggcgcgacgtgcggcagtgttcggcgacgctggggtcggcgttcatccagctcaatttcaacggttggggcgcgtagtttgggttggggtccatcgggtgttgcagggcggtgagcaccaccagcgtgtccatcggcgcgtagagttcgatgtagtcaccggcttttgaattgcctggttcaaagtgcaaaccaccgtcgccatcgacgctgacccggctgaacaggttgagggtcatcagcaggtcggagagccccaggccccacttgccgagttccaccagcaggttatcggtgccgttgcggaaaaagccgttgcgcagttcctgatagcggccctggccgtacttctcggccacctcggcggcacacaacacgccgccgatgctgtcgctccagccgcaggtgtcggcggtgatggcggccagcacgcggcccatgtccgagtacaggcaatggccgcgggtgagcttggcggtgtgttggcatttgaggctgtcgggcaggttcaggcgctcggttttttcattggcattgagcaaggtcaggctgacattggcgccgccgcgaatgtcggtgaggcgcagcagttggccgcgcttgagcacgaaggagcggtggccgccgccgggcagcatttcttcggcgaatggtgggaacagttgagtcgaatcgttcattgggcagtggctccaagttcggcggcgagcgctttgcggcgcgcgctgttcaaagggatgtcgtaggtgatacgggcgccataggcgccgggggcgtggggatcgacgcggactttgtcgaagaccagcaagcgcgtgcccaggctgaaaccttcgctgagatcgtgggtgaccatgaacaccgtcagccgggtttcgcgccatagctcgagcaacagctggtgcatgtctttgcgaatgcccgggtcgagggcgccgaagggttcgtccaacagcaatacgcgcggtttcatgatcagcgcctgggcgatggccaggcgttgttgcatgccgcccgaaagctgcgccgggtatttgtccagggcgtggccgaggccgaccttgagcagcaacgccgccgcctgttcccgggcctgctgtttggccttgccgaacagccggccgagcaagggcgcgcgcggcaactccaggcccagggcgacgttgtcgagtacggtcaaatgcgggaacaccgagtagcgctggaacaccaccccacggctggcatccggctcggcggcgagcgcttggccgtccagcaggatttggcctttgctcgcggtttcctggcccagcagcaggcgcaggaaggtggatttaccgcaaccggaggtgccgaccagggtgcaaaattcgccctcgtcgacgtgcaggttaaggccttccaacaccacttggtcgccgtagcgctgccacacattgttgacgctgataaagctcatgcgcgcgctccttcgtaccaggggaacgcacggcgggtgagggttttcaggccccaatccatcagccaggcgagcagggtgatccacaccacgtagggcaagatcacatccatcgccaggtagcggcgcaccaggaaaatccggtaacccaaaccgtcggtggaggcgatggcttcggcggcgatcaggaacaaccacgccgagccgagcatcagccgcagcgagatcagcaggcgcggcagcaattgcggcagcaccacacgcagcatcagcgtccaggtggaggcgccgagagtctgtgccttgaccagcagctcgacgggaatttcccgcgcgcgctgctccagatcgcgcgccagggccggggtgatgccgatgacgatcagcatcaccttggacaattcccccagcccgaacacgatgaacagaatcggcaggaccgccagcggcggcaccatcgacagcacggtcagcagcggcgaaagcggcgcaccaaacagcggcagcgtgccggcggcaatccccaggcacaggccggcgagggcgctgatgcctaagccgatggccagtcggcgcaggcttgaggcgctgtcttgccaaagcacgtattcgccggtgcgagtgtcggcgctgaacgccaggcgctttatggcgtcgcccatttgcatggcgctgggcagcagcttgtcgttggggttttccgccaggcgctccgctgagcctacaaagtaggcgaacagcagcaacgcgaacggcaggatcaccaataacaggcggctggagcgttccgggtgacggttgatcaggcgcatggccggggcctcttacagcgtgccgtcggcggccatctgcacgtagcgggggtcgaagtgcagcttgaggttggcggtgtcgccgctggtcacgccattggcgaagctcatgccgacggcgctggtgtccttggcaccttcgccgagcaggccgtgttcaaacgagaactcggcgactttgcgcatggtcgccggcaactgcgcgctggtggcgaaggccagggcttccttgggcgtggcgaacagcttggtggtgtccagttgcgcctggaaacccttgaggtcggtgccggaggccttggccatgtgttccagggcgtcggtgctggcggcgttttttgcgttcatcagcgccaccacttcaaaccaggcgccggtgagggctttgcccagcgccgggttgtctttgagggtttgggtgttgaccaccatcatgtccatgatttcgccgggcactttgctcgagtcgaagacttgcgtgacgccaggcttggccttgatctcagagagcatcgggttccaggtggtgacggcttgcacttgattggtgttgaaggcggcggcgatatcggcgtcggaggtgttgaccactttcaggtctttttcagtcaggtcggcggactccagcgcgcgggccagcaggtagtgggaaaccgaaagctccaccaggttgacgttcatgcccttgaggtcggccacggtcttgccggtgcccttgatcaccacgccgtcgttgccattggaaaagtcgctgaccaccagcgcggtgctgtccacgccaccggcggcggggatggtcagggcgtccatgttggtcatggtgcagccatcgaactggccggcggtgtattggttgatcgattcgacatagtcattgagctgcaccatgtcgatcttgatgccgtacttcttcgcccatttgtcgaggatgccttggctgccggcatactcccacggcatccaaccggcgtagatggtccagcacacactgaagtggtctttgacggcggcggcttgggtctggacgctcaacacggcggcgaaggcggcggcgagcaaggcgggtaaacgcggtagttgcatggggtttctccagttgatcgtgggcgggcagggagcaacgcggcaccgtgaacggtggcttgtctcccgggcttttatcccgccgtgtaacctcaactggaggtcgccaactctcggaccagccactcgcgtcaagcgagccggaaccctagtcagccattgcaaattgtggtgccgcgaacctgtgatgaatcctgcacgggttaggcaaagcgagagtcgtgccaagtgcgcacaggcccggttttcagccgggcaggcgggtggtgagggcggatatcgaggggcgagtgcgccaagcgggtgcgctggcgcactgcgatgaggcggttacagcttgaacttgctgaccagcacgttgaacgaggtcgccaggcgtgacaggtcttggcttgaggcattggtttggtgcgcgccggcggcggtctgggtcgacaggtcctggatgttgagcaggtttctgtccacttcgcgcgcaacctgagcttgttcttcggacgcggaggcgatcaccaggttgcgctcgttgatcatcgtcacgctggcggtgatgcgctgcaacgcttgcccggcgttttgcgccaagacctgtgtgtcgttagcccaactcaagcttttgttcatggcggcaacggcgtcatcggcgccgacttgaacatcgccaatcattttttcaatgtcgaccgtggaggtttgggtgcgatgggccaaggcccggacctcatcggcgaccacagcgaaacctcgaccttgctcgcccgcacgggcagcttcgatagccgcattgagtgccaacaggttggtctggtcggcgatgctgcggatcacatcaatcaccttgccgatttcgcgcacctggttggcgaggtccgcgaccgattgcgtcgaatcgttgatctcgaccaccatcgattccattcccgacacggcctgctccacttgctggcggccttcctcggcttcggtggtggcctgatgggatgcttgcgatgtcgacactgcattgctcgccacttcgtccactgccgtcgtcatctggttcacggcggtggcggcttgctggatttcgtcattctggcgggtcaggccacgggtgctttcatcggtcaccgcactcagttcttcggcggccgacgcaagctggtcagcagcgttggcgatctccaccagggtgcttttgaggccgccctgcatctcagacagcgccatcagcagttgcccggcttcgtcggttcgttccgtgacgatggcgtgggtcagatcacccttggcgatgcgttgggcgctttggaccgcttgtgcgatagggcgggtgatcaggcgtgtgatcagcagaccgatggtaatcgcaatgatgaaggccaggacgatgccgcagatcatccaggtcaatgcgctgtcgcgcaggtcttcggcggcgatcgcgccttctttgatctggcggttattggagtcgatcatcacgcggatcagctcgcgggcctggcggaacagttcattgttgctggtattgagttgcgtgcgggcctgttctgcctggccgctgtcgagcatcgcgatgatgcgttcggagttgctgacgtaatttggccagagctggtcgagcttgtcgcccgccactcgttcatcatcttccaagggcgtggcgcggtaggtggcatacgccacctggctgcgcttgagttcgttgctgatgtcctgacgcacgcggtcacggtcttgctgggtaacgtcgcctttgctggcatccaggagtcggtacaggccacggttgtgggcgaccaggccattgagcgtggctgatgtgttgctgacggacaccaagttattggagaaggtcagctccaaggcgttagccagtctaacgacgcctttgatccccaataagccaacgccgagggtgacaaatgcacacagaacaaacgagagcagcagtttggttgagattttcatggcttggatccgacgacagtaagtgggggctcgcgctagagcctccttgctcccgatcgatatcacaatgacatcatcgcaattgcggaagtttcagggcaactgaaattacttaatcgattaagccagcgcatcggcggcgttcaatgcctgcgtggttgacacggggggcacccgccgtcggtacaggtgtatcaagctgttacgaaaacgcaccagattcggtttttgatgtcagatatttcgtcattcaatgaacgacgaatgccgcccttcagcgtcgctgaaggtgctctccagcggtccaggaggccgccatgtatcgacgaatgcttcttagcgctttattcggcctgaccctgtcagcgtgcgtgccctattacgatggcggtgccacttactaccgctccgaggtctacaccgcgccggcgccggcttattactacggcggccccacttacctgtatgggcgtggctactacgcgccaccgccgcgctactattccgcgccgcgttattaccagcctgcgccgaactattaccctcggcccggctactacccacggcccggctaccggccatacccgaaccagggctggggcgggaaccgttggggcaatggtggcggtgggcataatcagggcggcaaccgtggcggtggccatggtggcgggcaccgttagacgtcggacaaatccgccagcggatggcggccttcccaggctttgtggaagtgcgcttctaccacggcttgcgggatcgcattgatgtccggccagtgccaatgcggcgtctggtccttgtcgatcaaccgcgcgcgcacgccctcggcaaattccgggtgacggcagcagttcaggctcaaggtgtattccatctggaacacctgggccaaggacagatgccgcgctcggtggatctgctcccacaccaggtgcgcggtgagcgggcaaccttcgctgagggttttgccggcgcgactgaacagcgggtcggcgtggtcgcgcaaggggctcaaggcccgccaggcgcaacgcacatcgcccacatccaaccattcatcgatctgcgcacggcgcggtagccattgcgcctcgggttgctggccgacggcttcctgggccagcgccttgagcaggctgttgagctgcatcgcggtttgttcctgccagttcagttgcagcaggccttcaatcagttcgtcctgttggtcatcgcgcaggaagcggtcggccaaacccaggtccagggcatcgcgaccgttgatatgcgcgccggtgaggcccagaaacaaccccagcttgcccggtagacgcgacaggaacgaactggcgcccacatccgggtacaagccgatgctgatctcgggcatggccaagcggctgctcggtgtgacgatgcgcaccgctgcgctttgcagcaggcccatgccaccgcccagcacgtagccgtggccccagcagatcagtggtttgggataggtgtgcaggcgatagtcgaggcggtattcagcggcaaagaactgtgcggccagggcgggcacctcgccggggtgttcacggcaggcctgggccaggctgcgcacttcgccgccggcgcaaaaggcttttgcgccgttgccgcgcagcagcacgcaggcgatgttcgggtctttggcccagctatccaggcgttcgctgagggccaggatcatcggcaaggagagtgcgttgagggacttttcagcgtccaggctggcgatgccaaggcgggcaccgtcgctgccggtcagctcttcgaagtgcaggttcatcgtgacctcaatcgagaaagtgaacgatcagtatgatcgctccgtgggaaagtgccggttgtgtgtcagatcaattgacaagcggggtcggctttcctagggttcgcccattctttttttacgcgacgaacacaccatgaccgaaggcgaccgtatcaaactcgaacccagctggaaacacgccctgcgggacgagttcgacaagccctacatggctgagctgcgcgagttcctgcgccaggaacacgccgccggcaaagagatttacccgcctggcccgctgattttcaatgcactcaactcaacgccgttggacaaggtcaaggtggtgatccttggccaagacccgtaccacggcccgggccaggcccacggtttgtgcttctcggtgcaaccgggcgtgccgacgccgccctccctggtgaatatttacaaagagctcaagcgcgacttgaacatcgacatccccaaccacggttgcctgcaaagctgggccgaccagggcgtgctgatgctcaacaccaccatgaccgtggaacgcgcgaatgccaacgcgcacgcgggcaagggctggcagttctttactgatcggatcatcgaagtggtcagcgagtatcagccgcacttggtgtttttgctgtggggtgcccatgcacaaggcaagcaaaagctggtggatgcgaccaagcacctggtgctgacgtcggtgcacccttcgccactgtcggcgtatcgcgggtttctgggctgcgggcatttcagccgcaccaacaagtttcttgagcagaatggcgagacgccgattgagtggcggttgccgccactctaaaggttaaccgcaacccaatgtgggagctggcttgcctgcgatgacgatctgtcagccgatatatttattgactgaaccaccgctatcgcaggcaagccagctcccacattggaattttgtgaaggcttagattttttccggctgacggttccagtgccggaacaacggttccgccagaaacagcacaaacaacaagcgcatcacctgcatcgccgtcaccaacggcaccgacagttgcaaggtctcggccgtcaggctcatttcagcaataccgcccggcatcatgcccagggtgagtgagcgcaagtccaggtgtgtcaatgcactcaagcccaccgccgccaacgtcgccagcgccatggtcaacgccgtgcctagcagcgtacgcgccatgaacgacggtgcccggcgaaagaactgacggttgaagtggcagcccaaaccgctgccgatcagccattggccgatctggctgccgccatcgggcaggccgatgtgcaaatcccacacaacactggcggtcgcactgaccaacagcgggccgaacagccacgggttgggctgacgcaaacgctgccagccccaggccaccagcgccccaagcggaaacagcagcgccagccacgcccagctcaccggtgccggatgaaactgcggcgcgccgccttccagcacgtacttgaagatcgccggcacacacaacaccaccaccagcacacgcagactctgcccggccgcgacacggctgagcaccgcgccattgcgcgcgcccaggttgaccatctcaccggaaccgcccggcatgctcgagaagaatgcggtggcgcggtcttcaccactgcggcgcatcaaccacacgccgacaatgctcgacaggctggtgaccagcgcgccgaaaaagatcaggccgaagtggctcatcacctgctcgatcaccaccggggtgaagtgcaacccgatgccgatgcccaccacccattggccgcatttgcgcccgccgggaatctcggccaactgccacggtgtgaggcaacgcaccagaatgatcgccagcaacgagccgaccatgtacggcaaaggccagccgacgaggctggccaggtaaccgccggccaggccgaccagcggtgttgcccaccattgtttaaaggtgacctcagacatcggccagggcacgacgctgcagggcacgtttacggtagatacggatcagcgggaaagccagcatcagcgcggtgagtacccaaaccccaaaggtgatcgggctggaccagagaatctgcaggtcaccgttggaaatcgacaacgcgcggcgcaggttctgttccatcaggccaccgaggataaagcccagcagcacgggcgacagcgggaagtccaacttgcgcaggatgtagccgaagatgccgatgccgaccatcaggaacaggtcgaaggtggtggcgtgaaccgcgtacacaccaatcgcggtgatgatcgcgatcaccggcaccagcgcccagttcggcacggcgaggatgcgcgtgaagatgcggatcatcggaatgttgaggatcaccagcatgatgttggcgataaacaacgaggcgatcaggccccagacgatgtccggttgctgttggaacagcagtgggccaggcgtgatgttgtacagcgacagggcgccgatcatcaccgctgtggtgcccgaaccgggtacgccgagggtcagcatcggcaccagggcgccgcaggcggaagcgccgatggcggtttccggcgcggccaggccacgcatgtcgccctggccgaatttaccgctggcaccggccaggcgtttctcggtcatgtaggcaaccgccgaagcgagtgtggcgcccgcacccggcaacacgcccatgatgaaacccaacaggccgcagcggatgttgaccacgaaaaccgcggacgcttccttcaggttgaacatcatgcgtccggtggcttttaccgcttcctgaccacggtgggttttttccagcagcagcaggatttcgctgatggagaacaggcccaacaccaacaccacgaattgaatgccgtcggtcaggtggatgttatcgccggtgaaacggtacacgccgctgttggcatcgataccgacggctgagaggaacaggccgatcagcgcggcgacaaaggtcttcaacggtttgtcaccggccatgccgccgaggcagacaatggcgaacaccatcagtacgaaatattccgccgggccgaaggcaatcgcccacttggccagcagtggggcaaacagcaccatgccgcaggtggcgataaacgcaccgatgaacgagctccacgccgacaacgacagcgccacaccggccaagcctttgcgggccatcgggtagccgtcgagggtggtcatgacggtggaggcttcaccggggatgttcaacaggatcgagctgatacgcccgccgtattcgcagcccaggtacacggcggcgagcaggatcaaggccgactcgggcggcaggcctagggcgaaggcgatggggatcaacagcgccacgccgttgatcgggcccaggcccggcaacaggccgaccacggtgccgatcaaggtgccgcacaacgcggtcaccaggttgtaaggggtcagtgcaacgccgaagccctggcccaaatagctgaacgtatccatatcagttctccagaacttcaagcaggccgaggggcagcggtacatccatggctttatcgaacagcaggtaaagaccaatggccatcagcgtgacgatcaccacgctcggcaaccagcggccgccatacaggcgcgccatcgggatgccgatcagcatgctgctgaggatgaaccccaggggctcgaaggtggcggcaaacacgatcagcagcgcgacgcagacgccgatcttgatcagcgtgtcgcggtccagcgccggttcttcttcggtgtgcttggtcggctgtgggcgaaacagcatgtagatcaggcccaggctcatcagcccgagcatcagcagcgggtaggcgcgtggcccgaccggctcgtaggaaaatgccgcctgatacggccaggccatcagtgccaggccagcgcagaccagcagcatcaccgaggcgaaaatgcgttgtaagagcatgtgaaactcctgggccgcgccgcccgttgaggagggcgcggccgagcaaaagaggggcgattactggatcaggccgaactctttggccagcactttgtagtcagccacctgtttcttcacgtaggtgtccagctccgggccggtcagggcgaacgggaacagctcgcgctggtcacgcagcttggcgaactcgtcggaggccagcagtttgtcgaacgcgtctttccaccacgcgtagtcggcatcgctgacttttggcccgaggtagaagccgcgaaccaccggccagacaatgtcgtagccttgctctttggcggtcggaatgttcttcatttccggctcgtcgaggcgctcttcagcgaagacggcgagcaggcgcatgtcaccgctgaggatatgcggcatggagtcggagatgtcggtactgccgacctggatatggccgccgagcagggccgtggcgatttcaccgccgccttcgagggcgacataacgcagctcgcgcgggttgatgccggcggccttggcgatcagcgcggtttgcatccagtcctggctgccgacggtgccgccggaaccgatcacgacgctgcccggatctttcttcagggctttaaccagatcgtcgaggtttttgtagggcgaatcgcttttcaccgcgatggcgccgtagctggtgccgacggcagcgagccagcgcaccgcgttttcatcgaagcggccaaacttgccttgggccaggttcaacagcgaaccactggaccacgccaccagcgtgccggcgtctgccgggcgttgagccaccactgcgttgtacgccaccgcgcccacaccaccgggcatgtaggtcacgcgcatcggcttgctcagcagcttctcgttgaccagcgcgctttgcgccagtttgcaggtcaggtcaaaaccaccgccaggcgaggccggggcgatgcattccgggcgcttgggttcgtcggcggccagcagttggccggcgaacagcatgcagccggccgcgagggccaatttacgcagtgaataggtcatctttaactccgtctttgttgttatgagttgtggctacccggcacgtgttaccaaagtgcgatgctgtaactgaccagcacgcgcacttcatccgcatcacgcgccgaatagttggaccggtacgtggcattgcgcaggcgcagggcgacatccttgaacgtgccgctttgcacgatgtagcggatctcgctgttgcgttcccactctttgccggtctcgccgttcctgagcttgatgttgtcacccgacaggtaacggctcatgaaactcaggccaggaatccccagcttggcgaagtcgtagtcgtagcgcgcctgccaggagcgctcttgggcgccggcaaagtcgttgatctgcacgaagttgaccaggtacgggtcgctgccatccacatagggaaaggcgctgtcgccggacatgtgctggtaaccggcgctgagcttatggccgttgagggcatagctgaacaggccgttgagggatttgttgtcgatcttgccgccatgggctgcgcctgtgtcatcactgatagccaggcgcaggtcggtgccgaaggtgccggggcccatcgggcgcgaggccacaaggccgaggaagtgctggcggtagacgtcgtcgagctgggcgaagtggtagctgccggtgaccttgtcggcaaacgtgtagtccacgccgccgaaattgaagtgcttgccggtggcgccgctgacgaagcggctgttgcggttgttaagggtaatgtcttcgtagttggtgtcgtcgcggtctttggctttatccaggcggccaccggtgaacaccaggttcttgaattctttggaagtcagcaggccgccgttgaaggtctgcggcaggatgcgcccatcgttgggcttgagaatcggcagctcggggatcagtgagccgactttcagctcagtggcggagatcttcactttgccggtcaggcccagcttggagtactcattggcagcgcggccgtcgtcgtgggtcggcaacaggccggtgccggtgcggtcggggctggagtcgagcttgaccccgagcatgcccagcgcatccacgccaaagccgacggtaccgtcggtgtagcccgattgcaggttgagcatgaacccctgggcccattcgtcgcgcttggattgctgggcgctggtgccgtcacgaaagtcgcggttgaagtacatgttgcgggtttcgagggtggcactgctgtcttcgaagaaggctgcctggctaaacggcgaaaagccggcaagggcagtggcactggcaagggcggtctgggcgaggcgagaaaaacgaacaggcgggcaagcctggggctgtgtcgacagcatcgttgtgtactccgttattgttcttattttggcgaaaacgcttcgaggcgtttttctggcgctacggatcaggtagctcggcgggcattacccaccgtcgctggatgctaaagggcgaagctttcactaacctttcagttgtctttcaatgttttcgggcttcacagggcagtgggcgcctgtaaactgcccgccaaagcgtggcgtcgaccatgcccgaatgaggtgaaaatccatgcgtgtccttctggttgaagaccatttgcaactcgccgaaagtgtcgcccaggcgctcaagagcacgggtttgaccgtcgacgtgctgcacgatggcgtggccgcggacctggccttgaacagcgaggaatatgcggtggtgatcctcgatgtcgggctgccacgcatggatggtttcgaggtattggcgcgtctgcgggcgcgtgggaaaaatctgcctgtgttgatgctcaccgcgcgcagtgatgtgaaggaccgcgtgcatggcttgaaccttggcgccgacgactacctggccaagccgtttgagttgaccgagttggaagcgcgggtcaaggcgttgctgcgccgcagcgtgttgggcggcgagcgccagcaggcgtgcggtgtgctggtctatgacctggatactcggcggttcacggtaggcggcgaactgctgacgctgacctctcgcgagcaagcggtgcttgaagcgctgatcgcccgtcctggccgggtgatgagcaaagagcagttagcctctcaagtatttggcctggatgaagaggccagccccgatgcgattgaaatctacgtgcaccgcctgcgtaagaaactcgacggccagcccatcgccattgtgaccttccgcggcctcggctatttactggaagcccgtgatgcataagcccagcagcctgcgctggcgcctgctgtggaacctggcgctgttgctggtggtgttgatgctagccagtggcatgagcgcttactggaatggccgcgaagccgccgacactgcctatgaccgcacgttgttggcgtcggcgcgcaccatcgccgctggcttgacccaggtagatggcaccttgagtgccaatgtgccttatgtggcgttggacacctttgcctacgacagcgccgggcgtatttattatcaggtcaatgacatcgatcaaaagctgatatccggctacgaaaaccttcctggcccgccgcccggcacgccccgcaccgatgattacccggcgttggcaaggttctacaacgcgacttaccagggccagcatgtgcgcgtggtcagcctgctcaaggcggtctccgagccgaacatgaatggcatggcggaaattcgcgttgccgaaaccgatgaagcccgcgaaagcatggcccgtagcctgctggccgacacgctattgcgccttgggatgttggcggtcggtgcattgttgctggtgtggtttgccgtgagcgccgcgctgcgcccattggagcgcctgcgcacggctgtggaagagcgccagcccgacgacttgcggccattgccgctggtggaggtgcagcatgaattcggcccgctggtgcgctccctcaatcactttaccgagcgcctgcgtggccaattcgagcgccaggcgcagtttatcgccgacgccgcccacgaactgcgcaccccgctggcggcgctcaaggcgcgcttggcgttgggcttgcgcagtgaagacccggcaacatggcgcagcacgctggaaaccgccgcgcagggcaccgaccgcctgactcacctggccaatcaattgctctcgctggcccgcatcgaaaacggcgcgcgggcgattgccgaaggcggcgcgcaattgcttgacctcagccagttggcccgcgagttgggcatggccatggcgccgctggcccatgcgcgtggtgtggcgctggcgttggaggcggatgaaccggtgtggttgcgcggcgagccgacgttgttgaacgagttgctgagtaacttggttgataacgcactggcccacacaccaccgggtggcaatgtgattttacgggttatggcgccggccatcctggaagtggaagacgatggcccgggcatcccgctggatgagcgggaccgagtgtttgagcgtttttaccgccgtagccagcagggcatgggctcaggcctggggctggcgattgtcggtgagatctgccgcgcgcatctggcgcagatcagcctgcatgatggtgatttggcggggttgaaggtacgggtgagttttatcgcagggtgatcagtagaacatcgagcgcgcttcatccagttcggcacgcagggcatcgctgtaagggtcgacccgtaatttcttgatcgccggcaggctggaaaccggcacattcgccagcgggtggtcagtaccatgatggcaatacagcacggcgacctgcaccaggtcgatgtagtccaggctcggggagtcgcgctgcaggtccaggtattgccctggcagtttcgccagcatttccgggaagtcccagccacccagcagtttgtctcccagcaacgggtggatgctgtcgatcacatgattgaggctgaccgggtcggagagcagctcgtagtggtcttcggcgtaagtgagaatcggcagcaccccaatctgatgcaccagaccgccgagggccgcctggtccggcttgagctggctgtggctgcggcacaaggcataactcacgcccgccacttccaggctgcggcgccacacttcgcgcattttcagttcgacgacttcggagcgggcgtggaagatttgctccatcaccagcccgatcgccaggttgctgctgtagttggtgcccagccgagtaatggcggtgtgcaggtcggtgacttcctgggtcgcgcgcagcagtgggctgttgaccactttgatcaggcgcgccgacagggcggtatcgcgaccgatcattttgctcaagtggctgatgctgatatccgggtcttcagcagcctgacgaatgttcagggccacttccggtaatgtcggcagaaccaggtcatcgttgtcgatggccgtcactaaagcctgttggactttttccgccagcttgttcattcatgctctctagggtgttgcaaaaaggtacggcaattaacgctggatctctttatcgcgatccagctggtaaggcagatcgagcaggtgcaagccgggaccttccagggtgcccaagtgcacatcgccactgtcggcagcttcggcttgcagcacggcgagaagttcaacggtttggtcagtttttgctgcgatgacgacttcgccgatcgcgctgttatggctgggggaaaacagcggcgtgccaggctcaggcaattcggctgcatcaaggctgaggcgatacaggcgacgcttgagcttgccgaggtattgcatgcgcgcgacgatttcctggccggtgtagcagcccttcttgaagctgacaccgccgacggcttgcaggttgagcatctgcgggatgaacagctcgcgggtttgcggcatgacctggccgataccggcgcgaatctggcccaatagccagtcatttaagtcagcttgttgcagctgtgcggccaattgagtgcgcacagcatcggcttgctcggcaggcacccagagttcggcgcggccgggggaaacgcgaatggcgatcaacgcctcggtgcgcgttacgctgtcggtctcggcggggagttcaaggcccagcgccgacagcgcctgatcggcactggccaggccgaaacgcgcccaggcggcgctttcgtcggtgagcttggacttggagaacactgcgtattttttcaggtcggcaagttgtggttcgagcagctcggtggccatggccagaagcacgccatcaccttgcaacaggatgcgaaaacttgactgcatacggcctttttgcgtgcaacgcgcgccgaggcttgcctgggtgtcgctcaggtaattgaggttgcaggtcagttgcccttgcaggaatttggcagcgtcggagccgcggacggcgagaacgccttcgtgggtcaaggggcagaaaaaagcagagtcggccatgggtcatcgcaggtcaaaaagtcatgagtgcatcatagaggggcgcccggcaaatggatagtttccgtatggggcgaccaaagccgactgttccggtgccatcgggcctgtatacttgcgcactatttgaggagcgctccatggtcgaagaagtagaaatcaatcgcctctactggcacagccgtcgtggcatgctggagttggatgtgttgttggtgcctttcaccaaagaagtgtacgcgacgctcaacaaggaggatcgcgacctctacgtcaggctgctgacgtgcgaagatcaggacatgttcggctggttcatggagcgcgccgaatctgaggatccggagctgcagcgcatggttcggatgattctggaccgtgtccagcccaagtaatcgcttcgaatgccgctggcaggcctcacggctgttgctggcggcgtatctgcttgcccagctgttcgcgctgggtgccttgctcgtaatcgatttgccgttcgcacgccttggcattctgttgtgcctggcgcatgccgcctgggtattacctcggcatattctcttggctcaccgttcgtcgatttgtggcctgcgccgcgatgaagacggctggcagctcttcagcaaagagcgtggttggcacagcgtgcaactgcgccccgacagcctggcattaccgttggtcgtggtgctgcgctatcgggtgcccgcagagtggtggacgcgttcgatttgtgtgccaagtgattcgcaggctgccgatgtgcatcggcgcctgcgggtacgcttgaagttcagccgccgtaggtggttggcaccagaatagtgtcgcgggcctcgggcagcatctgcggatagtcgagggtgtaatgcaggccgcggctttccttgcgttccatggctgagcggatcatcagttccgcgacttgggccaggttgcgcaattcgatgaggtcgcggctgactttatagttgctgtagaactcgtcgatctcatccagcagcaagcgcacgcggtgttgagcgcgttgcaggcgcttgttggtgcgcacaatccccacgtagtcccacatgaagcgacgcagctcgtcccagttgtgggcgatgatcacgtcttcgtccgaatcggtcacttggctggcgtcccagcgcggcagggctgccggcacggggatgcgtggcagttgctctaagatgtcggcggccgccgaacgggcgtagacgaaacattcgagcagcgagttgctggccatgcggttggcgccatgcaggccggtgaagctggtttcgccgattgcatacaggccgggcacgtcggtgcggccgtgctggtcgaccatcacgccaccgcaggtgtaatgcgcggccggcaccaccgggatcgggcctttggtgatatcgatgttgaacgtcaggcagcgctcgtagacggtggggaagtgcgtcttgatgaacgcttcgggcttgtggctgatgtccaggtagacgcaatcgatgcccaggcgcttcatttcgtggtcgatggcgcgggcgacgatatcccgtggggccagttcggcgcgtgggtcgaagcgttgcatgaagcgctcgccgtttggcagtttgaggtgtgcgccttcaccgcgcagggcttcggtgatcaggaagctcttggcctgcgggtgatacaggcaggtggggtggaactggttgaattccaggttggctacccggcaacccgagcgccaagccatggcaatgccgtcgccgcaggcgccgtcagggttgctggtgtagaggtagactttggctgcgccgcctgaggcgagaatggtgaagcgtgcgccgtaggtgtcgacttcgccgctggcgcggttcagcacgtaggcgccgaggcagcgctcgccgtccaggcccaggcgtttttcggtgatcaggtcgacggctacccgttgttccagcaattcgatgttggggcgttggcgggcctgctcgagcagggttctgaagatggcggcgccggtggcatcggccgcgtggatgatgcggcgatggctgtggccgccttcgcgcgtcaggtggaactcgaatccgccgtcgtcgctgccggcatgttcgtcgcgggtgaacggcacgccctggtcgatcagccattggatggcttcgcggctatgctcgacggtgaagcgcacggcgtcttcgttgcacaggccaccgccagcgttgagtgtatcttcgacgtgggactgcaccgtgtcggtgtcgtccagtaccgcagcgacgccgccttgggcccagaatgttgagccgttcgccaggtcgcctttgctcaggacggcaatgcgcaggtggctgggaagggtcagtgccaggctcaggccggctgcgccactgccgatcaccaggacatcgtgttgaaactgttggctcatttgaaggattccgcaaaaagcgatccgaagggttggcgcaaacaggacgcctggatcggcgaatcaaagggtcacacggactactagtatatagagggggggagcggcacaatagccgggcattcgtggcaatgtgagattacggtgcacggcttgggtaaaatcggctggttattgggatgggaactttttgcataagccctgactcaatagcaggttgcccgaaagctgggaaaacgttgagtttattggcccgtcgggtgcattggacgcgtcagaaaaccggcgacaagattattcgcgcagccggcatcgcccgtgctgcgtttttcgtgtgtgccaaatcagtgcgcgccggaaacttgcttggagggggagaacttttgcgaaaagtcctagtctatgtttgcaagcctgatcgtttagttatgcaagcctcctccaagtacaacgaggagtgttcatgctaacccaggaagaggatcagcagctggtcgagcgcgttcaacgtggcgataagcgagcatttgatctgctagtgctgaaataccagcacaaaattctcgggttgatcgtgcgttttgtgcacgacacccatgaagcgcaggacgttgcacaggaagcctttatcaaggcgtaccgtgcacttggcaattttcgcggtgacagtgcgttttacacgtggctgtaccgaatcgccatcaacacggcgaagaactatctggtgtctcgcgggcgccgcccaccggatagcgatgtaagttcagaagatgcggaattttacgatggtgatcacggcctcaaagatctcgagtcgccggagcgtgcattgctgcgcgacgagatcgaaggaaccgttcatcgcacaattcagcaactgccagaagatttgcgtacggcgttaactttacgtgaattcgatggtctgagttacgaagacattgcgagcgtcatgcagtgtccggtggggactgtaaggtcacggattttccgggcccgggaagccatcgataaagccttgcaaccgttgttgcaggaaaactaaagacagcggcgacagccaagagaggaaccgccatgagtcgtgatgccctgcaggaatcgctgtccgcagtgatggataacgaagcggatgaactggaacttcgtcgagtgcttaacgcatttgatgatgccgaaacccgtgatacctggtctcgttaccaagtcgctcgggcggtgatgcacaaggatcttctaatccctcgtctggatattgctgcggccgtttctgctgcgctggctgatgaagccgttccggcaaaagctgctcgcggtccatggcgtagcctgggtcgtctggcagtagctgcctcggtgaccgttgctgtgttggccggtgttcgcctgtataaccaggacgagatcgccggtgccgaactggcccaacagactcagcaaccggtaatggccggtccgcaagtcaaaggcccagctgtactggccggctacaaggaaagctctgacactaccggccctatggctaatggtgtacttcaagggcaatccggctggcaggatcagcgtcttccaggctacctgcgccaacacgcacaggaatcggctttgaaaggcgctgaaagcgcgctgccatacgctcgtgcagcaagcctggaaaaccgctaaaccgttaaggagccctatgcgcgccataccgctccttacgcttttgctcagtggttgttttgcactatccgcccatgccgacgaagcccaagactggctgactcgacttgggcgtgcagagcagcagcaaagctttcaaggtacgttcgtctacgaacgtaacggcagtttttctacccatgacatctggcatcgtgtccaggacggtcaagtccgagagcggcttttgcagctcgatggctcggcgcaagaggttgtgcgcgtaaatggccggacgcaatgcgtcagtggcacgttggtcgctggcctgggtaattcccctgaagcgccgtcgcgcgcacttgatccgcaaaaactaactcaattctacgaactggccgtcattggcaaatcgcgcgtggccggtcgtaatgcggtgattgtgtcgatcacgccgcgcgatcaatatcgatatggctttgagttgcacgtagatcgtgaaaccgcgctgccgctgaaatccttgttgctcaacgaccaaggccagttgctggagcgttttcagttcactcgactgaccacttcgccagcgccctccgatcgcgacttgcagcccagcagcgaatgcacgcctgtcgccgtttcgcagagtaaagcgccagaagtgcccgccacccatgcttggcatctggattggttgcctcctggtttccaactcaccagtagcattgcccgtaaagatacccagaccaagtccaccgtcgacagcttgatgtatgacgatggccttgcacgtttctcggtgttccttgagtcaaccgacggcgcgagcgtaagtgaaacccgcacacagctgggcccaaccgtcgccgtttcgcgccgtctgaacaccgtcgatggcgaagttatggtgacagtggtcggcgaaattcccatcggcaccgccgagcgcattgcgctctccgtacgcggcgaaaagacagccgccaagccgtgagttgttaatcctatgttcatcctgacctttcaatctgcgcctatgccgggttgggtgctgagagcatgaaatctctggatcattattttcacttgcaaaaaatccccatgttttttataggtcagggcttgtcggctctggccttgttttgttcgcggaacaaagatgtcggtcgcagttttcggcgtttcttgaaccctgtcgctcaaccctgctcgtcgtaacgggagctgtatgtcgataccacgtttaaagtcttacctatccatagtcgccacggtattggtgctgggtcaggccgtgtccgcgcaagcggccgagctgcctgacttcacccagctggtggagcaggcttcgcctgccgtggtgaacatcagtaccacgcagaaactgccggatcgcaaagtctcgaaccagcagatgccggacctggaaggcttgccgccgatgttgcgcgagttcttcgagcgtggcatgccgcaacagcgttccccgcgtggtggcggtgggcagcgtgaagcgcagtccctgggctcgggcttcatcatctctcccgatggctacatcctcaccaacaaccacgtcattgccgacgctgacgagatcctcgtgcgcctggctgaccgcagtgaactgaaggccaagctcgtcggcaccgacccgcgttccgatgtggccttgctgaaaatcgaaggcaaagatctgccggttttgaaactgggtaaatcccaggaccttaaagccgggcagtgggtagtcgcgatcggttcaccgttcggtttcgaccataccgtcacccaaggcatcgtcagcgccatcggccgcagcctgccaaacgaaaactacgtaccgtttatccagaccgacgtgccgattaacccgggtaactccggtggtccgttgttcaacctggcgggcgaagtggtcggtatcaactcgcagatctatacccgttccggtggcttcatgggcgtttctttcgccatcccgatcgacgtggccatggacgtttccaaccagctgaaaagcggtggcaaggtcagccgtggctggttgggtgtagtgatccaggaagtgaacaaggacctggctgagtccttcggcctcgataaaccggccggtgctctggtcgcgcagatccaggacgacggtccggctgccaaaggtggcctgcaagtcggtgacgtgatcctgagcatgaatggccagccgatcatcatgtcggcggaccttccacacctggtaggcgcactcaaggcaggcagcaaagccaagctggaagtgattcgtgaaggcaagcgccagaccgttgagctgaccgtgggtgcgatcccggaagagggcgccaccctggatgccctgggtaacgccaagccgggtgccgagcgtagcagcaaccgcctgggcatcgccgtggccgagctgactgatgagcagaagaagagcttcgaccttaaaagcggcgtggtgatcaaggaagtgcaggacggccctgcctctctgattggcctgcagccaggtgacgtgatcacccacctgaacaatcaggccatcgacaccaccaagcagttcaccgacatcgccaaggcgctgccgaagaaccgttcggtttcgatgcgcgtgttgcgtcaagggcgtgcgagcttcatcaccttcaagctggccgagtaatctgctggaacaataaaaagccccgcgaaagcggggcttttttgtgggcgatgggtttagctcatcatcccttttaccaaccgttcctgttcgatcaactcacgttggcgcgcgtcgatacgtgaggacagtgggaagttgttgccggcacggcgcttggcaaagtccagttgctgaatggcctgctggaagtcgcccaccaatgcaaagtactcggcgcgcgcttgatgcaagccgatgatgttgccggacagcccacgcgtttcggcgacctgataccagacgtcggggtcatcagggcgggatttgagcagcgcatccagggccttttccgcatcggcggtgcggttctgcttgagcagcaagtccacccgcacctgattcagcggatagttgccggggtactgggtgagcattcggtcggtgcgctgctgggcatccggcaagcggttgctggtgatgtccagttcgatctgcgccaggttgtaagtgatgtcgttgggcgctttggccagcaacggcgcaaggctttcccgtgcttccttgagttgcgtgcccttgatctgggcgatggccaagccatagcgcgccacatcgtttttcgggttctcgtccagctgcgcctggaaacgttttgcggcgaggcccggtgtgtcttcgtattgcaactgcacccgcgcccgaatcagttgatagcgcaggctgtcttccttgccacccggtttggcttgctcggcgcggttacgcgtatcggcgatccgtgattcggtaaccgggtgagtcagcaaaaattccggcggcttggcgtcgaaacggtattggcgcatcaggcgctcgaacatggtcggcatggagcgcgggtcgtacccggccttttccaggttgaggatgccgatacggtcagcctcctgttcgttctggcgggagaagcgacgttgttcctggatcgctgctgcctggctgcccgcaattgcggcgataccggcatcacccgcacccgccgccgccgcgataatgccgccgagcaaagcggccatcatcgggatttgcatgcgcgactgcgcttccacgccccgggcaaagtggcgctgggacaagtgcgccaattcatgggcgagcaccgaggcgtactcgccttcggtctgggcattgagaaacaggccgccgttgaccccgacaatcccgccaggggcggcaaaggcgttgagctgcgggctgttgatcaggatgaactccaggcgccggtcattgacctggctggtctccaccagtttgtacacgctggtttcgacgtaatccttaagctgtgggtcattgagttgcgagacctggccgcgcaggtaggccagccacgcgcggccgagttggtattcctgttgtggcgagacaatggcagaactggcgtcgccgagtgacggcaggtcgtcagcgaaggccggagaggccagcaggcaagccagcgtcagcagggtagggcgcaaaaaagtcatgcacaaagcctttcgacaaagagcttactgtagccggacactgagcttcggaccagatattctaagcacccgaaacgcttgcccggagtaaaaccatgaccgacgctgtagcctttgatgccgaactcgacgccagcggcctcaattgcccattgccgctgctcaaggccaagctggaactcaaccggttggccagcggttctgtgctcaaggtgatcgccacggacgcaggctcgcagcgcgatttccgcacattcgccaagttggccgggcataccttgctacacgaagaagacgccgccggtgtgtaccgttactggttgcgcaaggcctgaaccgtttgcccccaccacctgaggttgattgatgttcaaagtgttacgagactggattcagcgctacttctccgatgaagaagctgtggtgctggcggtcctgctgttcctggcctttaccgccgtgctcaccttgggcggcatgttggcacccgtgttggcggggatggtgttggcgtacctgatgcagggcttggtcaccacgctggagcggttgcgcttgccgggcggggtggcggtggggctggtgtttgccttgttcatgggcctgttggtggtgttcatcgtggtggtgttgccgttgctgtggcatcagttgatcacgctgtttaacgagctgccgggcatgctcgccaagtggcaatcgctgttgctgttactgccggaacgctacccgcacctggtgtcggacgagcaggtattgcaggccatcgaagtggcgcgcggtgagatcggaaagttcgggcaatgggcgctgactttttcgctgtccagtttgccactgctggtcaacatcatgatctacctggtactggtgccgatcctggtgttcttctttctcaaagaccgcgcaatgattggccgctgggtcagcggttacctgccacgcgagcgggcactgatcacccgtgtggctgaggaaatgaaccggcagatcgccaattacatccgtggcaaggtcattgagattgttatctgcgggggcgttacctacatcgcgttcgttgcgctcgggctgaactacgcagcgctgctggcgttgctggtgggtgtgtcggtggtggtgccgtatgtcggcgcggtagtggtgacggtgccggtgatgttgatcgcgttgttccagtggggctggagtgatcagttcatctacctgatggcggtgtacggcattatccagaccctggacggcaatgtgctggtgccgctgctgttctcggaggcggtcaatctgcacccggtagcgatcatctgtgcggtgttgttgtttggtgggctgtgggggttttggggggtgttctttgcgattcccctggcgacgctgttcaaggcggtgctggatgcgtggccgcgacaagagccggtggtggcgcctttgctgtaacacctgtggcgagggcgtttactccctctgggctgcgtagcagccccaaaaaagacgggagcgctacgcactccagcgcgagcaagctcgctcgccacacaagctcgctctgggggcaaatcaagccttgttcaatgcctgcgcggctgccaacacggcatccacatggcccggcactttcacaccacgccattcctggcgcagcacaccctttttgtcgatcaaaaaggtgctgcgatcaacgcccaggtattccttgccatacagcttcttcagcttgatcacatcaaacagctggcaaacggcttcgtccttgtcgctgatcagctcgaaggggaattcctgcttgcccttgaagttttcgtgggacttcacgctgtcgcgggacacgccaaacacttcggtgtcggcggctttgaacgctgcgtattggtcacgaaaaccctggccttcagtggtgcagcctggggtgctgtccttggggtagaagtagatcaccacttgcttgcccttgagggcaccgaggctgaaggtttggccgctggtggcctgggcttcgaaatcggccacgggtttgtcgatggctaccggcatgagtacttccttcttacattgggttctgtgggcgccatggctcgatcagtgcgtcgaggttcagggcatcggcgaaatccaggaactggtcacgcagccaactgatctgtacgccggccggcaaggtcacggtgaacgtggcgttgagcatggtgccgccggtttgtggcgcctggtaggtgtcacaggtcaggttttccagctcgacgttgtggtcgataaagaactggcacagttcattgacgatgtccgagcggtaggccgagctgacatacgccacatacggcagcgcctgtgggcggttctccagcgccgcgctgcgcaccacgttgacggtgaaatcgtgcttcttggccaggcctggcaggccagtctccaggcgcgccaaggcgtcccaggtgccggaaatctgcagcaccagcgcgctgcattcgccgtggcgagtgaggcgggaggtcacgacggcgcagcggttttcatggctggcgcggcacaggacgttagtcagctccatggggttggcgccgagggcactgataacaaggaattgttcgcgaactgtgggggtggacatgcagccttcctaaaacgatgagcggtcgatacggtgagggctgtatcgatcaaaggatgaagggtagcgaaaaccgtcgccaagggataggaggtggcgttttcattgcgtgatcggtctgatttcagcgtgcttcaaggcacgctttggcccaatgatggcattgcccgtcgtttagttggctcagaacgcatcctcaggcggtacttcgcttgtacaagcatcttggcgccagtaccattacggctctctttttccggcaggagcggttgcatgattgcgggcagtatggtggcactggtcacacccatggatgcacaaggtcatctcgactgggatagcctgggcaaactggtggacttccacctgcaagagggcaccaacgccattgtggcggtcggcaccacgggtgagtcggccacacttgatgtggaagaacacatccaggtgatcgaattcgtcgtcaagcgcgtcgcaggccgtattgccgtgatcgccggtacgggcgccaactcgacgcgtgaagcgatcgagctgaccaaaaacgccaagaaagctggcgccgatgcctgcctgctggtgaccccgtactacaacaagccgacccaggaaggcctgttccagcactttcgcaccattgccgaagccgttgatatcccgcagatcctctacaacgtgcccggccgtactgcctgcgacatgaaggccgagaccgtgatccgcctgtccaccgtgccgaacatcatcggcatcaaggaagccactggcgacctgcagcgcgccaaggacatcctggccggcgtaagcagcgacttcctggtgtattccggtgacgacgcaacggctgtcgagctgatcctgctgggtggcaaaggcaacatctccgtgaccgccaacgtcgccccgcgcgccatgagcgagctgtgcgccgccgccatcgccggcgatgcggtgactgcccgcgcgatccacgagaagctgatgccgctcaacaaaacactgtttatcgaatccaaccctattcccgtgaaatgggcgctgtttgagatgggcctgatgccggacggtatccgtctgccgctcacccggctcagcgaagcctgtcacgaaccgctgcgacaggccctgcgccagtccggcgtcctggtttaattgaggaagcactacgcatgaagcgattggccggactttccgcacttgccttgattatctccagcaccagtggctgcggttggatttggggcccggatggttacttccgtgaccgcggcagcgattacctggaagcacaagcaaccaaaccgatgcaactgccgccggacgtcaatgtcgccaagcgccttgacccgttgctgcctatcccgcgcaacgtcgccgacgacaccaccaagggtgagtacgtggtgccgcgtccgcagccgatctcggcagtggcggacgccagcgactacagcctgcagaagagcggcgacaaccgctggatcatcgcccagcgtccacctgccgaagtctggccagtggcgctgcagttcttccaggacaacggtttccgcatcgaccagcaacgcccgcagaccggtgagttcaccactgcatggcagcgcggtagcgaattgtccgccaacatggctcagcgtctgcaggccggtggtgtagccgccgataacgaagctcgtgtgcgtgtgcgcatcgagccaggcgtgcagcgcaacaccagtgaagtctatgtggtcagcgccgagcgtcctgccggcagcaccgccaacgtcgacttcaccccgcgttcggtcaacatgggcgtagacgccgcgttggtcgacgagatgctggccagcatgagccgtatctccgagaagggcggttcggtttccctgctcgccgcgcgtgattacgacacgcctaaccgcgtcagcctcaccgaagacggcagcggcaacgtcgtgctgaatttgggtgaagacctcgaccgtgcctgggccagtgttggccgcgcgctggagaagggcccttggcgagttgaagacatcaaccgcagcctgggcctgtactacatcaacgtggctgaaaaggctgagaagaaagacgacgagccaggtttcttcggcaaattgttcggcagcaagccgaccaaggaagagatcgaaacccgtgccgagcgttaccaggttcgtttgagcaaggttggcgaaagcgtacaagtcaccgtcgagaaaaacatcaacaccgttgcgccagctgaaacagcgcgcaaagtgttgggcgtgattcaggacaacctgggctgatccgatgcgttttgccgttctcggcagcggtagccaagggaacggcacgctggtcgcccacgacgacacgtacgtgctggtggattgtggtttctcgttaaaagaaaccgagcggcgcctgctgcgcctgggggttcaccccacgcagctgagcgcgattctagtgacccacgaacatgccgaccatgtgcatggcgtgggtttgctgtctcggcgctacaatcttccggtgtacctgagtcgcggcacattgcgcgggatgcgcaaacccatagaacccgcaggtttcctggccggtggcgaacagctgcagattggtgcgttgagcatcgatgtgattgccgtggcgcacgacgcccaggagcctacgcagtacgttttcagtgacggtgagcggcgtttcggcgtgctcaccgacctgggttcctactgctccaaggtgctggacggttaccgcgacctcgatgcattgatgatcgagtccaaccactgtcgagacctgctggcgcgtggtcattacccgtactttctcaagcagcgggtgggcggcgagctcggacatttgaacaaccaccaggcggcgtacctggtgtatgagttgggctggcaagacttgcaacacttggtcctggcccacctgagcagcaagaacaacctgccgcagctggcccggcaatgttttgtcgacacccttgggtgcgacccggactggctgcaactggccgatcaagattcagggctagattggcgacacatcgcctagcccaccctttagcaagcggagcccatcatggaaaaacgtgaagaactctaccgcggcaaagccaagtcggtgtacaagaccgacgacgccaaccgcctgatcctgctgtttcgcaacgacacttcggcgttcgacggcaagcgcatcgaacaacttgatcgcaaaggcatggtgaacaacaagttcaacgccttcatcatgcagaaactcgaagcggccggcatcccgacccaattcgacaaactgctgggcgacaacgagtgcctggtgaagaagctcgacatgatcccggttgaatgcgtcgtgcgtaactacgccgccggcagcctggtcaagcgtctgggcgtggaagagggcctcaagctcaacccttacacgtttgaactgttcctgaaggacgacgccaagggcgacccgttcatcaacgaatcccacgtcgtggcattcggctggggcaccgctgagcaactggcacgcatgaaggagttgtccctcaaggtcaacgacgtgctgagcaagctgttcgacgacgccggcctgctgctggtcgacttcaaactggaattcggcgtgttccacgacggctccatcgtcctgggcgacgaattcagcccggacggctgccgcctgtgggacaaagacaccaagaagaagatggacaaagaccgcttccgccagggcctcggtgacgtcatcgaagcctacgaagaagtcgccaatcgtctcggcgtaccgctttaatcgacgcaagcatctgatagcacggaaaaaaatcgcttttggggtttgcttccgcgaaacacactgttatgatgcgcgccgttggagagatgccagagtggccgaatgggacggattcgaaatccgttgtaccttcaccggtacctagggttcgaatccctatctctccgccatatttaaaaaacctttgtaaatcaatgagttgcgaaggtaaagaaacagcgatttgtagcagtggtttgcagcaggttttgcaaaacacagcgaataaatcgctgttttttttcgtctgtcctttttcgattgagttatgagtgttaacgccctgtccatcagccgttaccctctgtggccgtctatggtttgtgaaagggtgtcgaccggggaaggtgcgtccggacccgttgagacgtattggagggtgtctggtgtgcctgcttggctgccggtggttgactgggtacacccggggagccacttgtctattttggcttttttctctttgtcctaatgtcctattgccatgtgtttgcctttcgggcataaagggcgagggcacccctccaagctttaactatgcagtgctaccactgcaatgatcgttaatgtaaggacatatgctactgtgatttacgctgagactatcgattcgcaatgttatgagtctcgcggggcgtaaggtaaatagcggggggtgccgcttcttactccggtagcgtacaggccggaggctgccgtgaagctactgaatcccccaagtcgatctatccataagctcgattctcttgatcttctttgcaaccttctgggtgtaaaaaaaggacaacttctttatatctgctacaagcgagcagatgaacaaaaatataaatcctttgagattcccaaaaaacgtggcggtcttcgtaagattgattcacctcaaaagggattgagggtggttcagcaaaagttggcagagcttttgactgagaacttagagttcaaaccttgcgttcagggttttattaaaggaaggggcatacttcaaaatgccattttgcataaaaaatctaactgggtgttaaacgtagatattaaagatttttttggttcaattaattttggtagggttcgtgctgttttcatcgccaagcctttcgaaattcatccggacgtagcgacagttattgctcaaatctgctgtttcaataattatcttccccaaggtgctgcaacctctccagttgtgtcgaatattgttgccagtattttggataatcgaattataaaacatgttagaagccatcgtcttatttattcaagatacgctgatgatataacactttccgcgaaaaggaattttccccgagaaatcgctcatgttagcgacggacgaacaatcattggggaagatttagccaatattttttcgagggcgagctttgaaataaatgaaaaaaagagtcggcttcaatcaaaatatgataggcaggaagtgacagggctaataacaaataaaaaagtaaacattcctgctgagtataaaaacaaagtccgtaccgcgatataccactggattcaagacccaaaagaggcggagcgtaagtatttcattgatatactaaagcttaatcccgatgaggtggagctgacggaagatgggcgaaaactaaagcataacatatatggtagattatcttttatcgcaatggtgaaaggaaaagacgatccaacatacgttaaactaatattgaaaatggccgagcatgataaaacccctcctaaatttttaaaatccattaaggaagaatataaaatgtacgatgtttttctctgtcatgcatcagaagacaaagcagccattgtggagccgttgtatgaagcacttacgaaaattggtgttcatgcattttatgactctaaggaaattgcgtggggtaattctcttatcgaaacaatcaacaaagcccttattaagtcgcaatatgtgattgcggtaatgactgataactctgttgtgaaagcgtggccgcaaaaggaaatcaacgccgttctcaatggggatatttctggtggaaccaaacgactgctgccattaattcacggagataaagaaaaaatcctcaataataattttttgatgagcgacaagctttatgttgtgtggcaagacaatccagacgaaatagcacaaaaaataaaatctttgctagcatcataatttataaaaaattttaactcgtcgagaaaaaacatgacttatgttcaggtaaatcacgattttataaaatttattgatccaagtttgtatgccgatgttcttaataaaagtgatgatggaatttgcgtgataaggctgcagctgatatgcgagcggtttttaagcgtctatttgaaagaaaggatttctccagaaaatattgagtttttcattagtggaaaaggcaagagtgctgaaattctccgccattttaatgaaagactaactacatcgatagcttctggattgcctgctgagttggcaagggctttaaagcatataaataaaattagaaaccattttgctcacaacctcgatcataaaatcatgcagtctgatatggataaatattttgagctggtggatttgtttaaagtggatgtcggtatgatccatggttatgaagggccagtgagggaggcaaaaattagttcggatggcaaggtagtaaatgccgtagataattttcaagctgggtttactgctgctacttactttttaatgacaaaagccggactctggctggccaatgatttgcaaaagcgagggcagttaagcttaggtgagccattgcaatagaggctcgatcggcttgaggtgtaggcctgtgagctaggcgttacgttatactcggaatcaaatagagcgtctttggtttgcgtaaacatgccaagtaattaactgaaagccagatttaagctttacaaggagttggggtggctaagcttagcaaagttaaaataaagaatgacaaagtcatcttggcggatgggtcgattgttgatatgcatccacgccataatttcgataagccaacacgtttgcttttgcaacatatggcggcaggtgtctgttccaaccctgattgcctgagtcacaccataggctcgaatcttaagcgaaacgattatgcaggtaacggtgtcgccgctcatatttgtgctgccgctcccggccccggtgctgctcgctacaataaacatcagacgaaagaagagcgtagctcgtacaagaatgggatttggctctgcgggtcttgctccatcatcatcgatcgggatgagtcacgctacccggttgatctactctgtgagtggaaggctaaggctgaaaaacgtgcaatgactatggttggaaccaaatctctgacccagtttgaattggctgatagtattcgtgctgaagtggttagagctttgacgtgcaattttaataatatggtcaatcctttcgaatttcctgttcagtccattcatcattcttatagcgaagcaatagagaagcttgatccacgcttcagcgttaagacagtagttgatggtgctatcactcacgtactgtcggccaaaaacatttctgattcccggttttcagttgttgcaaccggtgaagctgcctctgaattacaggacaaaattgaaaatcatcggctgacaggccaaggattcaaaattgactcatcaaaaataaattttataaataatgatatttttcaggcgttcaaacaatcacgtcccggttcatatctatatctaaagcctgctgttttaaaggttcaaagctcgttgtatctggtgtctgcgaattctcgtcattttctttgtacatttgaaagtagttatgtcggtggggagaaggtgataacggtagatggtgagacgctagatggattcttaagcttttgctttaaagttaacgctatagattcaaatgtgtttattgaatttaagacatcaattgagtcttggtttgggaatttggtttcagggctcaagcatcttccaaaatacttagaggctagtaggtaccttgactcggttgcagaattcggttttctaattgaatatgaaaatgcggacacgcttgttcagattccacctgccaaggctgagtgctatatacaaaataatgaatcaacgataagttttaagaagtgtttgagtgccctgtgtgcgttgcacggattttcaaaaatattatctgataatttatatataaagcattcccctttggatacggactcagtactgctctcacagagttttttgcagcttgaaaagggggcagtgctgcagccgttagaatatggctcgcttattttttcacaaaggatggattcgattgaccctgaattagctagctatttttgttctggggttgagggtgtttattttagtattagtgatggagtcagggttctaatagaagtttttggtaattttatagagtgtccgccggtagtcgcttcttatgagggttttgaagtggctctttattatggtatatgtggagaggattctggttttttgtttgttaatttgtactcgaatcaagagacaaaggttacttttagcttgggtgatgggggctttgttttgagggggtgatgtttttcatctggcgagtaattactaagccataaatattgattacttgccaagtctagtgtttggtttgccaatggcgttaatggtcgcggaaaattaagcttggataatattataaagtaacaggtgcgtcgttaagttcatctagcttgggcaagcaccctgaaaaaagtttttgataccaaaaaaacctaacagcaggaggtacgtcattttgtagcagagttttgtagcaaaatactctaaatttcctgtgtctattggttttggcgggctgcagagtatgtttctgaacgtccctatctctccgccagcacatagaaaaagccccgtagctgaataagctgcggggcttttttgttctcgggttttcaagtcttctactcgctcaaacgttcgcccgctatacgataagcctgctcgcgttcccgcttaccgatggccatcaccaccacagtgatttcctgaacgatcacttgataaaccagcctgtaaccgccgctacgtagattgattttctagcagtcgggcaggttacgcaggcgattagctcaatgccctcgcatcgaaatcaaggctataggtcatctatagaaacctttacccgttgaggagatgccaatcgttcccgaacggtagccatcaacgcttcatcttcctcggtcatcagaacaggcttgaacggcagttggccgcgatccgccacgtattgcagggcctggcgcatcagttctgaaggcgtaacgccgagcttttccaattcgagataggcgcgcgctttcaggtcgtcatcgatacggatgcttacagacgccatggaatagattctcatgtaattacatttgtcattacgttggatcaagagaggactattggcaagcctggcgggaggtatggcgttcgtatacttccttgtcaccgcattacaatttccaagtgtcatatcgtgattaccgtcgcacaggctgtgcagctctcgcacgggcttgcactggcagaggcaggacgctaaccttccgccgtcgccctcctggcgaccggttttgacagaccgaataacgtgcgatctctgtgcatccccaaacgtggttccagattcttgtctgtgcccatctgttatggcggctgtgcgtggggcaccttcgggtgcgccgggtttccacgtttccggtctgtcaacccgcgtacagctgccacccaatcctgtttgacagcagggagtggtagctccttttcataacgtggagttacatcatgaaaaagatcacccccaactcgaccaatgctttcaatgccgctaccgacggcgaacctcgcaaaatcttccacgtaggcgccgacgtcggcaccgaagaagccctggccaacgcctccgaaatcctctcatccgcacttcaaaccgcctaccaatgcgccgaagatccggaaagtacgcagtcacccgtaatcatggggctggcgcagttgatcgagaatgcacaggtgctggtggacgcggtgctggagcgtaatttcccggcggataaaccagtcaagtaatcacctgcatctgaaactgaaaaagcctgctgaacttaatgctcagcaggctttttagtaggtgcggtgcctgagaaactgacgacttacgtaatcgcgcagaggttgcaggtcatgcaaaaccgtacgctccgcatggctcaagtggccaaagcgttcagaacatgcaccgggtcgttatgaatggccttcaacaatgcctttgctggccctgttggatcgcgacggccctgttcccaattgcgtagcgtgccgagttgaacgtcaatcaaggctgcgaatttggcctgggtcagccctgttgctttacggatttctttaacctgcatcgcatcaacatggaattcgccggaaggttcacgttccccgcgcaggatttcgttcatctcttgaacgctttccatcagctcatcaaaaaacttgctcatagctatctccacatgtaggccaatggcttagtcattcagcaatgataattccgcgctagccagccggcatccgatgagctgtaactgactttttgaaccttgatagttagtggagtagatcgagctagattgccggaagcgccgagcggcgcccctttaatgcgttggagtttccatatctgcgccattacacagaaaaatgccccgtagctgaaccagctgcgggggcttttttgtttctgtttttacatcggtagggctagccagcctgccccaccaagctattactcacattccttcccaacaccagcaccgtcacaaacccaacccccaccagcgccgtagccaaactcaacaacaccgcgctacccatctgatcgacaatccgcccgccaaagaacgaacccagggcaataatcacctgaaacaacgcgacaaacagcggcatgccgcgctccacatccttgggcgctacgacaaacatccagatactcgcgcaggccgggaaggcgccgaaggcgaagccccacagtgcgatcagcatcacggcgccggtcatttcggtggcgaagtaggggaacagggcggtgctggtgccgatcatcagcgcgaccaacagcagggtgtggcgcacgctgcggttggcggcgaagccggcgaagacgttgcccatcaccccagccacaccataaagcaacagcagtgagccaatcgtcgggccgtcgaagccggagctgtttttgaagaacggtgcgacataggtgtacgccgcaaagtgcgccaggccgatcagcaacacggcgatcaagccgacccgcgcttgtgggttgatgaacaacgccggcaggtcacggatctgaatggccttttccggagtgagccgcggcagcaggaatacctgcgccagcaacaccggcacgcccaccagcgcggtgaccaggaaggtcatgcgccagcccatcaggccactgagccaagtgcctacgggcaccccgagcacggtggccagggtcacgcccatcatgatgatcgaggtcgccttcgctacgcccacgcccttgggggccaggcgcccgctgagtgcaatggctgtcgcccagaagccgccaatgctgatgcccagcaggacacgaccgaacagcagcaggctgaagtcgctggcgtaggccaccaccgagttggcgatgatcatgatcagcgtcaggccgatcagcaggtagcggcggtccatcgccccaatgctcacagacagcagcggggcggcgagggcggccatgatgccgggcagtgtgaccatcaggccggcatggccggcgctgatgccgaggtcgctggcgacatcgttgagtacgcccactggcagaaactcgctggtcaccagggcgaaggcacccacggcgactgagagaatcgccagccactgctgtttgacgctctgttgattatgttcagggcggccactgggggcctggctgacgcttggcatggtgttgggttccataggggaatgtcgcttgaaatcaagcgaggtgagggcagggaaagtggaggcgattatatgaaccggttctggcaatcacacaggcgaccgtttcgataataaccatcagtgcaatcgattcgacgcccctatgggataatttcgtctttcgtacatcctttccgtacgttgcctacaggcagcgtgttgcggctttcgcgctggctgcctatcttggtttcgaggaattttcaggtaggaaatcccacaccgcaaaggacatgcatcatgagcaaaaacacgaaaaaaacttccggcacgatggctacgttggccgctgaaaccctgaataatccaaatgcctgcgcgatcgccaaaagccttgccgcctcagcgttggcacagagcagaacggataagcagaccagcgccgagatggaggaaaaggccggcaaagcgcttcaaagcgataaatacagtgaacagaccaaatccctggctgcgtcggtactctcccaagccaataaagaacgcgcaaactaagcgcctgactcggcgatgacatagaacggccccgtagctgaacccgctacggggcttttccgtttgcggacttgcaaaaaatttaacgtctcaccgaataacttcccccgctgcggtgttcaccccacagaccacccagggaacgcccatgaacacaccttccgatcgctatgaccgcctgacccgcaccttccactggctgaccgctgccgtggtgatcttcatgtttgccagtgcacatatctgggaaaacctcgaaaagggcacaccgctgcgcaagggcctgcaatcggtgcatatctcgctcggtattgcgatggcgttgttgatcgtcctgcggattgtgtggcgtgtgtttggcggcaatcgcctgaaggccgacagtcacccggcgcttaacctgctggcgaaaatggcgcatggttgcctgtacctgttgttggtgtcgcaaatcgtattggggttcctgtttcgctgggctcaaggtgaacccttcaattttttcggattgttccccattcccgcgccctttgtgattgaccacgaatggcgcggcacgctgggtggcctgcataacaatgtggcctgggcgatcattctgctggcgggcctgcatgctggcgctgcgctttggcatcactatgtgctgcgcgacggcacgttgcgcagcatgctggcgggttcacgcaatgcgtttcaaaaatgatgtttcctccctgacgttacggagcatgacaaccatgaagaatcgccacgaacaccccatcacttaccgcaccgcgttgttctttggtgcgtgcctggccgccgctttgctcgcaggccaagcccacgcctccggggatgaatcggcaccgcccaaaccgaactgccccaaaggccaggtgtgggacaccaagaccgggaaatgcgtgctgcaaaccagcaaagccacctccgacgccgaccgcaccgattacgcctaccgcctggcaaaagatgggcgctacgacgaggcattggccctgctcgacaccctgcaaaacccgaacaccgccaaggccctcaactaccgtggttacgccacgcgcaaactggggcgcaccgacgaaggcatcggttactacctgcagtcagtcgcgctcgaccccaattacgcccaggttcgcgagtacctgggcgaggcttatgtgatcaagggccgcgtcgacctggcacaagagcaactggtgaaaatcaaagccttgtgcagcaccacctgcgaagaatacgaagacctggccgaagccatcgccgctgcgcctcaggcgtgaaaccgatgagtgaaccagcagggggcggctatcaccacagaggctgagtttcggcgcgagttgggcctgttattgccgcgtttatggcgatatgggtgggtgttgtcgcggcaaaatcacgtggctgaagatctggtgcaggccacctgtgtacgcgcactggagcgtgccgggcaattcacagccggcacgcgattggatcgctggctgctgtcgatcatgcattccatctggctcaacgaactgcgctcgcaacgggtgcgccaggggcaagggtttgtcgatgcggagcaggcattgtcgttcgatggcgagcgccaggcgcaggatcaggtattggttgcgcaagtgatcaagcgcgttaacgggttgcccgaagcgcagcgggaaacggtgtttctggcgtatgtcgaagggctttcctacaaggaaattgccgaagtactgcatatcccggtggggaccgtgatgagccggttggcggccgctcgtgtgaagcttgcagagaccgcacctgcaaaagcccagccggaaaaatccagtggagaacggcgatgattcagactaacgcaccgtccgatgagctcttggtggcttatctggatggcgaactggatgctgaacagcgtcagcttattgccgatcagctaaaggcaaacccctctgttgccgcgcgcctggatgaattgcaatgcgctgatttgcccttcaaggccgcatttgactcgatgttggacgaagcacccaccgaacgcttgaacgcgatgctcaaagccctgccaactgcgcaagcgccagtcatgagtcgacggcgcttcctggctgtggcggcgagttttgctgtggcgggtgtggtcgccgaccgcctgtatatgagctggccacgagcagagtccggccaaggttggcgtgcctcggtggctgaatacatggcgctgtacacgcctgaaaccctggaaaaccttaatgctgatccagcctctcatgccgcccaacttagctcagtgggcgcgcaactgggcctgccgttatcccctgacgccgtgaacttgccgggtgccgagttccggcgcgcgcaaattctcgactatgacggcgtcttgattggccagctgacttacttggactcgcgccacggcccattggcgctgtgcatcaccgccagcaaaaggggcacgcagcccgccgctaccgagcagcgccgaggcatgaacgtggtgtattgggccaacccgtcccatgctttcatgctgattggtcgaaattctttcgaggcattgcaggtcatggccagcagtgtcgagcgcaggctgcccgcctgatctcagtgggttgtcagcgcttgcaacgctcgccagcgcgccggcgtggtgccttcccaggcgcgaaacgctcgataaaacgagttggtgtcttcatagcccagcaggcaagcaatctcttcgatttcgatggtcggctcggtcagcaggtggcgcacaacttcctggcgcgtttccagcatgagttggcgaaaactactgccctcttcggtaatgcgccgctgcaacgtgcgctcgctcatgcccatttcgcgcgccacctcgaccatctccgggcgaccgctggcgagaatgcgcttgagggtgcttttgacctggtggcttatcgtggccggcgcagtcgcttcggccaatgccgcggtcagtgccgggctcagcatttccagcagttcaggattgtgactggaaaagggccgttctaaatcggcggcgtcgaacaccagcgcgttacgctgcgcgccgaaccgtacggcacagccgaaaaagtccgccagcgcagtattgccgctttgtggacgggccaattcaacactgcgtggcgttatatgcaccccggagccgcggcgtcccaactcagtaaacgtcgcaaatgccgcgtcgatcaataacgttggcgggtgctgctgggtacgcagccaatcgacggtgactgtgcagccagcgccatcttcgctcacctgcacgcgctcgggcgtgcacagttgcttgaagcgggcgaggcggtgcaggccgtcccgaaagtcgcgggctataaacgctgcgaagctggacgggggcagtgtggcgctgtccatttcggtgaccatcagcaagccggccgctgggtcggggttgagtacgccaatggcttgccacagacgaaagaattcttcggtactgacttggcggcggtcccgacgctcatgaagattgagcgtcacaggcagccgtgcctgacgcaacaccgccgagggctccagcccaatcgtcctcagggcttgccagaaaacgtcggggatattgaaacggctttggcgtgcgtcagacatgggccacctttgtttgtttaatccgaggccgacacactcaggtcatgccatttctcgtcggaggctgccaggtctgccgccgcccgtgcggcgtactgcacggcatcgctaccgatcaacaagcgcagcggcgcgtctttgttcagggccagcccaagcacgatctcggccacgcgctcggggccagtcggcagaatgccaggaacgttgagcagctcaaccagggcgccgacgctttgctggtagggctcgctgatcggtgggatcgtcatcgacgcacccgaccaatccgtgcgcatgccaccgggctccaacacggtcacttgaacgcccagcgggtttacctcctgcgccagcacggttgaaaacccgccgaccgcccatttcgcactttggtaagccgccaggccggccatgccaatacgcccgcccaacgacgatacctgaaagatatgcccgttgccctgggcgcgcaggatcggcaccacggccttgctcacatgcaccacgccgtaaaagttagtgtcgatctgcgccgaaaaatcctccagggtcacatcctcgaccgacgccaggtcaccataacccgcgttgttgaccaccacatccaggcgtccaaaatgcgccactgccgcgtcaaccgcctctataacctgctggttattggtcacatccaactgcagtgggtaaaccgcatcaccgtattcggcgaccagcgcatccagctggcgagggttgcgtgcagtggcaaccacacgatcacccgcgcgcaaggccgcctcggtgatggcgcggccaaggccacgggaactgccggtgataaaccagatcttggacatgtgaacacctcttcgtgtggaacggctgatacagccagtgaacgaaggatggtcgaatggtgtttttcaggcactagcgggaaggcgccaagtgacttgcaaaaggcgccaatttagctcgttgttgatctgttggaacactggggagattttgaccgcgggcattcaatcctacttggagattggaagcttgccgctgatcacataggtgtcgaagactttctggccatcacgcgcggcttgccgtacatcgaggaaagtcagctcttcgctgacgacctttttgcgtggcttgtcgacttttttggtggtggccatcggaccctccgagggatgtgtgttcatggcgtccagcttatgtgaatagtgatgactgatcaaaccgcgcctcattgcacgggttcacaggactctatgggttgcctcgatacaggttcaagggcttcgctgaaagagctgtctggtagctacgtaagacgaatctctaagtgcatcagcacgtgcttttactctgccaaccgcccggacaaccgctcgataaacaccgtttccgcccgactcatcttctgctcccgattccacagaagatgaatatccacatcggcaatcccttcatccggcggtagccgccacagcagcccattcttcacatcctcggccaccacgtgaatcggcaggcagcccaaaccgtagccggcaatcaccagccggcgtacttcctccaggctcgatgacgacgccacgatccgcccgctgaagccttgctggtcacgaaagatcgtcagcggtgacagcattccgccaatctggtcgctggtgaaactgacgaagttttccgactgcaaatcgccctcggccaggccgctgcggccgaaaagcgcgtggtgtttgccgcaaaagaacgcataacgctggcgcaggaacaggtgctgttccaggcgtggttgcggccggcgattcaggctcaggcccagggttgcggttttttccagcagggcggcgacgatgtcggagctgcgcatcacctcaacttccaggtccacccgtgggtgctcgcggtggaagtcggcgaggaagtcgtcgaaggtgtccgagttgatgcggctgatcatcagcaggcgcactttgccaagcacttcatcgccgggtttttgcagggcattgctcatctgcgacacctgcccgtacatctcgccggcgatggcgaagatctgttcgccggcttcagtcagcacgaagcgcgggccacggcgggcgatgagttggcagccgagctgttcttccaggcgcttgagcgcctggctgatcgccggttgggtcaggtgcaggcgcgcggcggcgcggctgatgctcagttcctggccgataacacggaaagtacgcagcagattccagtccaatcggtcgttgagcagtgggtgaacatcgcggcggaattcgggcatggcgcagctcgataataagcaggatttataatcggaataataaatagaaaattgactaatcatagccccgggacgataaatcacccttaacaagcgccatcagagcgcatgcgtttgactttctcctgccaaaaaaataaccaaaggagcccgccccatgaagccttccgcttcgccgcagccgcgccgtgctgcggccgccgcttttatcggcaccatgatcgagtggtacgacttttacatctacgccaccgctgccgcgctggtgttcggccaactgtttttcccttccgacgacaagctgttcagcaccatggccgcgttcggcaccttcgccgtgggctttttcgcgcgaccgttgggcggcatcgtgttcgggcatatcggtgaccgcatcggccgcaagaaatccctggtgatcaccttggtgatgatgggcgtggtcaccgtgtgcatcggcctgttgcccacttacgcgcagatcggcgttgcggcgccggtgctgttggtcttgctgcgcgtggtgcaaggcattgccgttggcggcgagtggggcggggcggtgttgatggccggcgagcatgcgccgaagggccgtcgcaacttctttgcgtcgtttgcgcaattgggcagcccggccggtttgatcctctcgctgctggcgttcagcgcggtcacgcggttgccggaagaggacctgctcagttggggctggcgcctgccgttcctggccagcgctttgttgttgatcgtcggcttggcgattcgcctgggcgtcaacgaatcacctgagttcctcgaagacaaagccatcgccgagaaagcgcgggcgatcaaaaaagaccaggcgccagtgatcgaagtgctgagaaccgcctggcgccctctgttgttgtgtatcggcgccaacacgctgggcattgctggcgtgtatttcaccaacaccttcatgattgcctacagcactcagcaactgggcctgccgcgctcgctgattctggagtgcctgttcttcgtcgccatcattcaattctgcgtgcagccactggctgcctgggtcgccgaaaaagtcggggccacgcgttttctgtgcgccatgaccgtactggcgatggcctcgccttatccgatgttcgtgctggtcagcagtggccaggcgccgttgattgtcctcggtatcgcgctggcagtggtctgcatggcgtcgttttatgccgtgatcgcaggtttcgtcagcggcctgtttgaaacccgcgtgcgctacaccgcgatctccctggcctaccaggtgtgcggtgcgctggccggtggcctgacgccgttgatcggcacctggctcgcccacgaataccagggccaatggtggccgatggcagtgttttacagcctgatcgcggcgacctcgctggtgtgcgtactggcgttgtcacgccgccacgccacggctcaccgtattgaaatggcacacagcgtttgatggagactgcgtaatgttgaaaattaatggcgaacgcctgtgggccagcctgatggccatggccgagatcggcgccacatcacgtggcggcagttgccgcctggccttgagtgccgaagacaaagcaggtcgtgaactgttcagccattggtgcaaagctgccgggctgaccctgagcgtggatgccatcggcaacctgtttgctcggcgggccggcaccgatagcgacgccgcgcccgtcatgatgggcagccacctcgacacccagccggaaggcgggcgctttgatggtgtctacggtgtattggccggcctggaagtgatccgcagcctcgacgaccaaggcattcaaacccgtaaaccgttggaaattgccgtgtggaccaacgaggagggcgcgcgtttcaccccggccatgctcggctcggcggtgttcaccggcagcctggcgctggacaaggcgctcgcgaccgtcgatgtcgacggtatcagtgtggccgaggcgttgcgtaccacgggctataacggcgaacgtccgttgggtggcgcggtggatgcgtatttcgaagcccatatcgagcaaggcccgattctggaagacaacgccaacagcatcggcgtggtcaccggcggccaggcgattcgctggctcgacgtgcgggtcgaaggcatggctgcgcatgcaggcaccacaccgatgccactgcgcaaagatgccctgtatggcgcggcaaaaatgatccaggcgctggaaaacctcgccaccgatttcgcccccgaaggcctgaccaccgtcggtgagctgagtatcaccaaatcgtcacgcaacaccattcccgggttgctgacgttcactgtcgacctgcgtcatcaccgcgacgccgatatcgaagccatggagcaacaagtgcgtgcgcggctgcaggccattgccgaaaagcgcggcctgacggtcagcatcaccccgcattgggtcagcccggctacgccgttcgatgccgagtgtgtcgcctgcgtgcaggcctcggtggatgccttgggctacagccagcaacgcatcgtcagcggtgccggtcacgatgccatccacctggcgcggtactgcccgaccgcgatgattttcatcccgtgtgtgggtggcctcagccataacgaagccgaagacgtattgcccgaggatgtgcgccaaggcaccgatgtattgctcaacgctgtgctcatgcgcgccggccagacccaataacaactcaactctaaagcctgcccggattcaactgtgggagctggcttgcctgcgatggcggtacttcagacagaccgccatcgcaggcaagccagctcccacaggttcggtgtttacccaggagcctcacatgcgtacgtttttccacccagaacaactgttgcatcacccgcgcagctactactcccgcggccagatgcgcacgccgcaggaagtccccgagcgcgcgcgcaacttgctgttagccgcgcagaccctgggcttcgagattcagcaacctgctgactacggcctcgagccattgcttgcagtacatggcgcgccctacctggcgtttcttgaggaggcgcaccaacgctggaaggaaatccccgaagactggggcgacgaagtcatgtcgaacatcttcgtgcgcgagcccaatgccctgcgcggcatcctcgcccaggctgcacgctacctggcggatggcagttgcccggtgggcgaactgacctggcgttcagcctattggtcggcgcaaagtgcggtggccgccgccaaggacatcctcgctggcgcgcctgccgcctacgcgctgtgccgcccgccgggccatcacgcccgtcacgaggcggcaggcggtttttgctacctcaacaatgcggcggtggcggcgcaggtattgcgcgaaggtttccagcgtgtcgccgttctcgacaccgacatgcaccacggccagggcatccaggagattttctacgcgcgtgacgacgtgctgtacgtgtcgatccatggcgacccgaccaacttctaccccggcgtggcaggctttgccgacgagcgcggtgtggctgccggtgaaggctttaacctcaacctgccgatggcccatggcgccagcgaagcggtgttcttcgaaaaactcgaattggccttgtcggcggtgaagcagttctcagcggatgtgctggtgttgtccttggggttcgacatctacgagctggacccgcaaagcaaagtggcggtgacgcgcgaagggttcgcgcgcttgggcgaatccatacggcaattgggattgccctgtgtgatcgtgcaggagggcgggtatcacctggagacgctggacagcaatgcgcaggcgttttttgacggtcccaaggcgtgggcacgataggcgggcgccaacctctgctgttcggcccttctgcgtgccgggtcaatgcttcacgtggtcgctggcaattgccagcgacttacccaccagtttcagcactcggttacggccaccttctgccagtaagtaagtaccgtctcccgtgcgcacaatcgactgcggcgccttcaagaacgacaagatcgtttgttgctgcccgtgtttatcaatcaacagcaaccgcgcccgatgcgtcgagtcttcattgacccacaacccacgttcatcacacatcaagaatgtgggcttgttcaggcccgacagcaccaccggatcgctgccgtcatccgtcagctcacgcaccacaccctttttcttttccgtgtagagcattcgcccatcggtacagcgtgtgatggactcgccttcgtgcagttggtcacgcagtacggtgagtgactggtcgctccagcgatagcgcagcaggcgtccagcatggctgcggtcttcgatggcatagaggtagtcgccttcatcccacaggccttgcacgttttcgcctttgaacaattcggtgaccgcgccgtccttgagaaagctgacgggggcgttgccggtttcctggctgaacacccagccgccccgcgtggccaacatcccgtcgggtttggacaggttgccgagcacgacgtcgcgcgttccatccagccggatgtgcacgatgctgcccagcccgtccttgagttcctcggagaccatcaacgagccgtcagccatgggcatcaacgacgcggccttggccacatcggtgtgcaaaacctgataactccacgaatcggcggcgcgcaccgggtaaaagctttgccaggcaaaaaagcccagcgtggcggtgcacagcaggccgagcacccacgatgcgaggcgcaggggccgacagtgcttattgggttgagtcattgttcggtgccggtggcggattgcaaggccggtcacggtaccaagcctggcaccgcacggcatcctgcaatttagccggggcagcctgcgtgtcccccttactgggtgcctggcaggccgtccagcccgcggcggatcttctccagcaactcgtcgatatggaacggtttggagatcaggtccatgccttcccccaggaagctttggcgattcgccgcgttttccgcatacccggtcatgaacagaatcggcagagtggggcgcaggcctcgggcgacatcggccaattcccgcccggtcatgtacggcaggcccacgtcggtaagcatcaggtcgatgctggtgtcctggtgcagggtggcgattgcctcatcaccgtcggccgccacgctgcagcggtaaccggcgtcgaccagcacctcggcgacgaagctgcgcaccgagggcatgtcctcgacgatcagcacgtgttcgccgctgctgagcccgggcgctgcaacgggcttggtggttatgctcgccgggcccgaggcagcgggcagcatgatggtgacctcggtgccctggcgggagacgctgcggatctgtgcgtcgccgccggactggcgcgcaaagccgtagatggtcgacagccccagcccggtgccctggcccagcggcttggtggtgaagaaagggtcgaacaccttgtcgatcacactgtgttcgatgcccacgccgttatcgcgcacggagagcgcgatgtaggcgccgttttccagtttcaggtcgccgttggagtaagcagggtaggtggtcacccagatattgccgcccttgggcagcgcatcgcgggcattgatgaccaggttcagcactgcgctttccagttggatcggatcaaccagcgccacggccgggtgggtcgtcagctcgagtttgagcgcgatgtgttcaccgatcgtgcgcaccagcagctcttccagtgagcggatgtgcgcgttgatatccaccggccgcgtgtccagaggctgctggcgggcaaacgcgagcaggcggttggtcagcccggcggcgctcagggccgagctcaacgcggcatcggcataagccttgaccttctcggtttgctgagtgtcgaggcgttttttgatcagctcaaggctggtgataatcccggtcagcaggttgttgaagtcgtgggcgatgccgccggtgagtttgcccagcgcgtccatcttctgtgcctgcagcaactgcgcctcggtgtgcgccagctgggtggtggcgttggtcagctcggccagctgatggcgctcgcgatggcgatgctcggtgacgtcttcgacaaacaccaggctcagttcggcccggcgataaggcgagatttgccactcggtttcgcgcacctggccgtcgacttgcatttgcaaggtgcctttccagcgctctcccgcggcgagacgcaggcgcaactcctggatgacggcgtgctgatcgctggcaaagcattcgagcaaggcgtcagggttcaggttgtcctggatcagttgggcaaacgcatggttgcattcatgcaccttcaactgcgggtccatgacggctatcggcgcgctgatgttgaagaagatttcgcgaaagcgcgcctcgctctcgcgcaaggcgtattcggtatcacgcacgcgcagcaaggtgcgcagggtcgccagcagcacgtccgggtccaccgggtggatcaggtaggcatcggcgccggcgtccaggccggtgatgatgtcgcccgtctcgatggacgcagccgagacatgcaccaccggtagcagggcggtcgccgggtcggcgcgcagcgcgcgcacgatgtcgaagccactcatgtccggcagattgacgtcgaggatcagcccgtcgatcttttcgctcgcgatcaggtccaggccctcttggccggtgccggcttcgagcacgcggtagtgatggctttccaggcgccggcgcagggcgtagcgggtggcggcgttgtcgtcgacgatcagcagttggatgtcacgactcatcgacaggcccgcccgcgatagacagaggaatgatcacaaagaacatcgacccgacgcctggggcgctttgcaccccgacccggccaccgagcagctcggcaaagcgcttgcacagcgagagccccaggccggtgccgcgcaggcgcttttgcagcggtgagtcgatctgggaaaagtcttcgaaaaggttgttgtgcagctcggcaggaatgcccaggccagtgtcctgtaccgcaaagcggatctcgtgcgcgctttccatgcgtgccgaaacgcgtacctcaccttgcaaggtgaacttcaaggcattggagataaagttgcgcaggatctgcgccagctttttgtcatcggtgtagagcttgggcaagcccgagggctcttcaaagatgaggtccaccgacgatgcgtcgacaatcgggcggaacatcccgcgcaatgccgagaacaggtcgaacatgtcaaaccaggcaggcgagatggtaatgcgcccggcctcgatcttggccaggtccagcaggtcatccaccatttcccgcagctcgcgcgccgagctgcggataaagcctacctgggtctgctgctcggggctcaaagggccgtcgagttcatcggcaagcaagctggtgatgctcaggatcgagcccaggggcgtgcggaattcatgactcatgtacgacaggaagcggcttttcaggtctgatgcctgacgcaactgatcggcctgcatatccagttcggcatacagtgccagcacaccctggttggtctcgtccaactcggtacgcagggcgtcggcttcctgctgcaggcgttgcacttgctcagtgagcgaagcaatggtgtcagccatcaatggcctccagggcaatcacgaagacggtaacgtcatcccggccgcgacagaaatcacggtgaaggatggcggcgatcagggcggggtggcggtggcaaagcccgggatagtccgcaaggttccagcgtgactgcagcccgtcgctgtaaaggatcagcagttggccgctgacctgagcgtagtcgaagggttgcgccttgcgatactgcacgccgacgatgcccgggtgggaagccagcccgcgcgacttgccgaagccaatcaggctggcgccgatattgcccacgccggtgaagcgcagccggtcagccacggcgtcgtattgcgccacggccactgcgccgccccgggtgccgttcatgccgatatgcatgtcgttgagcagcgtggccgagtcctggaaggggtcttgggcgaacatctcttcacccgcgcgcgccgcgcgttcggcttcgctgccatggcccaggccgtcggcaaccatcacgctgaaccggcccgcttcgattgccaggtgccaggcgtcgccgcacgccggatcgttgtgcaaggaatgctggctgacgccatagcggatatcccgcgcgttcgaggtgcgtgggtagagccgcgccaacatcgccgtgccccgctgatcggcatgcacatcaaagacctgggccacgcgcgagatggcgcccatgccgatgccttgcgtgccgcccgtggagaacccatccaccaggcagctttccaggtcgaagccctggccacggtcgacggcgatcatttcgacgccctggttgcccgtggcgcgcaggtgcagctcgccatgggcggcatgcttgaggatgttgctggcaagttcggttgccaccagggcaacgcgcccggcgtcggtttcatcaaaacccagcagctcggcaagctgctgggcactgcgccgggcatagccgatttggctgacatcttcgatcaaaagcacttgggtcaaagcgctgggaatattcaggtccatcgggtgatcgtcacgcgtgtgcccttgccgggtgcggtgtccagttcaaactcgtccaccagacgtctggcgccggtcaggcccaggcccaggccgctgccggaggtccagccgtcggtcagggccagcttgaggtcagggatgccggggccttcatcgcgaaaggtcaggcgcaggccggggcgatggtctttttcgacgacgctccaatccatgtacccgccgccgccgtagaccacggtgttgcgcgccagctcactgacggccgtgaccagcttggtcaggtcgatcaggcgcatgccgcagtcctgagccagcctgcgtactaattgtctggccagcacaacgtcctgttcgatcagcacgggatgcgtgccgctgctggcctggctcataagtgttctacccgatcacgcagcaggctcatgccgcgctcgacgttcaatgcggtcgccacgccgggcagggtcatgcccagttccaccagggtaatggccaccgccggttgcatgcccaccagcacggtctgcgcgtccatgatgcgcgacaggccggaaatggtgccgatcatgcgcccgataaacgagtccaccatgtccagcgccgaaatatcgatcagcacgccgcgcgccgacgtgcggctgatgcgttcggacaggtcgtcctgcagcgtcatggccagctggtcgtgcatgtcgacctgaatggtcacgagcaaaaactcgcccatctgcaaaatagggatgcgttccatgcttagacagccttgctgatggtgacgcccaggcgtttgagcgccagcgccagggcatccgccaggttggctttggtcaccacgccttgcaggtccagacccaggtgcacgatggtctgggcaatttgtgggcgcacgccgctgatgatgcagtcggcacccatcaggcggatggcggtgaccgttttcagcaagtgctgggccaccagggtgtcgacggtcggcacgccggtaatgtcgatgatggcgatttccgagccggtgtcgacgatgcgttgcaacagcgactccatgaccacctgggtgcgttgcgagtccagggtgccaatcatcggcagggccagcacgccgtcccacagtttcaccacgggggtggacaactccagcaattcttcctgctggcgtttgatgaccgactcacgggacttctggaaggtgcggatagtgtgcatgcccagcgaatccagcagttcggaaacttcccatagttgctcggccagttgcgccggttgttcggcgtactcacgttgcagcaaggtgaacactgggcctttaagggcgaaaatgaagctggcggtttgttgcgagtcctggccgatcaaggcgcggctgtgcgacagcttttccaggaagacccgggtttcggcccagttttcatggcttatttgctgtgagccgccttgcaggagcgcgtcgatcagcagattaagaaagtcgccagcttgttgtttgacgtcatcacccttgacgtttcgcgtggctcccgaagcctcaaggctcgtaatccattcggtcagcagggcagggcgttgggtttgcagcgcctggattgtatgagcttgaagagttgccacgagagtctccttgaacggctttggttgatcgcgtgcaatttatactaagttggattgttttaaattgtttcgtggatttttcgtgttgaaatcccactgtattgctgactttcatcgtgggtatccaagccaatcggttcccttgcttgaacactgtcagtatcgacagctgtctcacgggttttatccatcttaattgcgagtggcgccggtaaggcgtcatacgcagtgaaggtagcaggtcgtcgcggtgcgggcgcacataacgcgcttatatcattggctgcatcgttgtagccgggttatcaattcaaacccgtgcaggcacacatggcgcaccctcaccacccgtacgataatgccccccaaatcgaccacactggcctcttcccgtgatcatcaactttgacctcaacgacctccaagccttccgcgccgtggtagacaagggcagttttcgcggcgccgccgaggccatccgtatctcgcaaccggcgttgagccggcgtatcgaaaaactcgagtcggcgctggatgtgaagctgttcgaacgcaccacgcgccgcgtcagcctgaccatggtcggacgggcgttcctgccacaggtggagcgcatgctcgacgacctcgacgtcgccttgatgggcatcagtaacgtcgcgtcaacgcgcatgggcaacgtcacgattgcctgcgtgccgtccaccgcttactacttcatgccccacgtaatctccgagtttcacaagctgtacccgaagattcgcctgcgggtgctggacgccagcgccggtgaggtgtgcaacgcagtggaaagtggcgaggcggatttcggcgtgagtttcagcggcagcctggccgatgaggtggagttcgaattgctgttgcaggagcgctacgtgctggcctgtcgccgcgaccatccactggccgagcgtgagagcgtgacctgggccgaagcctatgaacacgactacatcaccgtggacaaaacctcgggcaaccgctttctgctggaccaggcattgcgcggcgtgcgggtgaaaaaaccaagtatctgcgagacccaccacgtgaccaccatgatcgggctggtggaggcggggttgggcgtggcgatggtgccgtcgattgcgatgccggcgtgcacgcacccgattctggtgagtgtgccgctggtggagccgcaggtaatgcgcaatgtgggcttgatcaagcgccgcgggcggacgttgccaccggcggcgctggagttggagcggttggtgcgggagatgccgtttcggtcagtgtgacaccgagtccaggccggtggattgcaccaccggttgcgcctctggcgaggccaggaactgcaacagcgccttggcctgggccgggtgttcggcgttgaccggaatgcccgccgcaaagcgggtgaccgattgcacgtcttccgggatcttgccgacgtaagtcacgcccggcaccggcaacaattccgctacctgctgcaggcccacttcgtagtgacccttggcgacctgttcggcgaccggaatgcgttcgatcattgtgcccttggccggcatgccgagcttcttgaacagctctttctcgacatacacgccgctggcactgtccgaatacgccacggacttggcctggctcagcaccgccttcaactcggcatcggtgccgatggccggtttggctgcgccttctttcaccaccaggccgatccgcgaatccgccagttccacccgcgaggccttgtcgaccttgccctgcttgatcaagtcatccagggcgtagccgaccatgatcaccacgtcggcgtgttcgccacgggcgaggcggttgggaatggcttccggcgccttgcccatcgacgggccgaggatggtctcaagggtgtcgccgctctgcttggcgtactgcgggccgagcaatttataagcggcggtgaagcctccggaagtcatcactttgagctcttcggcctgggccgtcagcgccagggcgccgagggccagggccgtcagggttttgtacagttgcttcatcacacagccccctgcatcacctgcccacgggtgttggcgcgacggtacaacgccagtgtcgagcacagcgcacacagcgcggcaaacatcatccagtaggccggcgaggctttgtcttcggtgacgtgaatgaaccatgtggagatcgccggggtgaacccgccgaagatcgcggtcgccaggctatacgccagcgagaagcctgccacacgtacttccaccggcatgatttcggtcagcgccgggatcatcgcgccgttgtacatgccgtagaggaaggagaaccacagcagggtttcgagcatatggccgaagctcggcgcgttgaccacgaacgacagcgccgggtaggcggtgatcacggtcagggcggtcatcaccaccagcaccggtttgcggccaaaacggtcgctcagggtgccgccgatcggcagccagataaagttcgacacggccaccagcaacgtcaccagcaaggcgtccgaggtgctcagttgcagcacggttttaccgaaggtcggcgcgtacacggtaatcaggtagaacgcggtggtggtcatggccaccatcaacatgccgccgatcaccacggtccagttcttcaccagggtcgccagcacttcgcgcatggttgggcgatgtttacggttggcgaactcttcggtttcctgcaggttacgtcgcagtacgaagatgaacgggatgatgatgcaaccgatggcgaacggaatgcgccagccccaatcggcaaccacggccggttgcatccacacgttcaagccataacccagcgcggcggcaaccacgatggagatctgttggctgcccgactgccagctggtgtagaagcctttgcggcccggtgtggccatttcggacaggtaaaccgacacgccgcccagctccgcaccggccgagaagccttgcagcaagcggcccagcagtacgagcagaggtgcccacaggccgatggtctggtaacccggcaccagcacgatcagcagcgtgccgctggccatgatcgacagggtcacgatcaaccctttgcggcgaccgacgtcatcgatgtaggcacccaaaatgatcgcgcccagcggtcgcatcaggaagcctgcaccgaacacggcgaaggtcatcattaatgacgcaaactcattagcggcggggaagaacgcggcggcaatgtaggtggcgtagaagccgaacagaaagaagtcgaactgttcaaggaagttgcccgaagtaacgcggaataccgcaccaactttcgagcgggcagaatcgggccgggaagggctagtcatggtcttgtgtctccagcgttctttttaaagtgcttgtttcgcttaagaccgcggatagtggctgacacatttagaaatgataagtgagtaatttggatgtattgatgcgtcgtggctatcaatcgccaggcgcggccaaaatcctgaccctgttctatgcttgaaggtgtgaccaattcttacggatgggaggtggcaatggctgacgaacacaagcactcggatgagcgcgattgcgagcgggctcggcggcagcgagaagaggaaaagccgcagacgtggaaacatccggacgacggcacggagctgtccgagcgagatcaggagcggccgctaaaaccctgattaccaaggcttactcggttcaaatgtgggagcgggcttgctcgcgaaagcggtgtgtcagctaaaaaatgtttcgactgaaactccgcattcgcgagcaagcccgctcccacattagatctgtgttcagctcgcgattggcttacacaactccatgtgggagccgggctcccacacaagccagctcccacattcccagatcccacattagatctgtgttcagcccactatcggcgtgcacaactccaccaatgtcccatccgggcagcgcacataagacaccacttgcccccacggcttggtactcggcggcgccagctctgtcgcgcccagtgccagggccttggcatgggcaacaagtacatcctctgtgacgaaccccacctccatgcccagcggtttcctggaggcatgcgcctgcacgtgcccaccgtcgaaattcagctcgcccagctcatgcgcggcgaacgagagggtggtgtcaccggtttccaactcgccgtaggtgccggattcatgcaggaaacggcgactgaagccaaaggctttttcgaagaaggccagggaggcggccacgtccggtacatagatgatggtgtaggcgaatttcatgattaagcagtccttgctgaaaaagtaagtggtttaaaaacagctcatgaaagcagcacggaaatgggaaaaccctgggccagtatccaataggccaaggccgcagccaggcacaggccgataaacacccgcgtcagtgtcctgacggtggcattggcgatgaaccggacaacccagagacacaacccggccaccacgatggccaaggtgataatgaccagcacgatggtgttcctgcgaccttaaagagctgatttatagtcccaaagccgtgcgatgaacagtgttcacatagacgcagccccgtgggctttctaaactgcggcttgtcttggggaaaggggcaggcgccgatgaatcgcaatgaattacgcaaggccgacatcaacctgatggtggtcttcgaagcactgatgctcgagcgcaacgtgacgcgggtggcggagaagctgtttctcggccagccgacgatcagttccgccctcaaccgtttgcgtaccttgttcaatgacccactgtttattcgcgttgggcaccgcatggagccgactgcacgggccgaggagatcatccagcacctgtcgccggccctggattccctgtcgtcggccctgagcctgacccacgatttcgacccgacccaaagcaccatgaccttccgcatcggtttgtccgatgacgtcgagttcggcctgctgccgcccttgctgcgtgccctgcgccaggaagcgccgctggtggtgtttgtggtgcagcacgtggattactggcgcatccccgacctgctggcgtccggcgatatcaccgtcggcatcacccagacccgcggcctgccggcgaatgccaagcgcaaattattgcggcatatccgcccctgcctgttgcgtgccgacgcctcggacaaaccgctgaccctcgacgaatattgcgcacgcccccatgtgctggtgtcccacaccgccaacgtgtccgggtttgccgatgaatggctggccgagattggccgcaagcgtcatgtggtgctgtcggtgccgcaatacagtgcgctgccggccttgctcgccggcaccgacatgatcgccagcctgccggactacaccgcccaggccatggcggctggcggcaacctgttctgcgagccctttccgtttgaaacgccgaccctggatttgtccatggtctggctcagccacgtcgacaccgacccggcggaacgctggatgcgctcgcggctggaggcgttcatgagcgaacgcgacaggctgccggtgctgacggcaaagtcttgagataaccgttcaaaccgaaccgcctgaacgaagtttcaccttcaaagcgctctgattcagtgcggctgcgtgctatacgtatgtctcttttactacaacgactcggagcctttcatgccgcatctgcacctggaatacaccgccaacctgacagacctggccgtcgagaaaactctgttgcggctcaacaatgtgctgatggcatccgggcagttcggttccgagttcgatatcaaaagccgcgccgtgaaggtcgagagtttccaggtcggcacgtccctgaacccacgcggcttcatcgccgtgaagctgtcgctgctcagcgggcgctcaccgcaggtcaagaagcagttgtcggaaagcctgttggcggcgttgcaggacatgggcgaatggccggcggacatacaggttcagctcagcgtcctgctggtcgacatggatcgcgagtcctacagcaaagtcgctattggctgagggttacaacaacccctgatccgcgcacactttcaccacctgctcacgaaaccaggtattggcgctgtcctggccgctggtttcgttccactgcatgtccagggtaaaccccggcaaaccgttgggcgcttcgcaatggccgaacacgttggccggtgccagcagcttttgcacgcggcggggcagggtgacgataaagtcggtgccggtaatcatcttcaaggctgcgctgtaactgttggcccgggcgaccacctggcgcttgtgggcctgacgcgccagccagccgtcgatcatattggtgtccgaggaccacggcgtcggaaaaacgtggcgccgttcgacgaaggattgcaggctgaacgccgactcgcgcggcgccgcgcgtttatcgaacacacagaccaaatcgtcttccagcagcatctgggtcttgaagtctttatgggcgcggtgaaagtgcgggccgaagcaaatcaccaggtcgagacggccttcgcgcaggtcgtcggcggggatctcggtttccagcttctgcacattgacgttcaccggcaggtcggcgcggtcgaagttcttcagcaggcgcggcaggatcaactgttcgaagtattcgggcgcgcacaccgtgaaagtcaccgccttctgtgtcgggtcgaaggcctggccaccggcgtggcacaggttgatgctgtcgaggatcttctgcacatgcccgtacatggtggtcgccttgtacgtaggccgcatgcccgcccgcgtgttgataaacagctcatcctcgaaactggtgcgcagtttcttcaggctgtaactcaccgtggactggctgacgaacagcgtttcagacacctcggtaacgctgctctggtcgtagacggcgataaacaccatcaagtcctgcatatcgagctttctgagcaaattactgtttagcatccgttccatccggtaagccttggcactgaggcagcgcgcgacaagggcaaaagcttaacggaacggtcgtgccaatagaaagcgctgtagggcgtttctatgttttgcgtgggacaaataatgttggcaacacgacgtcagtgaatatgtcgtgcgtaatgctttggattgaagcgcgtgacgatcagcagcatcaccacgatcacggcggtcagcgaccaccaggcccattcgaagctgccgagttggtcgcgaatcatcccggcaataagtggcgacaggccagcgatcaggtagccgatgccttgcacaaacgcggtcaggccaccggcgcggcgcgggttgtcgaggtggtcgagggacaggatcaggctcatcggaaacaggccgccgatgcccaggcccaacaggcaaggccacagcaggctcaagtgttgcgggctaagaatcaggccgcagaaacccaggatgatcagcaccagcagcaccgccaccacgccgcgtttatcctggcggcggttggcgatggcgggggtgatcaggccggacaccacttccatggcggtcaagaaccccagcagcagaccggcgttctgctcgctccagccttgctccacgtaatacggcgccagccacgcgagtacgcaggtgtaggacgctgtaccgaggccgaagaagatcgccagtaaccaggcgcgacgattaccgaaaaaagattcctgagggccggaaccggcttcgggcagcggcggcattgccgagcgctgggcgtaccagaacaccagcgccaataacgcgagtgccgcccagatcgccaggccgatgcgccagctgccggtctgcacctgcacgaacggcgcgaacgacgccgccaacgccgcaccgcccatgatggcggtgacgtacaggcccatgaacagcgaaacgttgtcgctgaagcgggtcttgatcaacgccggcatcaacgcctggatcatcgcgataccgacgccggcagcgatggcgctgacgatcaactccagcgccgaatccacaaacaaccgcgacagcgtggccacgccaatcaccagcagcgacagcacaatgctgcggtgctcgccaacgcgtttgcccaggcccataccaaagaacatcgccaggcccatggccatgaccggcaacatggtcagtaaggccgcgctgctgaaactcagcggcacatcgccgcgaatcgatgacaacagcgggccgacggccgccatcgatgggcgcaggttaagggcgaccagtaccacgctgatcatcagccaaacggcggtggtgggttttgtgcggacgttttccatgggtgggccttgaagagacaagggcgaatcaggccacgcaggggcgcagaggggcaaattagaaagtcgttggcactatctaaaaattgcagatgatcaaacctgtgggatctacacaactgctggtggacgcaaaatcgctagtaagtgagctttcgtggcgagcgggcttgccccgcgttgggctgcgcagcggccccagagcctgactgccgggttctatttgaatgaacgcggcgcctttaatggggctgctgcgcagcccaacgcggggcaagcccgctcgccacagcaagccagctcccacaaggatctgcgtcgctagacggcgcggatcacatgcttgatctcctgaaatgccgccaacccccacggccccagctcgcggccgatgctgctttgtttgtaaccgccccacgccgtttgcgggaagatcacttgcggcgcgttgatccacaccagcccggcctgcagggcgttggccacgcgttcggcggtttcggcgtgggcactcaccacactggcgaccaggccgaaatcgctgtcattagccaaggcgatggcttgcgcttcagtggtaaaacgtctgacacacagcaccgggccgaagatttcttcgttccacaacgcactgtccagcggcacatcggtaaacaccgtggggcgaatgaaatagcccttcgacaggtccgccggtcgttcaccgccgcacagcaggcgcgcgccatcctcgacgccacgctggatatgcccgagcacccgctgatactgcgcacggttgatcagcgcgcccatttccacattctcggcaaacgggtccgccacgcgaatcccttcagcccgcgcctgcaaacgctgcaggaattcgtccgccaagctgtccgccaccagcacacggctggtggccgagcagatctgcccggcgttgaaaaaaccaccgccacacgccagttcgactgccaggtcgaggtcggcgtccgccaataccagcagcgaggatttgccgcccagttccaggctcacgcccttgactgtttccgccgcgcgctgcatcacctgtacgccaacggcgttgctgccagtgaaggaaatcttcgccacgcgagggtcagctgccagcggtgcgccgaccgccatgccggtgccgcagaccaggttgaacacacccgccgggaacccggcttcagcaataattcgcgccaattgcagctccgccaatggcgtgacttccgatggcttgagcaccacgcagcagccggcggccagggccggggcgagtttccaggcggtggtcaccatcgggaagttccagggtacgatcaagccgaccacgccgcacggttcacggcgcagacgtgcactgaactcctcgctgggcaacgccaccgggccgtcctgcgcggcgtccatgtcgtcgcagaggccggcgtagtagtcgaaggtggcgatcacgtcgtccacatcgatgccggcttcaaacagcggcttgccgttgttgctcgactgcaactgcatcagctgttcacgttgttcacgcacaccttgggcaaccttgcgcagcagggcgccgcgatcacggccggtgcttttcgaccagtcgttgaaggctgcgctggcggcctcgacggcctgggccacggcgctcgcatcacccacgctgacgtgggccagggtggcctcggtcgccgggttgatcacttcaagaaccccatggcctgcgcgccactcgccaccgataaacacaccgttcagtactgcgctcataccgctacctcctgcatccacagtgcctggtcgatttcaatcagcgtcggcccctggcgatcagccgcagcgcgcaatgccgtgcgcaggtgcgcaatcccctggatgcgttcggcggcgcagcccaaggccttggcgacaccgataaagtccggggtgtaaatgtccacaccgaccggctcgatagcgcggttgagcatgtatttcttgatctcttcgtagccctggttattccacagcagcacgatgaccggcacgcgtgcctcgaccgcgctggccagttccggcaggctgaattgcaggccgccatcgccgatcaggcacaccaccggctggccgtcgccacgccccaaccacgcgccaatcgcagcgggcagggcgtagcccaaggtgccgtagccggtggaggagttgaaccagcgacgcgggtggtcgaggttcagggtcaggttgccgctgtacaccggctgggtggaatcgcccaccagcacggcgtcgggcaattcctccagcacggtgttgaggaacagggtttgcgcgcgggttgcggcgtcccagcctggcgtcaattcggcccacaagcgggcgacgcgttgcgcgccccagtgtggatcgcgcgcgggcaaggtctgggtgttcagctcggccagcaaggcctcggcggcaatctgcgcatccgccaccagtgcgacctgcggcgggtagttgcgcacggtctggtcagggtcgatgtcgacgcgcagcaacgcgccgggaatctcgaagccaccggcgaaggtcacgtcgtagtcggtttccgccagttcggtgccgatggccagcaccacgtcggcttcggcgaccagggcgcgggtggcgaccagcgtctgggtcgagccgatcagcaacgggtgcgcggacgccagcatgcccttggcgttgatggtcagggccaccggcgcgccgagggtttcggccaggcgtgtcaattcgggggctgcctcgatggcgccgccaccggcgaggatcagtgggcgttttgccgccgccagcagccggctcatttgcttgaccgccgacggcgcagcaccggcacgcgcgacgctgaccggctcgctgccgagcagggcgtcggcgttttcgaccagcacatccagtggaatctcgatatgcaccgggcgcggtcgcccggcctggaacagcgcaaacgcgcgcgccagcacgctcggcaattccgctgctgacatcaaggtatgcgagaacgccgccacgcccgcaatcatcgcgccctggttcggcagctcatgcagcttgccgcgcccgccgcccaattggctgcgcgactgcacgctggaaatcaccagcatcgggatcgagtcggcataggcctggcccatggcggtggtgatgttggtcatgccggggccggtgatgatgaaacacacgccgggtttaccgctggtgcgcgcgtagccgtcggccatgaacccggcgccctgttcgtggcgcggggtgacgtggcggatattcgaacgcgccaggccacggtacagctccacggtgtgcacgccgggaatgccgaacacctggtccacgccgtagctttccaggaggttgaccaatacttcgccgcaggtcgccatacatgtcgctcttgttattgattcgaggcgctattggagcggctggcccgtagcggcaacaatcgataaaaagtcatactagccatgtctccacgtcatggctgtgccccaatgaaacgcctgccaccgctgcccgcgctgcacaccttttgggtcacggcccagtgctgcaacttcacccgcgccgccgagcaactgcacatcacccaaggtgcggtgagccgccagatagccgggctcgaaagccatttgggctacgccttgttccagcgccaggcgcggggcttgagcctgaccgaaaagggccgcgaatggtcgctgtgtgcgcagcaagtctttggcctgatcgctgacgcggtggaacagatcggcagccgccgcgaaaccctgcaactcaaggcctccacctgcgtgatgcgctggctgctgccgcgtttgctgcaatggcaaaaggagcgcccggacgtgccggtggaactcaccactaccgtcgcctacaccgtggactttcgccgcgagcaattcgatgcggcggtgatctacgcgcccatcgccgagcagtcggcgcaggcgcggcacttgttcgacgaacaactcacaccggtttgcgcgccggggctccttgcaggtttgcacacaccggcggacctgcagcaacaggtgctgctgcaccccacgcgggatgaacgcgattgggcgttgtggctaaaggcggcgaatacgcggttgagcaacctggcccaagggcatcatttcgagacgctggatttggccatgacggtggcgtcccagggctccggggtggcgattggcgacagtgcgttgattggcgaggatgtgaaggcggggcggttggcgacgccgtttgaactgcgagtgccgacggggatgggttattacctggtgtatccgccggggactgagccgtctgccggattagtcgccttgatggagtggttggtaagccaggcacaacagtcgtcacactgaagactcaaatgtgggagccgggcttatgtgggagctggctcccacacaagccagcccccacagggatcagtagccgacggtgaaacgctggcgcgagtgcttcggcgactcaacctcgtcaatcaacgcaatcgcgtaatcagcaaagctgatccagctgcgcccttcagcgctcaccagcaagtcatcctggccgacgcggaatttaccggtgcgctcagtctcaacgaactctgccgacggcgacaggaaggtccaatccagttccttttcctggcgcagcgcttccagaaactcagccccggcgctggcttcggccttgtactcggccgggaagcccgggctgtcgatcacgcgcccgccacccggcaacaacaacgaacccgcaccgccgaccaccaacaggcgcttgaccccggcttttttcaccgggccgatcacggcagtggccggcagcgtggcgaagtgcgccgcactgataaccacatcgttgccgctgacagcctgttgcaacgcgttggcatccagtgcgtcgacttgcttgacggtaacgccagggcgcgctgccagtttgtcggtattacgggcgatggcggtgacgctgtgcccacgacgcagcgcttcttccagcagttggctaccggcacggccgctggcaccaatgattgcgatcttgctcatgacgttctccagtacgttaaggtttaaaaccattcaccacttcatttcgcccttggcgactttggcgcccaactccaggctgctctcgtcggcaaggttcgggtaacgcttcttcatggcggcgatcagtgccgtcgagtctttggctttggcggtctcgatatcgaaggctttgatgtagtcggcggtgaaggccacggactgcactgtcggtgtacccaggtaatggcccggaatcacggtatggggtttcagcgcttcaatgcgtttgagcgtcgtcagccagtcggcgtgcgactgggcggtttgcgtgtcggccatccagacgtgggtgttttcaaagaccaccacaccgccgacgaccgccttgatcgaagggatccacacaaaggtgcggtccggctgtgcgccatccaggccgatcacttccagcgtcttgccttccagggtcagggtatggcctggcagcacctgcggaatgatggttttgctcggtgcgtcggcgcccagtttcgggccccagaacgcgagtttctgctcggcggtggccttgatgtggtcgaccaccggctgcgacgccagcaccttcgcgtctgggaacgccttcgtcagcacttcaaggccgaagtagtaatccgggtcgccgtcgctgacgtagatggtggtcaggtgtttgccgctggcgcgaatttttgtcaccagttgctcagcctgagcattgccgaattgcgcgtttaccaggatgacgtcgtgttcgccgctgaccagcaccgagctgacgggcatcatcgccgactcaccggggttgtaggcgtcgagcttcaggtcggcggccgccgcgtgggcggcgaatgccagggcggccgttgcggtggccaatcgtttgagcatcgagatcatgtgcagctccagtaggcgataagtgatgcacagagcttagttgcaccaaacgtcacaaaaaatgccatgcttgaacatagtttgtttctaaaagcgtgcaaatcatggatcgtcttcaagcaatgcgggtgtttgtcacggtagtcgacctgggcagccagtcagccgccgctgatcagctggacctgtcgcggccggtggtgtcgcgttatctggctgagcttgaggattgggtcggcgctcgcctgatgcaccgcaccacgcgcaagctcagcctcactgcggccggtggcgaaatgctgccccgttgtcggcaaatgctcgagttgtgcaacgacatgcagtcggccgtcagtgagccggacgaggcgccgcgcggccagttgcggctgagtgtcagcagctcattcggccaggcgcagctggcggatgccgtggccgagttcgtcaagcgctacccgttggtcagtatcgatatgcagatgctcgaccgtacggtgaacctggtggatgagcgtatcgacttggccatccgcaccagttttgagctggaccccaacctgatcgcgcgcaaactcacgctgtgccgctcggtgatttgcgcctcgccggcgtacctgctggagcatgcacagccgcagcaggtgcacgacctggtggagcacaactgcctcacgcattcctacttcggcaaaagtctgtggcacttcaccgaacacggcgagccggtgtcggtggcggtgcagggcaatatcagcgccaacgaggcgaccacgctgttacgggtaacgctggccggggcgggcgtggcgcggctgcccagctatcaggcgggggattacattcgcagcggcgaactgatccgtttactgcccgaggccgaaccgcaacagatgaatgtttacgcggtgtacgcctcgcgcaaacacatgccgttggcgctgcgcagcctgttggattttctggtgctgcgcttccctgaagaaccggtctgggacatcgggctctgaacccgacataaagatgttgaatggcgccccataatggcaactcgccctgactgacctatgctttaaacagcaccgagtcgatgtgttcagaggtgtgccatgacgctaaagattagaaagtacctgatgattttcatcctgtccgccgtggcgaccgcgctgtacggcacggccgcctaccgggttgaacagactcgcatgcagccgacctttgcggtcagctgccatcaggacctgtgcgtgccacgcaccggcagtttcagcgcgctcagatgatcgttgatcgttcccacgctccgctgatcgttcccacgctctgcgtgggaatggccgccgtggacgctccgcgtcccgaatcaatcagccttcagttgctcgcgaaacgccttgggcgaaaacccgacccgccggcgaaacagccgggagaagttggtcgggtcggaaaaccccaacacctccgacatctcattgatggtcatgctggtgtaggtcagcaggcgcttggcttccagcaactggcggtcatgcatgatctgcaacgcaggctgcccgcccaactcccgacacgtcccgttcaggtgtgagaccgagatgcccagcttgtgggccaaatcctcaatcttcgggtgttcgcggtaatgctgttcaaccaactgggtaaagcggcggaaatattcacgcccgcgcggtgcgcgcgggtggcgacgctggatcgcctggcggctgatccacaccagcagcacgctgaccagcgcgtgcatcatcatgtcgcgcgccggctgctcatcggcgtattcgtcctgcaggcgtgcgaacaggctgttgaggtaatcgctgtccttgccggccgggtaattacccagcacttgcaggccatctaccgtggtgcccaactgagattgcaaatggctgaccagcggcgccgacagcgtcacgatgaaaccttctacatcctcggcaaaccgaaacccatgcacacacaagggcggcagcacctgcaaggtcgcctcgttgagcgtggtgcgctggccttcgatttccagctgcgcctggcctttgtgtacatacaacaactggcacagatccgcgtgccggtggggctggatttcccactggtattctcggctgcgccgggaaatggtttcgcagtgcaacaaatcgggcgtcggccattgctggctttccccgtaaagcttgaagaccggaatcgcggtactggcagttttggtcatggtttcaatccgatactcaggatagtggtgcggtaatcgccccgattggcaaaaagcacaggctttgtctcagttttcaccttcttatgatgctcactcaagtgaaaaatgatcagtaacaagatgaatgacaactctttcacctgatccgttcgggtgtcgcttgcgagccataaaaataatgaaaacgctgaaaacccaagtcgccattattggcgccggtccgtccggattgctgctcggccaactgctgcacaacgccggtatccagaccctgattctagagcgccagagcgccgattacgtacaaggccgcatccgcgccggggtgctggaacaaggcatggtcgacctgctgcgtgaggcgggcgtcagcatgcgcatggacgccgaaggcctggtgcacgacggttttgaactggcgctgaacggccagctcagccacattgacctcaaggcactgaccggcggccagacggtgatgatctacggccagaccgaagtcacccgcgacttgatgcaggcgcgcgaagcggctggcgccatcaccttgtatgaagcgcgcgacgtgcagccccatgacctcaaaagtgatcgaccctggctgacgttcgagcatcagggcgaggcctttcgcctggagtgcgactacatcgccggttgtgatggtttccatggcgtggcgcgccaatcgatcccggctgattcgttaaaggttttcgagcgcgtctatccgtttggctggctgggcattctggccgacacaccgccggtgcatgccgaattggtgtacgccaagcacccgcgcggcttcgccctgtgcagcatgcgttcgccgacccgcagccgctattacctgcaagtgccggttgaagaaccgctggatgaatggtcggatgagcgtttctgggacgagcttaaaacccggctgcccggccacctggcagagcagttggtcaccgggccgtccatcgagaaaagcatcgcgccgctgcgcagctttgtggtggagcccatgcagtacgggcgcctgttcctgctcggggatgctgcgcacatcgtgccgcccaccggtgccaagggcttgaacctggcggccagcgacgtgagcacgctgtttcgcatcctgctcaaggtgtaccgcgaggggcgtgtgaacttgctgcaaaagtactcggcaatttgcctgcgccgcgtgtggaaggccgagcggttttcctggtggatgacctcgatgctgcaccagtttcccgaggcggatggcttcagccagcgcattgccgagagcgaactggcgtacttcatcagttcggaggcggggcgcaaaaccatcgcagaaaattacgtcgggcttccttacgaagctatcgagtagcctgctatcgtatcgagcattcccgcgggcctttcctttcctgcgggccttgctcgaaggttctgccgtgaccaacctgaatcagcctacccaacccgttcccgccgtgcgcagtgtgctggtcgccttgatgctggcgatcttcctcggtgccctcgaccagaccatcgtcgccgtgtcgatgccggccatctccgcgcagttccatgacgtcaacctgctggcctgggtgatctccggctacatggtggcgatgacggtggcggtgccgatctacggcaagctcggcgacctgtacgggcgccggccgatgatgctgatcggcatgggcgtgttcaccttggcgtcggtgttctgcgggatggcgcagagcatggagcagttggtgctggcgcggattctccagggtattggcgccggcgggatgatctcggtgagccaggcgatcattggcgacatcatcccgccccgtgaacgcgggcgctatcagggctatttcagcagcatgtacgcggtggccagcgtggccgggccggtgctcggcggctacatgaccgagtacttgtcgtggcgttgggtgtttttgatcaacctgcccctgggcgccggcgcctggtacgtggcgcatcgcaccctggtcgggctgccagtgccgcagcgtaagccgatcatcgattatgtcggcacggtgctgatgatcatcggcctgaccgccttgctgctgggcatcactgaaatcggccagggccatcattggcgtgatcagcaagtgctggggctgctggcgtgtgcgttggtggcgttgacggtgtttgtctggcatgagcgccgcgcacgcgagccgttgctgccgatgcacctgtttgccaaccgcagtgcggtgttgtgctggtgcacgatttttttcaccagcttccaggcgatttccctgacggtgttgatgccgctgcggtatcagacggtgaccggctctggcgcggacagtgccgcgctgcacttgctgccgctggcgtttggcctgccggtgggggcgtattgtgccgggcgcctgacctcggtgacggggcgttataaaccgatgattctgaccggggcgttgctcagcccctttgcgattctgggcatggcctacagcgcgccgcaggcggtcgggatgaccgcggtgttcatgttgctgtgcgggattgcggcggggatgcagtttcctacgtccttggtggggacgcagaactcggtggaacagcgggatatcggcgtggcgaccagcaccaccaacctgttccgctccctcggcggcgcggtgggcgtggcgtgcatgtcggcgttgctgctggcgttgttgcaggattcgagctttgcgcacttggccagcggcgcgctggtggccgagggcagttccggcaacgtgctgctcgacggcctcaacgccgcccccggcccggcgcaggatgcgttacgcggggaattggcggtgacgttccggcatttgctgatggtcagtgctgcggtgtcgctgctggggctggcggcagcaatagcaatgccaaaccgcgtgctgcgtgggcgcgaagacaaggccaagtaactgacacaatcgagatccaattgtgggagctggcttgcctgcgatagcggtatatcagggccggctgtgcaaactgacccaccgctttcgcaggcaagccagctcccacagttgtttgcattccaatcctgatccggtggggttagtacccaggtgctgcgcgggcgcgaagacaaggccaagtaactgacacaatcgagatccaaatgtgggagcgggcttgctcgcgaaagcggtgtatcagtcacagttgtttttaactgaaccaccgcattcgcgagcaagcccgctcccacaggggttgcattctagttctgatccggtggggttagtacccaggtgctgcgcgggcgtgaagacaaggccaagtaactgaccggatgatgatcgaactgtgggagctggcttgcctgcgatagcggtgtatcagggccggctatgcaaactgacccaccgctatcgcaggcaagccagctcccacaggtgtttgcattccagttctgatccggtggggttagtacccaggtgctgcgcgggcgtgaagacaaggccaagtaactgacacaatcgagatccaaatgtgggagcgggcttgctcgcgaaagcggtgtatcagtcacagttgtttttaactgaaccaccgcattcgcgagcaagccagctcccacaggtgtttgcattccaattctgatccggggggttagtactcaggtgctgcgcgggcgtgaagacaaggccaagtaactgaccggatgatgatcacactgtgggagctggcttgcctgcgatagcggtatatcagtgccggctatgcaaactgacccaccgctatcgcaagcaagccagctcccacaggtgattgcattccaatctggatcaggggctgtaatacccgaccgccaccatgaaatgcccggtcttgcgcaagtaggcgtgcttgttctcgaccttgtcggttaccgggtttttccaacggtatttgtattcaccctgatcctgctcggccatcagcttgaggatcggctcgcctaccggcctgccatccgggtctttgatcttgcgaaagtcggtattcaccagccgcaagttggtgccatgggccacataccgcccggtattcaggtccaccacaaacacatacaagtcatcctgcagaaacccgccctgcaacgcgttgatcgccttgagcgtgccggcttcgtccttgaccagcgctttcaccgccttgtcgcgcaaaccgcgagcctgttctggcgtggcgcgtggcaggtaatagccgactgccagaatccgctcgccgacccgctggtagaacacatgcttgcgctcaaccttgccgtcgttccagttctgccagcggtattccgcctgctggatgccttggccctcgggcactgccagcgcttgtttgaacgaagcttgaaggtccggccccagctgttcggacacatcgcggccgatcaatgcggaggaggggccgccgctggccagcaacacgccttgggtatcgacgacaaacacataacggtcgtggtcgataaattcaccctggcgactgaacgcggcaaaggccttgtcgccgttgctctgatagtaagccagcgccttttccagcagggccttggcggcctgggcgtcatcatcctgagtggccgcgtgcacctggctgaaacacagcaacagcagccacgtgagtcggagcagtcctttcattactcgtccctcattgttattgatgtgagcacagcgtagacgcctgcggctcagggcgccgccagccattgattgacgataccgtcgtacacgccggtggcgacgctcaagtgcaaccactggtcgacgtagcttttccaggccacgtcatcgcggggcagcaggaaggctttttcgctgtactgcatttgccgctccgggttcaccgcgcacagcccgggcttgagcttctgctggtagcgcgcctcgctggcgtccgtaatcatcacgtcggccttgcccgccagcagctcatcgaagatggtcacgttatcgtgtaaacgaatctgcgcctgccccaagtgggcgcgggcgaacacctcgttggtgccgcccgccggctcgatcacgcgcacctgcggctggttgatctgttcgacggtctggtagcgctgcacatcggcgcagcgtaccagcgggatcttgccgtccacgcccaaggcctggctgaagaaggcttttttctgccgctccagcgacaccgaaataccgcccacggcgatgtcgcaacgttgggcgaggaagtccggcatcagggttttccaggtagtcggcacccaggtgatcttcgcgttcaggctcttggccagcgactcggccatggcaatgtcgatgccttcatagctgccgtcggcgcgcagcgaggtgtagggcttgtagtcgccggtggtgcacacggtgagcgtgccgcgctgcagcaccgcgtcgaggcgcgattcggccacggcgtgggtggccaggctggccaacaggcagaaggtgaggggagctttcatgcagtcgaatcctttgggggcatgatcgggagcggtcattatttccagcggggcggcccggtagcaaggcccatgcaatgtttagccagcgcgcaaccaaactccatcaaccctgaatttaacctcctatgctggcgtgtgacgctgccgggcatctacctcactgtgaatcccgcatggacggttcccccgacactcaccccgcgacaccgcctggcacctgggtgccgagctgtccgtcgattgtcgaggcactgccctccgagctggccttctgggccttgttccactgccgccacgcacgcccaccagatacctctctcctacgttgatttgccccatggatgacgcgcacctgtgcgcatctgcccggcggcgcctgtgcgcctgcctgacgcaaacgtatgagaattgtcatgagtgtttttgccagcctgcacgaagcccaatccttccttgagcagcacccggacatcgagatgttcgagctgtttatcctcgacaacaacggcgtgccgcgtggcaaattgctgcaccgcgacgagctgctggcggtgtacaaaagtggccggccattgcccagcaccatcctcggcctgacgattaatggcgatgacgtggaaaactccgggctggtgtgggaagtcggcgatatcgactgccgcgcctacccggtcagcggcagtttgcagcgcatgccgtggcggctgatcccgacggcggcggtgcaagtcagtatgcaccccaccgaaggcctgcccgccaccgtggccgaccctcggcacctgctggccaaggtgatcgacgggctgaaagccgacggttactacccggtgatggcggcggagctggagttttacctgctcgaccagaaacccgacagccacggccgaccgcaaccggcgcgggatgtggacggcaatcgcccgcgctcgacccaggtctatggcctgcgcgaattggagcagatcgagccgttcctggcggacctctacagcgcctgcaaactacaaggtattccggcgcgcacggcgatctccgaatacgccccgggccaggtggaaatcaccctggaacatcgcgctgacgcgctgcaagccatggacgaggcggtgcgttacaaacgcctggtcaagggcgtggcgcacaaacacgggatgaccgcgtgtttcatggccaagccgttcgatgacctggcgggcaccggcatgcacatgcacgtcagcctcgccgatgcccacggcaataacctgttcgccagcgaggccgccgacggcacgcctttattgcgccacgcggtgggcggcatgctcagcaccttgctggattcgttactgctgttttgccccaacgccaactcctaccgccgctttcagaccaacagttatgcaccgctggcggccacctggggcgtcgacaaccgtaccgtcagcctgcgcgtacccggcgggccggccaactcccggcacatcgagcaccgtatctgcggcgccgacgccaacccttacctggccgctgcggcgatcctcgctggcatccatcgtggtatccgcgaacaactcgaccccggcgccccggtggaaggcaatggctacgcgcaagccaaggaattgctgcccaccgactggctcaccaccttgcgtgccctggaaggttccagctgggcgcgggatgcgttcggcagtgagttcctcggtgtgtacctggcggtgaagcgtgccgaatatcgccagttcatgggcgaggtcggcgagcaggactggcgctggtatctgcaccaggcgtaatccactgtgggagccgggcttgcccgcgataaccataggtatctacacaacaatccttcgtggcgagcgggcttgccccgcgttgggctgcgtagcagccccattccaggcgccgagttcatccatatagaactcggtcgtcaggttttggggccgcttcgcagcccaacgcggggcaagcccgctcgccacaaaagatcgactgcaacaggattcctgtgcatcggcagttgtgtagatacctaagccgcgatagcggtgtgtcggccagtgatgggttgcctgacccaccgccatcgtagcttcgctgaagctcgacaactctcacaatggatcttgggtgttgggtggccgtggcggtttcgacctttttttcacgttgcagtggttaagctgcggttcaaggtcgttcactaccgttctacacacatgagcccgtgatgtcgtcacaaccaccatcctctatcgagattgaattcaccgagcgctgcgaccgtgagcacgccagggtctgtggcgacacgcgcccgccacggctgcgccagcgcatggcggcgtggcgcgatgagcggttggtgcgccaggcgttgaaagtcgccggcgaaccggggcttatcctcgacctggcctgtggctcgggtcggttctggccggtgttggccgaacacatcaaccgcgtgattctggcctcggacaactcccaggccatgctcgaccatgcgcgcactcatcacccggcggcgttgctcaaacgggtcaaaacgttccagggttcagcattttccatcggcctgtcggcgaatgcggtggattgcattttctgcctggaattgtttcgccatgtaccgagcagcgaagggcgtttggcgctgctcggcgagtttcatcgggtcagtcgcgacacggtgatcgtctcggtgaatgcgcagacggctgccgagggcgaattccgccaagccggtttcaaagtcttgaaccagcaagagttcctgccgggctccaagcgttggcgggtgtacgtcctgcgtaagagaggctaattgccgcctgtcggattattctttgtctcttgtcggagttttcatgatggtgtgtgcactgcggatgctcgcaagggtctttcgcgatatatactgcgcgccattcttcaagggagagccgtgtggccatcgatattcactggatctgcgacaacgatagcctcggcaagcattgcgccgaatggcagcagttgccattcgtcgccctcgacaccgaattcatgcgggtcgacaccttttatcccattgccgggctgatccagatcggcgatggcgtgcgcgcttacctgatcgaccccctgaccatcgacaactggcaacccttggccgccttgctggaaaaccctgcggtgatcaaggtggtgcacgcctgcagtgaagacctggaagtcttgctgcgcctgaccggcagcctgccggtgccgttgttcgacacccaattggcggcggcttacctgaacctcggtttctccatgggctactcgcgcctggtgcaagccgtactcgatatcgaactgcccaagggtgaaacccgctcggactggctgcagcggccattgtccgagacccaagtgagctacgccgccgaagacgcggtgcacctggccgaggtctacattcgcctgcgcccgcgactgtctgacgacaaatacgcctgggtactcgaagacggcgccgaactggtggccaacctgcgccgcgaagtcgacccgtacgaggtgtaccgcgacgccaagctggcgtggaaactgtcccgcgcccagctcgccgtgctgcgtgaactgtgcgcctggcgcgagcagcaagcccgcgcccgtgacctgccgcgcaaccgcatcatccgcgagcactcgttgtggcccctggccaaatcccagccggataacctcgctgcgctgggcaaaattgaagacatgcacccgcgcaccgtgcgccaggacggccagttcctgctggacctgatcaaacgtgccggcagtgtgccgatggaccaatggccgccagccgtggctgagccgctgccggtggacgccgccacgctgatcaagcaattgcgcgcgctgggccaggccgaagccgaacgcttggacatggcgccggaactgatgctgcgcaagaaaaccctcgaagccctggttaaaagtggctaccccgatgggccttatacattgccagactcgctgcgtggctggcgccgcgagttgatgggccaggcgctgctcgacagcctggccactgccggagaacagccttgaaacgtatttgctccatctatcgcagtttgaaaaaagacgggatgtacctctacgtgctcaaaagcgatgcgctggagcgtgtgccggagccgttgatgcaagccttcggcaaggcccatctggccttcgaaatgatcctgacgcccgagcgcaagctgtcccgcgaggacatcagcgtggtcctggaaaacctcgacaagcagggctatcacctgcaaatgccaccggccgaagacgagtacatcgagcacttgcccgaagagctgctgcgccgcaacgacccgatgtgatcagtcagtgcccggatgcgggcacattcttcaatgcaaacgtattcgttggcggtggccgtaaggatgcgggcggccgtctgcagtgtttttgaaaggtttgaaccatgcgtgttctgattgctgaacaggattacccgctctacgcccaactactccgtgaagcggcaccggacgtcgaggtgctgaccagcggcgactccgccgaactctcgcgcctggccgccgattgcccggtatggctgggccagccggacctgttggcgaccttgttgcgccagggtcaccaaccgcaatggctgcaatcgacctgggccggtatcacaccgctgctggccgacggtttgccccgcgactatcgcctgacccgcgcagtcggcatctttggccaggtcatggccgagtttgtgcttacctacatgttgggccatgagcgtgaagtgcttgcgcggctggtcagccaggtcgagcgcaagtgggacaaccgcatgggccagagcctggccgggcgcaaggcgctgatcgtcggcaccggcgatatcggccagagtgtggccgacttcctgctgccgtttggcgtcaagttgtatggcatcgccagctccgcacgggagcaggcaccgtttatcgaagtggccgggctggatcaattgggccgcctggtgggcgaggtggattacgtgatcaacctgctgcccaatacgcccaatacccatgacctgtacaacgcggcgctgttcaagcaattcaagccgaccgggttgttcatcaacgtcgggcgtggcgtggccgtggtcgatgctgacctggtggaggcgctgaaggaagggcatctggcgggtgcagtgatcgacgtgtgccgccaggaaccgctgccgcaacggcatccgttctggaccgcctggggcttgctgttgaccgggcacagctcggcgccgacgtcgccggggatgatggtggacttgtttgtgcagaacctgcgggcgtatgacgccaaggaagcgttgcgcggggaagtcagcttcgagcgcggttactaataatgtgggagcgggcttgctgtggcgagcaagcttgcttgcgctggggtgcgaagcgcccccaaaaagccgactccagctgcgctgtcgaacgggagcaagctccctcgccacagcaagcccgctcccacaggaatatcagtaaggcttacaggctgaagtcgccttcggacaccagctcgctcagcggcttgcgcgggcttggcgcttcacgcccctgcaaatattcaggcaagctcgacttgtcacccagcttgcccacggccacggccgcgtgcagtgcatagcctgcggggatcttcagctctttgcgggtcagttcctggtcgaaaccggccatgccgtgggtgtgccagccgctgaggctggcttgcagcgccaggtggccccaggctgaaccggtgtcgaaggtgtgccacagcgccggggtttcttcgctggcgccgggggcagtgaagtcggttttcgaagcgatgatcaccagggccgacgcatgctgcgcccagttgcggttgaattcattcagcaggcccaggaaacgttcccagttcggcgtgtcacggcgcgcgtagagaaaccgccaaggctgggagttgtaggccgacggtgcccagcgtgccgcttcgaagaagctcagcagcgtgtcctgcgggatgctctcgccggtgaaagcgcggggcgaccagcgttcggtgaactgggagtggatcgggtaatcggcaacgcgtgtcatgggcaattcctgaggttcaattcggcgttcaaagctactgcgcgcccactagactgacaagtgttgttacaccgccagtcgtaagcgcttggccccaagggccttgggcactagactggcggccttttcacctaccgatactgatgtagagccatggccgccaaagtcgaacctttctggatacgcaaaacccttgaacacctcgaccaggaggagtgggagtcgttgtgcgacggctgtggcctgtgctgcctgcaaaagcttgaggatgaggaagacaacagcgtctattacacgcgtattgcctgcaaactcctcgacctgaaaacctgccagtgcaccgactaccccaaccgccgcgcctcggtgcctgactgcatccagctcacgccgggccaggccgaccagttcaagtggctgccgccgacctgcggctatcgcctggtcagcgagcgcaaggacttgccgctgtggcatcacctggtctgcggcgaccgcgacgccgtgcaccatgaacgcatttcccagtccgggcgcatgctcgccgaaggcagcgtgcccgaagacgactgggaggattacctgatcttccgcgcgggctgaaaaaaggagtgtgtatgacggtggcaaccaagctggcggcatcgttcgtgctgctggcgctgagcctgcccgcgtggtgcgcgaagaaagtcgacctcgactatcacgtcaaactgttgccccagagcgatcaggccgaggtgcgtgtgagcctgtcccacggctcggcggtgcgcagcctgaacttcgacctgggccgtgacggtgactacagcgacttcaaggccgatggccaatggaaggtcagcggcacccatggcctgtggcagccgtctgccgacaaggccagcctgacttaccgcgtacgcctcacccatgcgcgtaaagcgggcgtctatgaggcgcggatgaccccgagttgggcgctgtttcgcggcgaagacctggtgccggctgcccggctcgaccagcaggacggcgtcgaactggtctcgcgcctgatgttcgagctgcccagcggctggaaaagtatcgagaccgcctggccgcgtatcggcaagaacaaattccgcatcgacaacgtttcccggctgttcgaccggcccaccggctggatgctcgccggcaccctcggcagccgccgcgtgcgcctgggcgaaaccgaagtcaccgtggcctcgcccaaaggccaggccatgcgccgtatggatgtgctgacgctgctgacgttcgtctggccgcaggtcgaggcggcgttcccgcgtcacccggccaagctgctggtagtgggcgccagtgacccgctacgccgtggcgtattcgcggcgcgcgactcgatctacctcaacagccgcacgccgttggtcagcgaaaacggcagcagcccgttgattcgcgaagtggtgcaggccatcggccgcttcaacgatcacgacaccagtgattggatcagcgaaggccttggcgagtattacgccatcgaactgctgcgccgcgcgggcggcatcaccgatgagcggtatgccgcgattcaggcgcgcttgagcaaagagggcaaggacgtgaccacgctgcgtggcgatcacgtcaacggtgcgacggtcgcgcgggcggtggtggtgttgcaggagctggaccgcgagattcgcgtgaagacccataacaagcgttcgctggatgacctcgcgcaggcggtgatgcgcgcgaacagcattaccacggcggagtttgtgcaactggccgaaagcgtgatcggcgagtcgtcggtggtgctggacagcaagttgctgcgctgacccaaagccatactcaaagcaaaaatgagggagcgggcttgctcgcgaatacggtgtgtcagccaaatacttggcgactgattcaccgctttcgcgagcaagcccgctcccacatttgaccgcgttcagtttgactacttagtggccttctccgccgccacctcagccttggtcttcaagttcttcaactcttcgcccgcgcgctcgattttggtacgcacgctgttcatttcctggcggccctgttccagcttgtctttgagcgagctgtgcccggtcacgccgcgcaccagcgccacaccgccaattgccacctggatcaagccgaagatgccgccacggcgcaggcctttgccgaccatcatcacgccaccggccaccgagccgatgcgttcccagccgtgcacgttctgggtgggctgggtttcaaacggggtgtgttcaatgataggtcgcaggattttgctgtcgctcatgatctgtctccaacaagggcaagtgtaagtagctgactgtttgcgggcgccggatgttcccgaaaaatcaatacttggggcccgaacgggtgttgttgcccttggccaggcggtcgtagagcacgacgttgacggtggcggcgaggttcatgcagccggtggtcgggatgtacaccacgtcttcacaccagtcgcggatctctttgtccagcgagccgtcttcggggccgaagatgtacagcgcgcggtccgggtgagtgtattcgggcagcgggcgggcgccctcgaccagttccacggcgaccgggatgcagcccagcggcaggatctttttcaggtcgtcgatgccgatcagcggaatgtcgtggtggactttcttggtgtcggtgatgaagtcccgggcgcgctcgtagcgcacgccggtgtagaacaccgaggccacgccgtagcagccggcggcacgcatcaccgaaccaacgttttcgggggatttggggttatacagaccgatgcagctgtagcgtttattgcccacggggaagggtgccttggagaaaaaccgcgattatacggccttggaggcatgtgttgcttgggcgatcgctatcgcgggcaagcccggctcccacacttggaatgcgttcccccgtgggagctggcttgcctgcgatgaggcccgcacagacaagaagggcttcagtcgtccttcttcatcaaccccgccaacgccgcaaacggattgtgcgtggccttggcaatggtcgggctgctggtggagccttcgccgaaatactgctggtcggtgtagcgcgagtgttcgttgtcgtggcaatacaggcagagcaactcccagttggagccgtcctgggggttgtcatcatggttgtggttgcgatggtgtacggtcagctcgctcaagcgtttgccggcaaattcacgggcgcagcggccacacacgtgcgggtacatcttcaaggctttgtcgcggtagcccatttcccggtcgcgctgggcatcggcgaggatgcggtccagcttggcggtgtgggagggcgggttggtcgagctcatcatggctcctggctatttgggggttcacggattgggttgattctagccgcttgcgggcgaaatgactgctggctttttcagctacggtacagcctgacggtggcattcgtttgtagtatcggctcactccattcacaaggatctgaaacccatgcgtttatacacttggcccgtagcgctgctcttcagcgtcctggcggctcacgctcaagcgttctccacccccaaacccggccaggtcatcgaggtggcccttgaacagctgcacccgacccaggccgtggtgggcttcgaccagatttattacagcctggggctgttcgccgacaaacccgccaaggtcttcgacgagtactgcgaaaccaacggccagggcgacgccgacaaggtgcccaaagacgccgacctgcaccgccctgccagtttcagttgcaaaagcccggtgggcacccaccccgacgagatgaaaaccgtggtggtcggccccggcggccagttgtacctgaccgacggtcaccacagcttcaccaccctgtgggaagtgcccggcggcggcccgcagttgaaaatgtgggtcaaggtgaccgatgacttcagcaatagcccggacatggccaccttctggcagcgcatggagaccgcgcgcaaggtctggctcaaggacaatcacggcaaaaccctggcaccgcagcaactgccggcgcacctgggcttcaagaacctgcaggacgacaccttccgcagcctggtgtatttcacccgcaaagccgcctacggcaagccggacgatggcgccgttgcgccggagtttctggagttttactggggtaactggctgcgctcgcagattgacctgagcgccttcaacctgaacaagaagggcggctacaaggacgctatccaagccgttgcccagcgcatggtcagcctggcaccgggctcgcaggtgggtgacagcggtttcagcgcgcatcagttgggcggcatgagccagttggatcaagctgagctgaagaagaccttcgagaaaaaagtgccgtatgtgattgattaccgcaaatcccgaagctgacacaggacaaaaatgtgggagcggcggtgcgacgattcgacttgctcgcgaatgcggtggttcagtgactgatgcagtgactgacactccgctttcgcgagcaagcccgctcccacattagatttgtggtggtttggggggggggggctcagcccttgagcttctcagcaatccaaatcgtgtgccgagtgcctttattgccatgggcaaacacctgcacttcctcagccttgaaaccggccttgcgcagtttgtcgctgaacagcttgtcggcactcgccgaccataccgccaacacacccttggggcgcagggccttggcgcaggcggccaggccaccggcggagtagagccagctgttggctttttgcgtcaggccttcggggccgttatccacgtcgagcatgatcgcgtcaaagccctggggctcgccctgcagcactttcgccacgtcttccaggcgaatcaccgtgcgcgggtcgagcagcgggcgaccggacttttcgcccagtggcccacggttccactccacaacgccaggcaccaattcggcgaccaccacttcggcggtcttgcccaaatgcttgagcgccgaggccagggtgaagcccatgcccaacccgccgatcagcacccgcgaacccgggcggccggcgactttgcggcagggaatttccgccagcgcgtcttcggaaccgtgcatgcgcgtgttcatcaactggccaccgtcaccgccctggatcttgatgacaaaatcctcgccgtattcgaacaggcacaaggcaccgccgttatcggggatcggagtagtgtcgagcagaacgaaacgtttcatggaaatctcattgggaagggcattcttgcgcggttgggagtagccttacgacattccggtcaggccatggagccatcgatgaagtgcagtattctaacggtcattgtgcttggcgcgctcacattgggtgcggctcaggctcaggagttgcaaaccgtaccggtcgcccccgcgccaacccccggtgcgccgggcacgccgacgcccacgccgtacccgcaagtcaccccgcccgtcgcgcctaaagccacggcaaacggctcaccggcgctggtgccgattgtgttgccgacgccgccgaaggatcaaagcgtgcccggcctgctgcaaaacgacagcaaaccgaaaacccccggcggttaaaattgttgcgacagcaattgcccgtcggccatgcgcaagcgcttggacaaggcaatcgcgatagcgcggatgatcttggcggcaaccctgggcgcttcgttgagcattttttccagggaatccttgcccaggttcaacagcacgcaatcactggcggcgatgcagctggccgaacgccgctcgccatcgagcaccgccatttcgccgaaggcccggccactgcgcagggtggcgatggtcaggcgctggccgtcgtggttggttttctgcacggccacctggccgctgtggatgatgcacatgaaggtgccggcatcgccctcgaggaaaatcacctcatcgcgggcaatgctgctgatattgaagaaaccggcggcgacgtgaaagtcttccggcaacaagggatcgaacaggccgcagtccatgagcatgtcgcggatttcattgttcattaacgtcggtaatggcatggctgcaatcttggtccatcaatcaagtaggcggtctgtgtgttcagacaggaccgccgtcctaagttccttaaaccagccctagcgccttgaacacaaatgcatattcgagcgctacgtcacgtaatccctggtaacggccgctcatcccgccatggccggcgcccaattcggtcttgagcagcagcaggttgtcgtccgtcttggtgtcacgcagcttggccacccacttggccgcttcccagtactgcacgcggctgtcgttgtagccggcgataaccagcgtggccgggtaggcctgggcgctgacattctcgtacggcgcgtaggcctggatgcgttcgtacacctcaggcgcttcagggttaccccactcgtcatactcggtgatggtcagcggcagctcggggtcgagcatggtgttgagcacgtcgacgaacggcacctcggcaatcgcggcctggaacagatccggacgctggttgagcaccgcaccgatcaacaaaccaccggcgctgccaccgctgatcgccagttgcctggaggtggtcaggccggcggcgatcaagtgctcggcgcaggcgataaagtcgctgaaggtgttctgtttgtgtgcctgcttgccgttgcgataccaggcttcacccagttcaccgccgccgcgtacatgcgcgatggcaaacgccacgccgcggtccagcaggctcaagcgtgcatgcgagaaccacgggtcgaggctatggccgtaggcgccataaccgtagaggtacagcggcgtcggcttgccgagctggtcgcgtttgaccaccaggctgatcggcacttgggtgccatcggcggaggtggcccacaggcgttggctgacgtagtcgtcggcgttgaatacgcccagcaccggggtttccttgagcaccacttgcgcgccgctggccaagtccagttggcgcacctgggccgggcggttaagggcttcgtagcgcaggcgaatcttgtcgctggaaaattccaggctgttctgtacgtaaaggctgtaggcggcgtcaggcaattccacgcggtaggcttgtacgtcctgcgggtgcacttcgatcaccggcaggccgccgatgcgcaggctcaaggtcatcgcgctggcgttgaggctcacgccatcgagcatcacctcgtcgctgtgcgggatcaggttgtgccattgatcttcggtgggcacgctgccggtgtcggcggcgacgaacagcgcgtagttgatgccgtcgcggttactgcggataaaccaggtccactcgccgtcaagctggccgtggtccacgtcgtattcgtggttttcgacccgtggcgccaggcaggcgaagtcgaggtgcggctggtcggcgtcgagcgcccagatttcgctggtggtcttgctgcccagggccagcagcaactggcgctcggagctggaacggtagcaatgcaggaagaaacgtccgtcaggctcgtggaacacttcctgcgccgccgtgccatccaggcggtagcgatagagcttgtgcgggcgatgggtgtcgtccagctcagtgaagaacagggtcaggctgtcattcgcccaggtcatgctgccgtcgcagtcctcgaactccagctcgctgactttgccggtggccaattccttcacgaacagggtgtaaatctcttcaccgctggtgtccaggctgtaggccaggcgctggtggtcggggctgatgctgaacgcgcccagggagaaaaagccgccattggccagcacgttagggtcgagcagcagttcttcgctgctgtcgtccactgcgttgctgtcatccgccgggcggcggcagcggtagtggcgggcgtattcgtcaccggcggtggtgcgtgtgtaatacaggtacgggccccacggcgagggcagggacaagtcggtttcgagaatgcggcccttgatctcttcgaacaaggtttcacgcagcgcctgctggtcggcgagctgcgcttcctgccaggcgttttcggctttgaggtaatcgaggacttcaggcgtgtcacgctgttgcagccaggcgtacgggtcctggccttcggccttgcgggcaatcggggcggcagtgatgtgggtcgatgaaggcatggatcactctctgtctggcggatggtggcaggcattgcagccgagacacgcaaaagccgttatcatagccgcctgtttgcctaccttgccatggacaccatgaccgagaacgactatctgaccgcttggggcctttacgccttcgccgctttgggctgcctgttggtgtggtggcgcatgacccgctggatctggcgctggctgcgcgagccgctgcagttgctgatggcggtgctgctgttcagcccgaccatcgtcgacccggtcaagacccagtttgcgccggccgtggcgatcaccgcgttggatctggtgctgcatgtcggcaataacgcctggcgggccatctccgatctgttcatgtacacgatgatcgcctttggcgtgtacatcgtgtttgtgttgatccgctggcccatcgagcgcgccgccactgctcgccgtgagcgcaaggccgctgccgatgcggccctggccgccgagccggtggacgaagacgacgagccattccgtcgcccggcgcccaccagcggtatgcgggtcgaaccgcgcctttaacgttgtccgccctgcagcgagagccctggcatgtgtgaattattgggcatgagtgccaacgtccccacagatatcgtgttcagctttaccgggctgatgcagcggggcgggcgtaccggcccccaccgcgacggttggggcattgccttctacgagggccgtggcctgcgtctgttccaggacccggccgccagctgcgagtcggaagtcgcgctgctggtgcagcgttatccgatcaaaagtgaagtggtgattggtcatatccgccaggccaacgtgggcaaggtcagcctggccaacacccacccgttcgtgcgtgaactgtggggccgcaactggtgtttcgcgcacaacggccaactggcggacttccacccgcgcgccacgttctaccggccggtgggcgataccgacagcgaagcggcgttctgcgacctgctcaaccgggtgcgcgaagccttcccggagccggtggagatcgagcaagtgctaccggacctgatcgccgcctgcgccgaataccgcagcaaaggcgtgttcaactgcctgctcagcgacggcgactggctgttttgctattgctcgaccaaactcgcgcagattacccggcgcgcaccgtttggcccggcgcgcttgaaagatgtcgacgtgatcgtcgattttcaggctgaaaccacgccaaatgatgtggtcacggtgatcgccaccgagccgctgaccgacaacgaaaactggacccgttacgaaccgggccaatggagcctgtggcgacgcggtgaatgcgtcagccagggcattaccgagtaaggatatcgaccatgctgctcagttatctgcggttggtgctgtttgcgattggcttgttggtcggtgtgcaagtgccggggtttatcaacgactacgccaagcgcgtcgaagcccacctgatcgaggcccagaccggcctcagcgggtttgaaactaccgcgcggcagttcttcaacggtgatttgaaggcgctggtggcgcattaccgcgccagcgatgacccggtgttccagagcgacgccaacagcctgggcagcatgcttgatcgccaggtcgcgttggacaagcagttccaggccatgcaaggcccgtggtacatccgcgcgttgcaagtggcggtggccgccgacccggcgattcgcctggaaacctggaatggctacagctaccagattctgctgacgcctgaggccatgggttggggcctgggcggagcgatgctgttgtcgttcggcatcgaatgcctgttccgcttgatcgactgggtggtgttgggcggcaagcgcctgcgccagagccggccgattgaagagcgagacctcaaaggcctttgatgatgatcgttcccacgctccgcgtgggaatgcctcttgtgacgctccgcgtcacgttttgggacgcggagcgtcctgggccgcattcccacgcagagcgtgggaacgatcaatccggtttcgtcagtagcatgtgctcttcgccgacctcttcggcataccttgccaccaccttctggcacagcccgacaatctcctccaccaactccacgcctacacgccacgacaccaccacctgcaagttcggcagtttctgcgccatcggcaacatcaccaattccccgcgcgccaattcttccatcaccagcaccggcggcagggcaccgatgccaaaaccatcgcgcaacaagcgtgtaatcgccgacaccgaattcacacagttcatgcgcggcgcggccacgccgttggcttgcatcaggctcagcacgtcctggtgcgggtgggagtttttcgaataggtgatgatgcgctcacgggccacttcggcgagggaggcgtagtcgcggttgtagatcgaatggctggcgacgatccaggccatcgggtggctggccagttccaggctgcgcacggtttcgaggcgcagcaggtcggtttgcaggatcaggtcgaggaagcctttttgcagttgatcgctcaagttcagtgcggtatcggcgaccaactcgatttctaccagcgggaagtggtccatcaattcggcgaccagcgggctgagccaagtgtgaatcacggtgtccatcgccccgatgcgaatccgcccgaccttgctgctggtggtctccagggactgcttcaaaccctgcatggtcaccatcatctgctcggcataatcgagcaccttcaagccttccggggtcaggctcaccccacgtgagtcgcgcagaaacagcttcacacccaactcgctttccagcaccgcaatgcggctggaaatcgaggcctgggtggtgaacagcttctcggcggtcaggcgaaaactcttgagcttggccacccagacgaaggtttcgaggaacttcaaattcatgggatcaacttttcttatgcaaggatcggtttttattagttggacgccgcaccgggcaaacgccaaaaatcgaggcattccacgataagcgtcgttggggtgtcaggacaagttgccagttctgtgcgaaaaatcccacactacaaaaaacacaacgcccagaggtacaccgaccgtgagccgtcttctattgaattgcgacattggcgaaagctttggcaattggaccatgggtctggacgccgaggttatgccattcattgattgcgccaacgtcgcctgcggctttcatgccggtgacccgagcatcatgcgcaagaccgtcaccctggccctcaagcacggcgtgcaagtgggcgcacacccggcgtaccaggacgtgcaagggttcggccgccgctccatggcctacacgccgcaggaaatccaggacctgttgcactaccagatcggcgccctcgacggcatctgccgcgcgcaaggcgggcgggtcagctacgtcaaaccccatggcgcgatgtacaacgacatgatggccaaccccacgcaattgcgcgcggtgatccaggccgtcgccgcttatggcgacctgccgttgatgctgctggccacccgcgacaacagcgcggcccaggccctgggcgatgaatacggggtgacgctgtggttcgaggccttcgccgaccgcgcctacgaccacaaagggcacctggtgtcgcgccagttgccgggtgccgtgcaccatgactccgaaaccatcgtgcaacaggccctgactatttcccgtggcgaagccctgaccgccagcgacggcagcgccttggtgttgcaggccaacaccctgtgtgtgcatggcgacaacgccagttcgattgccgccgtgcagcgtatccgcgaggcgttgaagccagcatgaagccacgcattgaagtggtagcgatcgactgcctgatggtgcgtctgtttgatctgattgccgaagccaacatgccgtggatgctcgccgccactcaacgcctgcgcgaaggctttggcccggcattggtggatttggtgccgtcctacaccacgctgatggtgcattacgacctcaccgcgttgagcccggcccaggccagggagttgatcagccaagcgctggccgacctgcagcctcaggcccagggcagcggccagtgtcacgtgttgccggtgtggtacgacctgagtgtcggcccggagctgacattgctcagccagcgcagcggcctgtcggtagacgaagtgatccgccgtcacagcgcccacgaataccaagtgttcgccctgggttttgcccccggctttgcctttatggggctggtggacgaaatcctcgccacgccgcgcctgaataccccgcgcaaacgcgtgtcggccggcagcgtcggcatcgccgaacggcaaaccgccgcgtacccgctggtttcgccgggcggctggaacttgatcggccgcaccccggccaaactgttcgaccgtgaacgcgacggctacagcctgatgcagcccggcgatacggtgcgattcgaagcggtcgagcacgctgaatttattcacctgggtggcgatgacacgccgttggaggcgcacgcatgagccgcttgttgatcgaggccagcacgccgctgtgcctgttgcaggacgccggtcgttttggcgtgcggcacctgggcgtgactcagggcggcgcgctggattgggtgtcgatgtcgtgggccaactggctgctggacaatgcgctggacgcgccggtggtggaaatcaccttgggcgggttcaccgtccaggctgaagattattgcttgctggcgctggccggtgcggatttgggcgcctacatcgatgagcgcgcgatcagcccggggcgcagttttatcctgcaaaagggccagcggctgcgctttacccagccgttcagtggcgcgcgggcttacctggcggcgccgggcggctttgatgcgccggcggtgctgggcagttgtgccacggtggtgcgtgaagcgttgggtgggctggacggtttcggcaaagccttggtcgaaggcgggcggttgatgtattccggaacgggcggtgcgatgaaggtgttgagtagcgcggatttgcaatccgctgcacccttggacgtgattgtcggtgcacagatcggccagttcagcgggcagagtttgttcgatgccttcaacaccgaatgggcgctggacagccgcgccgaccgcatgggtatgcgcctgctgggcacgccgttgcagtatcaggggccgtcgttgatttccgaaggcattccgttgggagcgatccaggtgccgccggatgggcagccgattgtgttgctcaatgatcggcagaccattggcggctacccgcgtttgggcgcgttgacgcccttggcgctggcgcggctggcgcagtgtttgccgggggagaaggtcaggttggcgccggtggtgcaggaaacggcgcatcggcaacacgtcgactttttgcagcggttctgatcgttcccacgctctgcgtgggaatgcctcttgtgacgctctgcgtcacgctttggcacgcagagcgtcctgggctgcgttcccacgcggagcgtgggaacgatctatttacttggagagaaagcgcatcccttcttccaggccccgcagcgtcagcgggtacatctggtcttccaccaactcgcgcactatccccgtcgacgccgtatagccccaggtgtccttcgggtacgggtttatccagatcagcttcttgtacttggccatgaagcgttgcatccacacatacccaggctcttcattccagtgctcaacgctgccgccggcctgggtgacttcatacggcgccatcgacgcatcgccgataaagatcactttgtagtcggcgccatacttgtgcagcaaatcctgggtggaggtgcgttccgaggtgcggcgttggttgttcttccacaccgactcgtacacaaagttgtggaagtagaaatactccaagtgcttgaactcagtcttgcacgcagaaaacagctcttcgcagatcttcacatgggcgtccatcgagccgccaatgtcgaacagcagcaacagcttgatggtgttgcgccgctccggacgcatctggatgttcagcagcccggcatcccgtgccgtgtggtcgatggtgccgtcgatgtccagctcttccgccgcaccctggcgcgcgaacttgcgcaggcggcgcagggcgatcttgatgttgcgcgtgcccaactcgacctggtcgtcgaggttcttgtactcgcgctggtcccacaccttaaccgccttgccctggcgcttgccggcatcgcccacgcgaatgccttccgggttatagccacccgagccgaacgggctggtgccgccggtgccaatccacttgttgccgccagcatggcgttctttctgttcttccaagcgtttcttgaactcttcgatcagcttgtccagtccgcccaaagactggatctgcgcgcgctcttcatcgctcagcgagcgttcgaactccttgcgcagccactcttcggggatcagcgcctgcaggtgatcgtcgagtttttccaggccgttgaaataggcaccgaacgcacggtcgaacttgtcgaaatgccgttcatccttgaccaggatcgcgcgggccaagtagtaaaactcgtccatgtcggcgaagaccacgcgctgtttcagcgcgttgatcaggtcgagcagttcacgcaccgacaccggcaccttggcggcgcgcatctcgttgaacaggttgagcaacattatcgattaccgcgacggctcatgaatgccaggcgttccagcaactgaacgtcttgttcattcttcaccagagcgccggccaacggcgggatggccttggtggggtcgcgttcgcgcagcacggcttcgccgatgttgtcggccatcagcaatttgagccagtcgaccagctcggaggtggagggctttttcttcaggcccggcactttgcgcacgtcgaagaacacgtccagcgcttcgctgaccaagtttttcttgatgtcggggtagtgcacatcgacgatcttttgcagggtcgtgcggtcggggaacgcgatgtagtggaagaagcagcggcgcaggaacgcgtccggcagctctttctcgttattggaggtaatgatgatgatcgggcgcttcttggccttgatggtctcgtcgatttcgtagacgtagaactccatcttgtcgagttcttgcagcaagtcgttggggaactcgatgtcggccttgtcgatttcatcgatcagcagaatcacccgctcctcggactcgaaagcctcccagagcttgcccttcttcaggtaattgcgcacgtcgtggaccttgtccacgcccagctgcgagtcgcgcaggcggctgacggcgtcgtactcgtaaaggccctgatgcgccttggtggtggacttgatgtgccaggtgatcaacttggcgccgaaggattcggccagttgctcggcgagcatggtcttgccggtgccgggctcgcccttgaccagcagcggccgctccagggtgatggcggcgttgacggccagtttcaggtcatcggtagccacataggcctgggtgccttcgaacttcatcgatcattcctcgaattcatcaatgcccggactataccgcgcagccccggcgactgtgaacgcagacgggttattcagtctctgaatggccggtcacgcctgaccgctagcggtttttttccaacgcatacgcccgcgcatcggctttatccctgagcttgctgccgccccacagggcgagtgctgctaaaaccagtgtgcccaagcttatgaggatcatctggcgggccatcggcccgccttcaacggcggatatcattaatcgcatacagcccgaaaaggcccaaagataaccaagaattgtcagtatccagccgcagatgcgcattttagtgtccttactagtcgttggaatttagtcggcggtacgataaacgagggctcagtgtttcaccatagttgccctcgggcgtgtgactcagtcagcgctgggcttgggctgctcgtaccgtgcattgaacgcctggataaacccattacgcaaaatcgacaaaaacgcagagaactcgctgatattttgctggtgtacgctgccgctgagttcgacgcgggtggcaaactggtttttgttctggtttttcagcactgtttcgctggtgccgaccacggcttcccagatcgagcggaagatgtttttgtctttgttctcaacgtcttgcttccaatcaaagacttccacgtcgcgcagcagcggcttgatgtagccgctcaactggcctttttcggcctgggcttcgatcaccacggcgccagtgccggccttgaagtcgaatttgccgtaggccgaggcgaagtcgttcaggcgcttgagttgaatatccttggcgcgaaagcggaattcgaaatcttcaaagttgctcagcgggtcgaacgccgccgtggcttccagcggcgcctggccgagtaactgcgccttgccttcaaaggtcgcgtcgcgcttgcctttgatgtccaccacgttggtcaggttatagaagctggcgttgacctgggtggcgtaaatattcaccggtggcttggaattgaagttgtggaaggcgatcttgccgtcctgaattcgcacttcgttgagggtgatcggcagcaatttgctcagttgttcacgccagtccgtgcctttaccggtctgggatgcctgctggttgccgccgtcgacgaaattcagctcgggctgaaagaactgtgcctcggcgactaccgcgtggtcgtaccacagcgaatgccagctcaccgacaggtcgatcaccggcactttgacgaacggcaccggcactttgccgtcgactttgacgatctgcaggccgttgatcttataggcgccgcgccacagggcgacgtccacgtccgtgacctggccgcggtaatcgcccatgtcggcgagcttgtcgttcaggtagttgcgcaccagatagggcagggcgatgtccagggcaatcagtactaccaccagtacggcgacgatccatagcagcccactgtagcgacgtttcatgttcaggttctccaacggtataggcgatggaccgcgcgcacgggcgcaacgttcctctgactggacgcctaaaggcctgaggcatacccttggggccttgttgaaattgccttaaggacccgtcatgagccgtatctttgcagacaacgcgcactccatcggcaacacgcccctggtgcagatcaaccgcatcgcaccgcgtggcgtaaccatcctggccaagatcgaggggcgaaacccaggctattcggtgaagtgccgcattggcgcgaacatgatctgggacgctgaaagcagcggcaaactcaaaccgggcatgaccattgtagaaccgacctccggcaacaccggcatcggcctggcgtttgtcgccgccgcccgtggctacaagctgctgctgaccatgccggcgtcgatgagcatcgaacggcgtaaagtgctcaaggccctgggcgccgagctggtgctgaccgagcctgccaagggcatgccaggcgccatcgccaaagctgctgagatcgtcgccagcgactcggccacctactttatgccaggccagttcgaaaacccggccaacccggcgattcacgagaaaaccaccggcccggaaatctggaacgacaccgatggcgccgtggacgtgctggtcgcaggcgtgggcaccggcggcaccattaccggcgtgtcgcgctatatcaagaacattgccggcaagccgattctgtcggtggcggtggagccgatggtgtcgccggtgatcacccaggcactggcgggtgaagagatcaagccgagctcgcacaaaatccaggggattggcgccgggtttgtgccgaaaaacctcgatttgtcgatggttgaccgcgtggaactggtgaccgatgaagaatccaaggccatggccctgcgcctgatgcaggaagaaggcattttgtgcggtatttcctgcggtgcggccatggccgtggccgtgcgcctggccgagaagccggaaatgcagggcaagaccatcgtggtgatcctgcccgactccggtgagcgctacctgtcgagcatgctgttcagtgatttgtttaccgagcaggaaaaccaggcttgattgttcgccacagggtttgatgcaggtcagccggtcggcttgggccttctgcataatggcccaagtgtttatcatggccggctgttacgtctggtttcccgttgatgggaggctgttggccaggcgcttatttccaggagttgctgcatgaccttttctttggccgccaaactgtcggtgttgctgctgtttattggcagcacgctgtatgtgcacctgcgtggcaaggcccgtttgccgatgctgcgccagttcgtcaaccattcggcgctgttcgccccgtataacgccctgatgtacctgttttcggctgtgccgtccaagccgtacctggaccgcagcaagttcccggaactggatgtgctcaaggacaactgggaagtgatccgcgaagaggccatgcacctgttcgacgagggttacatccgcgccgccgaaaagaacaacgacgccggtttcggttcgttcttcaagaaaggctggaagcgtttctacctcaagtggtacgacaaaccgctgccgtcggccgaggcgctgtgcccgaaaaccgtggccttggtcagcagcattccgaacgtcaagggcgcgatgttcgcgctgttgccgggtggcagccacctcaacccgcaccgtgacccgtttgccggttccctgcgctatcacctgggcctgtccacgccgaactccgacgactgccgcatcttcgtcgacggccaggtctacgcctggcgcgacggtgaagacgtgatgttcgacgaaacctacgtgcactgggtgaagaacgaaaccgaccagacccgcgtgatcctgttctgtgacatcgagcgcccgttgagcaaccgcatcatgacccgcgtcaaccgctgggtcagcaagcaactcggccgcgcaacggcgccgcagaacctggatgacgagcgcgtgggtgggattaaccaggcgtatgcctggagcaaaaccttcagcgacaagttcagcggtgtggtcaaacaatggaagcgcaagcatcccaaggcctaccgcattgcgcggccggtgctggcggttgtcgtgctggtgttgttgtggaagtggttgttcgcctaaaccgctccgcatgaaaaaggcgctgcatcgaaagatgcagcgcctttttcatgtctggaatgtgatcaaaactgtgggagctggcttgcctgcgatggcggtctgtcagctacctaagggttggctggcctaccgctatcgcaggcaagccagctcccacatttgatctccagtgttgcttaagaggcgatcaactggcgcagcacgtagtgcagaatcccgcccgccttgaagtattccacttcattgagcgtatcaatccggcacagcacctcgaccttctcgctgctgccgtcctcgcgcgtaatcagcagcgtcaggttcatccgcggctcgatctcggcatgggtcagcccaaggatgtcgatcttctctttgccggtgagtttgagcgccttgcggttctggtcgagcttgaactgcaacggcagcacgcccatgcccaccaggttggaacggtgaatgcgctcgaagctctcggcgatcaccgccttgacccccagcaggttagtgcccttggccgcccagtcgcggcttgagccggtgccgtattcctggcctgcaatcaccaccagcggcgtgcccgacgcctggtacttcatggcggcgtcgtagatcggcattttctcgccggtgggaatgtacagcgtgttgccgccttcttcgccgccgagcatttcattgcggatacggatattggcaaaggtgccgcgcatcatcacttcatggttgccccggcgtgagccgtaggagttgaagtcacgcggctccacgccttgctcgcgcaggtaacggccggcggggctgtcggccttgatattgccggccggggagatgtggtcggtggttaccgagtcgcccagcaaggccagcacgttggcgcctttgacgtctttgatcaccggcaatggcccggcaatgtcatcgaagaacggtgggtgctggatgtaggtggaatccttctgccacacataagtcgccgcctggggcacttcaattgcttgccactgctcgtcaccggcaaacacctcggcgtattccttgtggaacatgccggtgctgacctgcgccacggcgtcggcgatttcctggctgcttggccagatgtctttcaggtacaccggcttgccgtctttgccttcgccgagcggctcgctgctgatatcgatgcgcacggtgccggccagcgcataggcgaccaccagcggtggcgaggccagccagttggttttcaccagcgggtgcacgcggccttcaaagttgcggttgccggacagcaccgaagccacggcgaggtcggctttctggatggctttttcgatgggctccggcagtgggccggagttgccgatgcaggtggtgcagccatagccgaccaggtcgaagccgagctggtcgaggtattgggtcaggcctgcggccttgtagtagtcggtaacgactttggagccgggcgccagcgaggttttcacccaaggtttgctggtaaggcccttttccacggcttttttcgccaccaggcctgcggccatcatcacgctggggttggaggtgttggtgcacgaggtaatcgcggcgatcaccaccgcgccgtttttcaggcgataggtgcggccgtcgtattcgtagtcggtttcgccgaccaagtcggcattgcccacggccacaccgccgccgccttcgctttccaggcggccttcttctttgttggtcggtttgaattgcaggtcgaggaagtcgctgaaggcttggccgacatttggcagcgaaacacggtcctgcgggcgtttcggcccggcgaggctggcttcgacactgcccatgtccagcgccagggtgtcggtgaacaccggctcctggccggcgttacgccacaaaccctgcgccttggtgtaggcctccaccagcttcacggtttctgccgggcgaccggacaggcgcaggtagtccagcgtcacctcatccaccgggaagaacccgcaggtggcgccgtattccggggccatgttggcgatggtagctcggtcggccaggggcaagtcggccaggccgtcgccgtagaactcgacgaatttgcccactacgcctttcttacgcagcatctgcgtgacggtcagcaccaggtcggtggcggtaataccttctttcaatttgccggtgagcttgaagccgatcacttccgggatcagcatcgacaccggctggccgagcatcgccgcttccgcttcgatcccgcccacgccccagccgagtacgccgaggccgttgatcatggtggtgtgcgaatcggtgccgaccaaggtgtcggggaaggcgtaagtgcggccgtcttcgtccttggtccacacggtgcggccgaggtattcgaggttgacctggtggcagatgccggtgcccggtggcactacgctgaagttgtcgaaggcgctctggccccaacgcaggaaggcgtagcgctcgccgttgcgctgcatttcgatgtcgacgttctgctcgaaggcgctggtggtgccgaacttgtcgaccatcaccgagtggtcgatcaccaagtccacgggggagagtgggttgatgcgttgcgggtcaccaccggccttggccacggcggcgcgcatggcggccaggtcgactacggcgggtacgccggtaaagtcttgcatcagcacgcgggccgggcggtattgaatctcgcggtcggactggcgctctttgagccaggcggcgatggccttgaggtcggtgccggtgacggtcttgttgtcttcccagcgcagcaggttttccagcagcaccttgagggacatcggcagcttgtccaggtcaccgaggctcttggcggcttcgggcaagctgaagtaatggtaggttttggcgtcgatttgcagggttttaagggttctcaggctatcaagggatgacattacatgactccttatggtccgcacggctacggacctgacgggacgaacagagctttcaacttagccctgttttcattagcaggctaataactggactctatcgttaagtccaaggttccgaactcggctatcatgcgcgcgttttcatgacaggcattgcgctacagcaagccagttgccaggagattcaatgaacaccctttttatgcactgccgcccgggttttgaaggcgaagtctgttccgagatcgcggaacacgccgcgcgcctgaacgtttccggctatgccaagaccaagaccggcagcgcctgcgccgaatttgtctgcaccgaagaagacggcgcccagcgcctcatgcacggccagcgctttgccgagctgatcttcccaaggcagtgggcgcgcggggtgtttatcgacctgccggaaaccgaccgtatcagcgtgatccttgcgcacctgcaaggcttcccggtgtgcggcagcctgtggctggaaatggtcgacaccaacgacggcaaggagctgtcgaacttctgcaagaaattcgaagtgcacctgcgcaaagccttgctgaacgccggcaagctggtcgacgacccaagcaagccgcgcctgctgctgaccttcaagagcggccgcgaggtgttcatgggcctggccgagtcgaacaattcggcgatgtggccgatgggcatcccgcgcctcaagttcccgcgtgaagcgcccagccgttcgaccttgaagctggaagaggcctggcaccactttatcccccgcgaccagtgggacgagcgcttgcacagcgacatgaccggcgtcgatctcggtgcagcgccgggcggctggacctggcagctggtcaaccgtggcatgctggtgaccgctatcgacaacggcccgatggctgaaagcctgatggacaccggcctggtgcagcacttgatggccgatggttttaccttcgtgcccaagcagccggtggactggatggtctgcgacatcgtggaaaaacccgcgcgcaacgcggcgctgctggaaacctggatcggcgaaggttattgccgtgaagcggtggtgaacctgaagttgccgatgaaacagcgttacgccgaagtgaagcgtttgctggagcgcatcgaagacggcttcaaggcacgcggtatccgtgttgagatcggctgcaaacagctgtaccacgaccgtgaggaagtgacctgccatttgcgccggttggtggatgtgaagaaatcgaaatcacgctgacaccaactgtgggagctggcttgcctgcgatagcggtataacagtcgaaatctatagtgaatgtgcccccgtcatcgcgggcaagttgaatcgtcgaaccgccgctcccacattagagcgggccagtattaggagtgactatgagtaatgatctagcggtcgacggcacgctcgacgccaccggcctcaactgccccgagcccgtgatgatgctgcaccagcacatccgtgacctgccgcccggcggcttgctcaaggtgatcgcgaccgacccgtcgacccgtcgcgatatccccaagttctgcgtgtttcttgaccacgaactggtggatcagcaggagcaggccggtacgtacctgtactggattcgcaagaacgccggttaagccaggcgaatccgccggcgcgcgctgcgtgtcaggcggatcaccagcatcgcggcggcgcagctcaagcccacgatcagcccctgccacaggccgctcggcccgctggcagcgcccagccagtcggtcagccccagggcgtaacccaccggcaggcccacgccccagtaagcaaacaaggtcagcaccatggtcacccgcgtgtcctggtagccgcgcaatgcgccggcggccgtgacctggatcgcgtcggaaaactggaacagcgccgcaaacacaatcagcatcgacgccacgtggatcactgacgggtcaggcgtgtagatcgtggcaatctgttcgcgaaacagcagcatcaggctgcaggacaagcaggcgtacgtcagtgccgtgcccatgccgaccccggcggcaaagcgtgcttcccgcggttcgccacggcccagggcctggccgacacgtacggtgacggccatgctcagcgagtaagggatcatgaacaccagcgagctgaagttcagcgcaatctggtgcccggctaccacgttggcgccaaggctgccgatcagcagcgcgatcaccgcaaaaatgctcgattcggcaaacaccgcgatgccaatcggcaggccgatgcccagcacgcgcttgatcaccgaccactttggccagtcgaatcgcttgaacaactcgctgctctggtaggccggtgcccagcgggtccaggcggccaggccgagcatcatcacccacattacaatggccgtggcccagccacagcccacaccgcccatggccggcacgccgaaatggccataaatgaacacgtagttcagcgggatattcagcgccaggccgcacaggcccatgaccatgctcggccgcgtacggcccaggccatcgctgaagcagcgcagcacgtaatacagggcgatggccggcatgcccgaggcgatgccgtgcaggtaggccatgcacggcttgatcagctcggggtcgaccttcatcgcatgcaggatcggctcggcgctgaccagcatcagcagcgcggtgagccccaccgccacggccagccacaacgattgacgcaccagcgggccgatttcggtgtggttgccggcgccgaaacgctgggcgactttaggcgtggtggccagcaaggtgccggtcatcagcaggtacaccggaatccagatcgagttacccagcgccaccgccgccaggtctcgcgggctcacacgcccggccatcaccgcatcgacaaagcccatggcagtcgtcgcaagttggccgatcatgatcggcagggccaggctcagcaggctgcgcacctcacggctgacgcgggcggggcgggagagggcggtggtggcggtgttcacgtgcgggtgtccatttaaaaagcatcacaaaggacggcgcagtctacgcgctgacgcaacggtcaggaaaaaacctgtgttagcgttttgtaagcaatccggcggctggcccataacacctgtgggagtcgggcttgcccgcgatagcatcaactcggtgtagctgttaaaccgaggtggctgcatcgcaggcaagccagctcccacatacgccagctcccacacaagtccggctaccacagaagcaccgcccacttggtatctgcggtgttacaccagtcgcatccctgtacactgctggtccgcgaaaggagcctgccatgctgattgttgccgacgaaaatatcccgctgctcgatgcattcttcgaagggtttggcgagattcgccgggtgcccggccgttccatcgaccgcgccacggtcgagcaggccgatgtgctgctggtgcgctcggtgaccaatgtcaaccgcgccttgttggaaggcacccaggtacgtttcgtcggcacctgcaccatcggcaccgatcacctggacctcgactacttcaagcaggccgggatcagctggtccagcgcgcccggctgcaatgcgcgcggcgtggtcgactatgtgctgggcagcctgcagaccctggccgaaatcgaaggcgccgacctcaatcagcgcacctacggcgtcgtcggtgccggtgaagtgggcgggcggctggtcaaggtgctcaagggcctgggctggaacgtgctggtctgcgacccgccacgccagatcgccgaagacggtgactacgtcagcctggagcagatcatccagcagtgcgatgtgatcagcctgcacacgccgctgaccaaatccggcaatggctccacctggcacctgtttgaccgcgagcgcctcaaccggctcaagcacggcacctggctgatcaacgccagccgagggccggtggtggataacgccgccctgcgcgaggtgctgctggaacgcgaggacctgcaagcggtgttggacgtgtgggaaggcgagcccgaagtggacgtcgacctggccgacctgtgcgtgctggcgaccccgcatatcgccggttacagcctcgacggcaaacaacgcggtacggcgcagatttaccaggcgttttgcgcccacctgggccaggaacccggcatccatttaagtgacctgctgccgcaaccgtggttggccgaggtgcacttgaacgcgtccaccgacccggcctgggcgttggcgactctgtgccgcagcgtgtacgacccgcgccgcgatgacgcggatttccgccgcagcctggtaggcaccgtgcaagagcagcgcaaggcattcgacctgctgcgcaagcattacccggcgcgccgtgagattgatggcttgaaggtgcgcatccatggcgagtcggcggtgttgtcgaatattgtctcggcattgggcgcggtgagcctttaagccggcataaaaaaaccggccatcaaggccggttttgaacgagcttaggcgcttcagccttgcttggcaggcttgaccagtcgctgttccagttcgctgcacgcttgctggatcatctcttcggtaatttgcacttcgcggccctttgcatcgaagtacgagcaaggcaactgctgcggctggcgaattacttcaatcttggcttcgctgctatgttgcaaggtcatggcctgtctcctcatcaggttgtgtacctactattctttctactctaagccgcccgcgtgaccaggctattacaactccatacaaagtcaccggttcgaacacccagtccaccagaaaccgatacaaatttccagccgggggttagaccgatagcctctaggggtcagcatcggcgggcataattaacctgactcattgttatttacccaagttcccccaatgttgggtgtagatatctatcttcccctacctatcttcccctgcgcaggtgatgccctccatgttctcagtccgacaacgccgtgcgattcgcctggccagccgcttcatcgcgccctaccgttggcaggcgctgggcgccttgttggcgttgatcgtcacggcgggcatcaccttgtccatggggcagggcattcgcctgttggtggatcagggtttcatgacccagtcgccgcacctgctcaaccagtccatcggcctgttcatggttctggtgctgggcctggcggtgggtacatttgcgcggttttacctggtgtcgtggatcggcgagcgggtagtggcggacattcgccggcaggtgttcaaccacctgatttacctgcaccccggcttttacgaaaacaaccgcagctcggaaatccagtcacgcctgaccaccgacaccaccttgctgcaatcggtgatcggctcgtcactgtcgctgttcctgcgcaacgccttgatggtcatcggcggcatcgtgttgctgtttgtcaccaaccccaaactcaccagcatcgtggtgattgcgctgccgctggtgctggcgccgatcctgatcttcgggcgtcgcgtacgcagcctgtcgcgcctgagccaggaccgcatcgccgacgttggcagttacgtgtccgagaccctcggccagatcaagaccgtacaggcctacaaccatcaggtgcaggacgaacaacgctttgccgtcaccgtggaagaggcctttgccacggcgcgcaaacgtatcgtgcagcgcgcctggctgattaccctggtgatcatgctggtgctcggcgctgtcggcgtgatgctgtgggtcggtgggatggacgtgatcggcgggcgcatttccggtggtgagctggccgcgttcgtgttttacagcttgatcgtcggcagcgccgtcggcaccttgagcgaagtgctcggcgaactgcagcgcgctgccggcgccgccgaacggattggcgaattgctgcagtcgagcaacgaaatccaggcgcccgttgccggcaccgtgcagttgccagtgcgggtccgtggtcgcatggaactgcaagacctgcgcttttcctacccttcgcggccggacagctacgccatcgacggcctgagcctgaccatcaatcccggcgaaaccctggcattggtcggcccgtccggcgcgggtaaatcgacaatcttcgacctgctgctgcgtttctatgacccccagcaaggccgcatcctgctggaaggccacgcgctgactgaactcgaccccatggacctgcgccgccacttcgccctggtgtcccaaagcccggcgctgttttttggcagcgttgaagagaacatccgctacggcaacccgtccgccacgcgcgaacaggtggaagccgccgcgcgtattgcccacgcccacgacttcatcctgcaaatgcccgacggctaccaaacccacctcggggacggcggcatgggcctttccggcggccagcgccaacgcctggccatcgcccgcgcgttgctggtggacgcgccgatcctgctgctggacgaagccaccagcgccctcgatgcccagagcgaacacttgatccagcaggcgttgccgcagttgatgcagggccgtaccacgctggtgattgcgcacaggttggcgacggtgaagaacgccgaccgcattgcggtgatggaccagggcaagctggtggcggtgggcacgcaccagcagttgattgcgagcaacccgctgtatgcgcggttggcggcgttgcagttcagtgatggtgctgagaatccagcctagcaggcttactgtctgtggcgagcgggcttgttgtggttagcgggcttgttgtggcgagcgggcttgccccgcgttgggctgcgtagcagccccaaacctgccatcgcggttttccagttacaccgcggcgcttgggttgggagcgcttcgcactccagcgcagggcaagcctgctcgccacaacaagccgccacagtctgtgtcactgatcatcaaaataccgctcatgccaatccaccagcggctgcggtgaattgagcttctgcccgtagatcaccgaataagacagcacgttctgcacgtactgacgggtttcgtcgaacgggatgctttctacccatacgtcgaaactcaggtggtcggcgccgcgcagccattggcgtacgcggccggggccggcgttgtaggcggctgaggcgagtacgcggttgccgttgaactggctgtgcacctggctcaggtaggcggcgccgagctggatgtttttgtccgggtcgagtacctgggccggggaggccagcgggatgctgaatttgcgcgcggtttccttggcggtgccgggcatcagttgcatcaggccactggcgcccacgccggagcgggcgtcgtccatgaatgcactttcctggcgggtgatggcgaaaacccagctcgaatgcaggccacgcactttggcttcgcgcaccagggtgtcgcggtgcgccatcgggaagcggatatccaggtcatcccaatactgcgcctggctgatggtgcggatcgccgggaagtaccacttcatgtcataggccagtttggcctgggcgaccatttcatcacggttaaagtggcggctgacgtgataccactcgcgccggccatcgacgatctggccacgtgcatagaactccagcgcacggcgtacaccgggggtgttgcggaccttgttgaccagcgcctggctcatcaccagcggtttgtttttcaactgatacggcgctttggagcgatccgccgccaggaagccgtagaaatcacgttcctgggcgaggtttttgtacagcaccagcggttgcgggttcttcggctcagccagttccaggctgcgcgcctgccagtaacgccagcggttggtggtcgccaggtcttgtgggagtttgcgggtcaactggtaggcatcttcccagcgtgccaggcgcaacagcaggcgcaggcgccattctgaaacggtgttgtcacgcagctcgggatcgtattgggtcattacgtccaatgcgcgcgggtcatagcggcgggcgagagtcaggccgatttcgcgggcgatcgacactttttcgtcacgggagaagtgcatgctgctggcgtaaccgtcgagcagcgccatggccttgtcagggtcctggcgtgccaggcggcgcaggcccaggccgacggcgtcggacatggcctcgttggccggcaggaagcgcgacgggtcgctgagcatgtcgggcttttgcgccacgtcgaccatcaggcggccttgagcgccgagggttggcagggtttttaccaggctgttggccagcgcgtagttgcgcgcttcggcggcgagtttggcgcgatcccagattttttgttcggtgagttggccatcggcggcccactggccgaaggtggcgtcacacgcggcgggctgggatttgccggtcagccagagtttttcggtggtcttgtagccttcggctttgaggttgtgggtgagctggtattgaccatgcaggcagtccagttcgacgaaattgagtttggcgtcgtagtacttttcaaacgtctgccagtcgccacggtcggccagccagcgcagccaacgcagtttcatccagttggcctggggcaggtcgccgtttttggcgaggaactgttcgatttcctcgttactcgcggttttcaggcgcgctgtcagttcgtcataggccagatagggcgtcagcgggtagtcggccaaggcctggctgtattgcatgtacgggccgctgtcgcctttggcgagggcgcgtttggcttcatcgtaatattgacgttgggtggtgaggtccacggcctgggcggattgaacggcggtggcggaaagaagcaggcaagataaaaagttgaaaaggcgactgcgcatgagacgtccgtgcagagaaatcacgactagcaccggctctgccgacactgattgcccctagcttagccttttgccagcggccggcgaaagctttgccggccggctggcagaagttcatcgtaaatgtcctacagaacgtgtcgatagcgaaaatgccgaccgcatcccaccctcaagtcaggtagaatgcgcgcccagtttttggagaagcgtatgaccctgctcaaattcagcgatgtgtcccttgctttcggcgctatgccgttgttggacaaggtgtcctggcagatcgcccgtggtgagcgggtgtgcatcatcggccgcaacggcaccggcaagtccagcatgatgaagctggtaaaaggcgaccagaagcccgatgacggctctgtttggcgcgccccgggcctgaagatcggcgaattgccgcaagaattgccggtggccgacggacggacagtgttcgacgtggtcgccgaaggcctcgacggtgttggcgagttgctcgcgcaataccatcacctggcgcagaactgcgtcaccgaggaagacctggacaagctgatgcacgtccagcaagacctcgaagcccgtgatggctggcgcttgcagcaactggtcgacagcaccctgagccgcctgcaactgccggccgacaagaccctcgccgagttgtccggcggctggcgtcgtcgcgtgctgctggcccaggcgctggtgtccgagccggacctgctgctgctcgacgaaccaaccaaccacctggacatcggcgcaatcgcctggcttgaagaagccctcaaggatttccagggcgccgtgctgttcatcacgcacgaccgttccttcctgcagaacctggccacgcgcatccttgaactggaccgtggcggcctgatcgactggaacggcgactacgccagcttcctggtgcacaaagaggccacgctggccgctgaagaaaccgccaacgcgctgttcgacaaaaagctggcccaggaagaagtctggatccgccagggcatcaaggcccgtcgcacccgtaacgaaggccgtgtacgcgcgctgaaagccctgcgggttgagcgcagcgaacgtcgcgagcgcaccggcaaggccaatatccagctggataccgccgataagtcgggcaagcaggtgatggtgctggagaacgtcagcttccatcacccggatggcccgttcctgatcaaggacttctcgatggtcctgcagcgcggcgaccgtatcggcctgctgggcgccaacggcaccggcaagaccaccttgctcaagctgatgctcaatggcctgcaaccgaccagcggcaccgtggaagagggcacgcgcatcgacgtggcgtacttcgaccagttgcgccaccagttggacctggaaaaaaccgtgatcgacaacgtcgccgaaggtcgcgactttatcgatatcgacggccagagccgccacgtgctgagctacttgggcgacttcctgttcagcccgcagcgtgcgcggacgccggtcaaagccttgtccggtggcgagcgtgcgcgcctgctgctggccaagctgttcagcaaaccagccaacctgctggtactcgacgaaccgaccaacgacctcgacgtggaaaccctcgagctgttggaagaggtcttgctgaccttcaacggcaccgtgctgatggtcagccacgaccgggcattcctcgacaacgtggtcaccagcaccctggtcttcgaaggcgaaggcaaggtgcgtgaatacgtcggtggttatcaggactggctgcgccaaggcggctcgccgcgcctgctgggcgtgaccgagagcaagtccggcaaggccgacctgacctcggcagtggtggcgccggttgccgctgctgcggcaccggtccaggaagctgcgccgtctgcgaagaagaagctcagctacaaactgcagcgtgaactggaagccttgccgggtgatatcgacgccaaggaacagcagatcgcggcagtagaagcagaaatggctgacgcgggtttctacctgcgtccggcggcggaaaccgccaaggtcatcgcttccctggaaacgttgaaccaggagctggaggtgttggttgagcgttgggctgagctggatgcctgagtgattcaagcgcattaaaaaacccggtgttcatttacatgaacgccgggtttttcatatgaaatgcgagtcaaaatgtgagagggcccatgtgggagccgggcttgcccgcgatgcgggcaccgcggtgagtctgttggcctgcggtgatgctatcgcaggcaagccagctcccacataagccagctcgcacagttgatcttcgtcagtcttacttgttggtgtctttgaccagcttcaccgccagcacatcacaaggcgcgccgtgcagcacgtcattggcagtggaacccagcagcagcgcaaggccgtgtcggccatggctgccaaccacgatcaggtcgcaagccttttccttggcaagatggtggatctcctggcgcggttggccgtacgtgaggtggcagtcgtctttttgcagatgcgggtacttgaggatcaagcgatccaggcgctctttggcctggtcaaattgttgttgctgcaactgggaaaggtccatcggcacgtcgccgccaaaggccatcgccataggctcgacgatatgcacgagtgacagcttggcgccgttagcgattgctgaagcctgcgcgcgcttgatcactgggtcgcactcttcggtcagatcgacagcgaccaggatatgtttgtaggaatgttcgttgggcatggcgcgttcctccaggggactgcaataggttcagtatggctggtttcaagcggatggggttgcgtcagctcaaacccgctcatctagaaattcgggagtacacatatgacggtctggatagtggtgtcaatccttctggtggttctgagccctctggcctggctgcgcccgtcgcgccatcagagcgggcgcatggccctgcggatggaggcacgccgcatcggcctggccatgcaactggcgccgcaggagtggccgcactggctcaagcaggagccgccaagcccgtgcgcgcagtattgccggcctcgacgcgggagtgcgccggccctctggtgttactggcagtcggaaccgggggtttggctcaatcagtggcgtgaagtgtgcgtcgatgaaaagttgttgccgcattttgcgacgctgccggacaacgtctacaaggtcgaggccgacaagcaaatgatcgccttgtactggggcgagaagggcgaggcgagcgtcttgcaagccatcgataaattactcaaagccctggcctgacgccgggtggtaaaagccaggcaataaaaagcccgatatcatcatcgggctggagttggccaggcaggccggtaattctgtgattcacgcgtcggatgttcatccaggcgcatcaagcttgtcgctagcctagcggcatatcccattctgtacagccttttcccacaaaatttccattattgatttcgtgaatagttgaatattgacgaatcacgggcaatgggtgggggttctgaaatgactggaaagtcgcgttttccctagcctttcgagcgattgacaattgcccggaattggatgaaggtggcgtacccaaatcaaacgggcgtatgaattgagcgtttgtctgtcagaccgctcatacagaaccccgactagcgcattggcgggtgtgcctggcggattggcgtgaacattgagcaaatcatcaatgtccaaccagaggccagcgtccagtgtgtactgttcagcttccatatcgtggagatcagttgatgatttacgaaggtaaagccatcacggttaaggctcttgaaagtggcatcgtcgaattgaaattcgacctcaagggtgagtccgtcaacaagttcaaccgtctaaccctgaacgaactgcgtcaggccgtagacaccatcaaagcagatgcatcggtcaagggcgtgatcgtctccagcggcaaggacgtgtttatcgtcggcgctgacatcaccgaattcgtcgacaacttcaagctgcccgatgccgagctggtggctggcaacctcgaagccaacaagatcttcagcgatttcgaagacctcaacgtgccgaccgttgccgcaatcaacggtattgcgttgggcggcggcctggaaatgtgcctggccgcagacttccgcgtgatgtctgcgaccgccaaaatcggcctgcctgaagtcaaactgggcatctacccaggtttcggcggcaccgtgcgcctgccgcgtatcatcggggccgacaacgccatcgagtggattgccgccggcaaggaaaacaaggccgaagacgcgctgaaagtcggcgctgtcgatgctgtggttgccccggacaaactcgccgaagccgcactgaacctgatcaagggcgccatcagcggcgaatttgactacaaggccaagcgtcagccgaagctggaaaaactcaagctcaacgccatcgaacaaatgatgtcgttcgaaaccgccaaaggtttcgtggctggccaagccggcccgaactacccggcgccggttgaagcgatcaagactatccagaaggccgcgaacttcggtcgcgacaaagccctggaagtggaagctgcaggcttcgtcaaactggcgaaaacctcggcagcacagagcctgatcggcctgttcctgaacgatcaggaactgaagaaaaaggccaaggcctacgacgaaatcgccaaagacgtgaaacaggccgccgtactcggcgccggtatcatgggcggcggtatcgcctatcagtcggcgtccaaaggcacgccgatcctgatgaaagacatcaacgagcacggcatcgagcaaggcctggcggaagccgccaagctgctggtggggcgcgtggataaaggtcgcatgaccgctgcgaaaatggccgaagtgcttaacggcattcgtcctacgctgtcctacggcgacttcggccacgtcgacctggtggtcgaagcggttgtcgagaacccgaaggtcaagcaagccgtactggctgaagtggaagcccaggttaaagaagacaccattctggcctcgaacacctcgaccatttccatcagcttgctggccaaagccctcaagcgtccggaaaacttcgtcggcatgcacttcttcaatccggtgcacatgatgccgctggtggaagtcatccgtggcgagaagtccagcgagctggccattgccaccaccgttgcctacgccaagaaaatgggcaagaacccgatcgtggttaacgattgcccgggcttcctggtcaaccgcgtgctgttcccgtacttcggcggtttcgccaagctggtcagcgccggtgtggattttgtgcgtatcgacaaggtcatggaaaaattcggctggccaatgggcccggcgtacctgatggacgtggtcggcatcgacaccggccaccacggtcgcgacgtgatggctgaaggcttcccggaccgcatgaaagacgaccgccgttcggcgatcgacgcgctgtacgaggccaagcgcctgggccagaagaatggcaaaggcttctacgcctacgaggccgacaagaagggcaagcagaagaaagtggccgacccgtcggttcacgaagtactcgcgccggtcatctacgaacagcgtgaggtgtccgacgaggacatcatcaactggatgatgatcgccctgtgcctggaaaccgtacgttgcctggaagacggcatcgttgaaaccgccgccgaagccgatatgggcctggtgtacggtattggtttccctccattccgtggtggtgcgctgcgttacatcgactcgatcggtgtggccgagttcgttgccctggctgacaaatacgctgatctgggcccgctgtaccacccgaccgcgaagctgcgtgagatggccaaaaacggccagagctttttcggttaagcgcccagacgactagagcgagaatatttatgagcttgaatccaagagacgtggtgattgtcgacttcggtcgcacaccaatgggccgctccaagggcggcatgcaccgcaacacccgtgccgaagacatgtccgcgcacctgatcagcaagctgctggagcgcaacgtcaaggtcgacccgaacgaagtcgaagacgtgatctggggctgcgtcaaccagaccctggagcagggctggaacatcgcgcgcatggcgtcgttgatgacccagatcccgcacacggctgctggccagaccgtcagccgcctgtgtggctcgtcgatgagcgcgctgcacaccgctgcgcaagcgatcatgaccggtaacggtgatgtattcgtagtcggcggtgtggagcacatgggccacgtcagcatgatgcacggcgtagaccctaacccgcacatgtcgctgtacgcggctaaagcctcgggcatgatgggcctcaccgcagaaatgcttggcaaaatgcacggcattacccgcgaagcccaggacgcgttcggcctgcgttcccaccagttggcccacaaggcgaccgtggaaggcaagttcaaggatgagatcatcccgatgaacggctacgacgagaacggtttcctgaaactgttcgactacgacgaaaccattcgtccggacaccaccctggaaagcctggcggccctcaagcctgccttcaatccaaagggcggcaccgtgacagccggtacttcgtcgcaaatcaccgacggtgcctcgtgcatgatcgtgatgtcggcgcagcgtgcccaggacctgggcatccagccactggccgtgatccgttcgatggcggtggcgggtgtggacccggcaatcatgggctatggtccagtaccggccacacaaaaagccttgaagcgcgcaggcttgaccatctccgatatcgacttcttcgagctcaacgaagctttcgccgcacaggccctgcccgtgctgaaagatttgaaagtgctcgacaagatgaatgagaaggttaacctgcacggcggtgcgattgccctgggccacccatttggttgctcaggtgcacgtatctccggcactttgcttaacgtgatgaagcaaaatggcggcaacctcggggttgcaaccatgtgcattggtctcggccaaggcatttccaccgtcttcgaacgcgtctaagcgttgagttgacggaagccggggcccagtgccccggtttttgttttttggaatttttaatatttttttttaacaaattttgtaagagggccagagcatgaaagtcgaaccagggctctaccaacattataaggggccgcagtaccgcgtttttaacgtggcacggcactctgaaacggaagaagaagtggtgttttaccaagcactgtatggcgattacggcttttgggtgcgtcctttgaacatgttcctggagaccgtcgaagttgacggcgagcaggtcccgcgctttgctttgatccaggtcgaacccagtcttttttcagggcaataacggcgggccgcgcagaatgctgcgcttgacctcaccttgttgccactatatatagcgttgccgcgacaggcgccaactgcctttcacttctcgaattcaggaattttccgatccatgggcaaatcgctggtcattgtggaatccccggctaaggccaagaccatcaacaagtacttgggtaacgagtacgtggtgaagtcgagtatcggccatatccgagacctgcccaccagcggttcggctagcgccagcaaggagcctgccgccaagcgcggcaaggcggctgcgggcgaaggtccggtgctcacccctaaagagaaagcgcgcaagcagctggtctcgcgtatgggtgtggacccggaacatggctggaaggccaagtacgaaatccttcctggcaaggaaaaggtcatcgaagagctgcgccggctcgccaaggatgctgacaccatctatctcgcgacggacttggaccgcgaaggggaagccattgcctggcacctgcgggaagccatcggcggtgatgacagccgctacaagcgcgtggtgttcaacgaaatcaccaagaaagccatccaggaagccttctccaagccgggcgaactggacatcgaccgtgtaaacgcccaacaggcccgtcgtttcctcgaccgcgtcgtgggttacatggtttcgccactgctgtgggcgaagatcgcccgtggcctgtccgccggccgtgtgcaatcggttgcggtaaaactggtggtggagcgcgagcgcgagattcgtgcgttcaaccccgaagaatattgggaagtccacgctgacctcggcacagccaagggcgccaacgtgcgctttgaagtagcccgcgagaaaggcgaggctttcaagccgctgaacgaagcccaggccatggccgcgctggagaagctcaaggcttccagctacagcatcgtcaagcgtgaagacaaaccgaccagcagcaagccgtcggcaccgttcatcacctccaccctgcagcaggccgcgagtaaccgcctgggcttcggggtgaagaaaaccatgatgatggcccagcgtctgtacgaagccggctacatcacttatatgcgtaccgactccaccaacctgtcgcaagacgcggtggcgatggcgcgtacttatattgaaagcgagttcggcaagaagtacctgccggagaagcctaacgtctacagcagcaaagaaggcgcgcaggaggctcacgaagcgattcgtccttccgacgccaacaccgagccaagcaagctgagcggcatggaacgcgacgctgagcgcctctacgagctgatctggcgccaattcctggcctgccagatgctgccggcgcaatacctgtctaccaccgtcagcgtgggcgctggcgacttcgagctgcgtgccaagggccgtatcctcaagttcgacggctacacccgcgtgatgccgcaaatcgccaagcctggcgatgacgatgtgctgccggacatggcccagggcgacacgctgaagctgatcaagctcgacccgtcccagcacttcaccaagcctccggcgcgttattcggaagcgagcctggtgaaagagatggaaaaacgcggtatcggtcgtccttcgacctacgcggcgatcatttccaccatccaggaccgcggctacgttgcgctgcacaaccgtcgtttctactcggaaaagatgggcgacatcgtgactgagcgcctgtccgagagcttctccaacctgatggactacggcttcaccgccggcatggaagagaacctcgatgacgtagcccagggcgagcgcgactggaaaaacgtgctggatgagttctacggcgacttcaagaagaaactcgaagtggccgaaagccctgagagcggcatgcgtgccaaccagccggtgatgactgacatcccgtgcctgacctgcggccgcccgatgcagatccgtaccgcgtccaccggcgtgttcctcggttgctcgggctacagcctgccgccgaaagagcgctgcaaggccaccgtcaacctggtgccgggcgacgaaatcgctgctgacgacgagggtgaatccgagtctctggtactgcgtggcaagcaccgttgcccgatctgcagcacggcgatggacgcctacctgctcgacgagaagcacaagttgcacatctgcggtaacaacccggattgcgacggctacgagatcgaagagggcagctaccgcatcaagggctatgaaggcccgagcctggaatgcgacaagtgcggcagcgagatgcagctcaagaccggccgtttcggcaagttcttcggttgcaccaacccgacgtgcaagaacacccgcaaactgctgaaaagcggtgacgcggcgccgccgaagatggacccggtgaagatgcctgagctcaagtgcgagaaggtcaacgacacctacatcctgcgcgacggcgcttcggggttgttcctggctgccagccagttcccgaaaaaccgcgagacccgtgcgccgttggtgctggaaatcgtgccgcacaaggacgagatcgatccgaagtaccacttcctgtgtgaagcgccgaagaaggatcccgacggtcgcccggccgtgatccgctacagccgcaaaaccaaggagcagtacgtgcagaccgaagtggacggcaagcctacgggctggaaagccttctacgacggcggcaagtggaaggtcgaggacaagcgccagggcgcttgatcgactacgctgcgaaatacaaaggccgcctgcataggcggcctttttttgcgcttgcaggagtctcggctgatccgtgacactgctaggccagcatcaagcctattcgttgtggagactgccgttatggccaacgaactctatacccgtaccaaccagaaaatttacttcgcgggtttgtccctggaagcccttggccgcgccgaggaagggaaggagatgaatgccatcgcgctggtgcaggcggggcgtgaggctgcattgttccatctctacggcgctcttttgggcctgtgccatgaaatcgctgggttctaccgcttgccccaggccggttcgccacgtgcggaaatgatcatgaaccgcgacgtgctcgacagcatggcgattcccgagttggctgagctggtggaaatggcccagagccccgacagttgggtcgcccgcttgctcaaggcgcatgccgacatgttccagccgccacgtgtgccgcatgtgcccaagggtgatgtgacgcagccgctgatcgtcgctgttgcactggaagaggatgagcccaagccattgagccgtgaagagctggaaagctggcgccaggagctgaagaagatggcgttgcggtttcgggaaggcttgaacgaatgttgaaggggtttggctgaacaaatgtaggagctggcttgcctgcgatagcggtgggtcagcttgctggtgattgactgaaacaccgccatcgcaggcaagccagctcccacactgatagctgcattaccgaaagcaccattcatcaagccgtaaagaaacccgtgcagatcctcaacgaggttgggtagatgactgatataatcccggcctttcgtggagaacagacttttatgccaacgtcctttctggaaattgttgaattgcctgacggccgaatcgagctacgccgggctgaggacgagggttctctggttatccttgatttttccgaagacgcaaaagcgttcctgcaaggccagcacgtggaagtggcaaaagccatgttgagcgtcggtgtgcagatggcgggtcgcctggcagaaggcgagccggagaaggacgaggggccgcgggttcttcactgagcatcagtgaagcccgctcgccacaacaagcccgctacattccattaccccaaacgaatattcaaactctgcgcatcgcccgtacgtgccgcgctgatcaactgttgcttggccgtagcattcaacggattcaaccagctcaccaccgtatggctacgccccaggcgcagcgcttcgcaggtcaactgctgagcgctttgcgtgccgcgtggttgcagcagcagaatacgctcgcggttgaggccggcatcccgcaaccaggcctgggtcaggctggcgggcggggcgatcagcgtcagccagcgcgcgtcctgttcttcgctcaattcgcgaaggatcggcgccagcaggctcaggcagctcccagctgcaccgcgcaacgacagttcactgaacgcctcaggttcggagccccaaggggcctcgaccgtttccttgaggatgggcgcgaggggttgggccataaaggcctcgaacagcgacagttgtgtgtgttgtggggtgtgcacgagctgcatggtgcctcctttagcggcgaatgacgccgacgctcaagccttcgatcaccaggtcctgatctttcaggttcacttcaatcggggcgaactcagggttttcggccatcagccaaaccttgctgccttcacgcttgaagcgttttacggtgacttcatcgccgatacgggcgacgacgatctggccattacgggcttcacgagtggtatggacggccagcaggtcgccatcgaagatgcccacgtccttcatgctcatgccgtgtacgcgcaacaggtagtcggcacgcggatggaagaaggtcgggttgatgttgcaggactcttcgacgtgctgctgcgccaggatcggcgcaccggcggcgacgcggccgatgatcggcagggtcgattcgtcggccttggcttcgaaaccagggatgcgaataccgcgtgaagcaccgggggtcatctcgatcgcgcctttgcgagcgagggccttgaggtgttcttcggcggcgttgggggatttgaaccccagctccagcgcaatttccgctcgcgtcggcgggtagccgttgtcgtcgaggcagcgcttgataaaagccagaatctcagcttggcgtggcgtcagttttagcatgttgatcgctctgtctttttatacagtgactgggattatatacagtgaactgcgcttggcaatcatccttttccggcactccgctggacggtcattcgtcacccgtcccacgaggcagagacagcgctgcctacagacccgtaaggatgtgattaaatagcgatgaaatagatgactgcccggccggaaaacggactcgcaggcttgacaagacacaccctgaaacgtatgtttcaaacaagtgtttgtcaggcggagtagccatggcccagtcggaaaccgttgaacgcattctcgatgctgccgagcaattgttcgcggaaaaaggatttgctgaaacttcattgcggctgatcaccagcaaggctggggtcaatctcgctgcggtgaactaccatttcggctcgaaaaaagccctgatccaggcggtgttctcgcgcttcctggggccattctgcgccagcctcgaccgtgagctggaacgtcgccagaccaagccggaaaacaagccaagcctggaagacctgctggaaatcctggttgagcaagccctggtggttcaaccgcgcagcggcaacgacctgtcgattttcatgcgtttgctgggcttggccttcagccagagccagggccatctgcgacgttacctggaagacatgtacggcaaggttttccgtcgctacatgttactggtcaacgaagctgccccgcgtattccaccgatcgaactgttctggcgcgtgcacttcatgctcggcgctgcggcattcagcatgtccggcatcaaggcattgcgtgcgattgccgagaccgatttcggcgtcaacacctcgatcgaacaggtcatgcgcctgatggtgccgttcctcgccgccggcatgcgtgccgaaaccggcgtgaccgacccggccatggcggccgcgcaattgcgcccgcgcagcaaatccacgccggccgtcgccaaggcgtgaccgccctgggtgtgcgcggccgcttgcatccgctaagctagccgccatgccgatttcagctatttactcgcaacccgttgtgctcactgcgcttatcgcgccaggtgagggcaacgggttgtttgcgttatttaaggaaggtttatgactgctgccctgcaaggttcgttaatggtcgatgtggccggtacttggctgacggccgaggatcgccacctgttgcgccagcctgaagtgggcggcctgatcatttttgcgcgcaatatcgagcatccacgccaagtgcgtgaattcagcgccgcgatccgtgccgtgcgcccggacttgctgttggccgtcgaccaggaaggcgggcgtgtgcagcgtttgcgccagggctttgtgcgcctgccggccatgcgcttgttggcggataagccgaacgccgaataccttgccgaacagtgcggctggatcatggccactgaagtgctggcggtgggcctggacctgagcttcgccccggtgctggacctggattaccagcgtagcgccgtggtcggcacgcgttcgttcgaaggcgaccccgagcgcgccgctgtgctcgccggcgccttcattcgcggcatgaacagcgccggcatggccgccaccggcaaacacttcccgggccatggttgggctgaggcggattcccacgtcgctattcccaatgacgaacgcagcctggaacagattcgcgccaatgacctggtgcctttcgcacgcctgagcaagcagttggcggcggtaatgcctgcacacgtcatttacccgcaggtggacgcccagccggccggcttctcgcgccgctggttgcaggagattttgcgtggcgagttgcagttcgacggggtgattttcagcgatgacctgtccatggccggggcgcatgtggtcggtgatgcggccagccggattgaagcggcgctgacggccggttgcgatatggggctggtatgtaacgatcgtgcggctgctgagctggcactgactgcggcgcagcgcatgaaggtcacgccgtcggcgcggattgcgcggatgcgtgggcaggcggttgcgtcgacggactacaagcaggacccgcgttggttggcggcgcttaccgcgttgcgcgatgctcagttgatcggctgaaaaccggggtgcatccatcgcaggcaagccagctcccacattttgatttgtgaacacattcaaaggtgggagctggcttgcctgcgatagcgatctgaaggtcagcgcttctcttgcttattcggcaacggcgcaaacaacgcctcgatatcctcattgcccaactgccaatccccggtcgtacgcccatccagcacgcccgccgccaggtcggatttttccttttgcaggtgctggattttctcctccaccgtgccccgcgcaatcatcttgtagacgaacacaggcttctcctgcccgatgcgatacgcacggtcggtggcctggttctcggtggccgggttccaccacggatcatagtgaatcaccgtgtcggcttcggtcaggttcaagcccacgccgcccgccttcaggctgatcagaaaaatctgcagcttgccgctctggaagtccttcaccggcgtgcgccggtcacgggtctggccggtcagcagcgcgtaggcgaccccgcgcttctgcagttcggcttcaatcaggctcagcatcgaggtgaactgcgagaacagcaaaatccgccgcccttcggcaaacagctcttcgagcatttccatcaggctgtcgagtttgcccgagctgctgccacgcgcgggcagggtggcgtcgttgaccaggcgcaggtcgcagcacacctggcgcagcttgagcagcgcttcaagaataatgatctggctgcgcgccacgcctttgcgggtgatttcgtcgcggacttttttgtccatggccaggcgcatggtttcgtacacatcacgctgggcctcgttgaggtcgacccaatggatgatctcggtcttgggcggcagctccgtcgccacctgctctttggtgcggcgcagcaggaagggtttgatccgaccgttgaggtgctgcaagcgcacatcactggcgcgcttttcgatgggcacgcggtaatcgcggttaaagcttttcacgtcgcccaaccagcccggcagcaggaagtggaacagcgaccacagctcgcccaggtggttttccagcggtgtgccactcaggcacaggcgctggcgcgcattcagctcgcgcgcggcctgggctgccttgctgttggggttcttgatgtactgggcttcatcgaggatcagcacatgcaagggcagggcggcgagctgttcgatgtctttgggcagtagcgcatacgtcgtcagcagcaggtcgtagtcctgcaaattggcgaagtgctttttgcgtgtcgcaccatacagcgccagcaccttgagctgcggggtgaagtgcgccgcttcgtcgagccaattgggaatcaggctggtgggcatcaccaccatgcacggccgatccaggcgcccggcgattttttcgctgagaatatgcgccagggtctgcagggttttacccaggcccatgtcatccgcaagaatcccgccgacgtcgagttggcgcagcgactgcatccagctcaagccttccagttggtacgggcgcaaggtcgcgttcaagccctcgggcgctacacaggtgaagtccttgatgtcacgcaggcgctgggcgaagttgcggatcttctcgccgccttcccattgcagcggcaggtcttccagcggattgaggcgaatcgcgtcggccttggccaggcgcaacgtggtggtgccggattcctgcaggtaaaactcgccgagggtggccagcaccggtttcaatcgcccataaggcagcgccacttgcagtgggccgtggccgttgggcaggccggggatgttcaccaggatcagctcttcatcgcggcgccgggcgagtttttccgggttgaggatttcggtgtgggaacgcatcaggttaagcaggatcggcaacaggctcagccgctcaccgttgacgatgatccccagttccaggtcaaaccaatcgcgttccggcccttcatcgacggtggcgtaccagtcatcaacggcgctcaggtcaaagccgaaatcctcatcgatctgcagctcccaaccctcggcgcgcaaggtgggcgaggcgttgagcgtgaagttcagccaggcgctgtcattgaccatctcgaacaattcaccggcactctccggcagcgctttgctctggcgcgtggcgatcttgaaaccgagcaggcgcagttgctcgcggtacggctgctccagctccgggtgacgcttgatgcgcaggctctgggtttcctggcgcacgatgatgtcggcgttcttttgcccgctgacatagttgcccaggtaattaaacgacagcgccgcgcggtgctggatatagcgctgcatcttgccattgcgcggttcaaacgcgctgaactcgacactcgccagccacaggcgcggcactggccgcacatcctccatcaccacttgcggcaacaccacgcggttatccagcacggcctggagtttctccagcaactcggcatcctgggcggctgccgggtaggccagggtttcctggaccttgagcagcactgccgcgatgtgtttgcagttggtgtgcaccgggcaggtacagcggctgtccaccaggatcagcgtgcccttggccgattcgcgcagcgaaatggtctggcggtaaacgttgccgcccgagccttcgcagctggcaacgatggtgctgtcgccggactcgacgatgcgcacacggttttccagggcatagcgccgcccgcgctcaaggctttgctctttgaagcgattggcccacgaaggggccaggggtttggtcaacgacgacgtcaggggcatggcgctggatcagtcctgaatgtcgggcggtggtgcgctgggaggtttggcggtcagcgaagtgatcttgatcagcagcgccaggtggccgccgtccaggtagttgagctggttgttcttggtgcgcacatcctgctggctcaggtgttcgctggcgatgacgctgccgttggcgtcgaactggttgatgtagaagtctgcgtcgatatcggtaaaacgccccagttgcaggttcagcgtgccttcgatggggaattggccaaactgctcctggccgtcgctgatggccagcttcactggctgctcgcccaggttctgatcccaggcccggtgcagcagcacggtgtagctgttgtcggcattgagtttgtcgacgatgttgcccaggcgcggcgggctcattttgtcggttggcaggcgtaaagcgccggcatcccagttttccggggccgcgcggctattgatcaccggctcggcgttctggcgcaccaggatcatttcgatcaagtacgggctgtcggcaaacgccgaaggggcaacgaccaccaacaacaagctcaaaatgcggaacaggcgcattggggcgtccttcaagctgatttcgggatgaggcgctcaaacagcgcctctaatgtattaaagcgttcttcggcgcgttccatcggcaccatgaatttgaacagcgtagccccttcgaacttgtagcggttgggctggccctgaatcagcttgatcaacaccagtgggtccaccggcgtttgcgcttcgaactcgatgcgcccgccctgcggcccggcgtcgaccttcttgatgcccaactgctcggcctgcaatttgagcagggtcaggcgcaccaggttcttggtcggttcgggcaacaggccgaagcggtcgatcatctcgacttgcaggtccttgaggccttcttcgtcggtggccgaggcgatgcgcttgtacaggatcagccgcgcgtgcacatccggcaggtagtcttcgggaatcaacgccggcaagcgcaggttgatttccggaccgccgcccaagggttgatcgaggttcggttgttcgcccttgcggatggcttttaccgcgcgctcgagcatttccatatacagggtgaaacccaccgcctggatctgcccgctctggccgtcgccgagcagttcgccggcgccacggatttccaggtcgttggtggccagtacaaaaccggcaccgaggtcctgggtgttggcgatggcttccaggcgcttttcagcgtcgccggtaatctgctggcgcggtggcgtcagcaagtaggcataggcctggtggtgactgcgcccgacccggccgcgcaattggtgcagctgcgccaggccgaacttgtcggcgcgctcgataataatggtgttggcgctcggcacgtcgatgccggtctcgatgatggtcgaggcgatcagcacgttgaagcgcttgtggtagaagtcgctcatcacctgttcgagttcgcgctcgcgcatctgcccgtgaccgatggcgatacgcgcttccggcaccagctcggcgaggtcggcggcgcatttctcgatggtcttcacgtcgttgtgcaggtaatacacctggccgccgcgcagcagttcgcgcagcagtgcctctttgaccgtgcttttgttttgctccatcacgaaggtgcgcaccgacaagcgccgcgccggcggcgtggcgatgatcgacaggtcacgcatgcccgacacggccatgttcagcgtccgtggaatcggcgtggcggtgagcgtgaggatatcgacctcgctgcgcagcgccttgagctgttctttctggcgcacgccaaagcggtgttcttcgtcgatgatcaccaggcccaggttcttgatcttcacgtcgtccgacagcagcttgtgcgtgccgatcacgatgtcgatcttgccttcggccaggtcggcgacggcggcattcacttccttggcggacttgaagcggctcatcacctccacggtcaccggccagtcggcgaagcggtcgcggaagctgttgtagtgctgctgggcgagcagggtggtgggcaccagaatcgccacttgcttgccaccgtgcaccgcaatgaaggcggcgcgcatggccacttcggttttgccgaagcccacgtcgccgcacaccaggcggtccatcggcttgggcgcgagcatgtcggcgcgcacggcttcgatggtggtttgctggtccggggtttcttcgaaggcaaaaccggcgctgaaggtggcgtagtcggctttagggtcggcgaaggcataaccctcgcgggccgcgcgacgggcatagatgtcgagcaattcggcggccacatcgcgcacctgttcggcggccttgcgcttggccttctgccaggtctcggagcccaggcggtgcaacggcgccagggcgtcgtcgctgccggtgtagcgcgcgatcaggtgcaggctggccacgggcacgtaaagtttggcgccctcggcgtattccatggtgaggaattcggcggcctggttgtcgatttccagggtttgcaggcccaggtagcggcccacaccgtggtcgatatgcaccaccggcgcgccttcgcgcagctcggtgaggtttttgatcaccgcgtcgttattggcgtcggcacgtttttcacggcggcggcgttgcatcacgcgctggccgaacagcgggctctcggcgatcagcgccaaggccgggtcatccagcagcaaaccttcgtcgagcggcgcgatggtgatcgccaggcgctctttgctttttacgaaatccggccagctgtcgacggttttcgggcgcagcttcaggcgttccagcaactccagcagcacttcgcgacggccggcggattcggcggtaaacagcacgcggccggggaagtcgccgaggaagttggacaacgcttccagcggctgcgtggctttggcctggatcgccaggtccggcagcgtgcccgccgggaagcgctcgcgaccgctgccggcgtccacgtcctgttggctggcgaccacgcgcggccagtttttcaggcgggcgaagcagtcttccaccggcaggaacagctcggcaggcggcaataaaggccgcgatggatcgacgcgacgctcttcatagcggttgcgcacgtcgttccagaagttttccgccgcttgctcgatgcctggcagcgagaacacttgggtgtcttgcggcaggtagtcgaacagcgtggaggtttcgtcgaagaacagcggcaggtagtactcgatacccgccggtgtaatcccgctgctcaaatcctgaaagatcgggcagcggcggaagtcgacgtcgaagcgttcgcgaaagcgggccttgaagcgcgtgacggcatctttttgcagcgggaattcccgtgccggcagcagcttgatcgactcgactttatcaatcgaacgctggttctccgggtcgaaggtgcgcagggtttcgatttcgtcgtcgaacaggtcgatgcggtacggcaacttgctgcccatcgggaacaggtcgatcaacgccccgcgcacggcgaactcgccgtgttcgtacaccgtgtcgacgcagcggtagccactggcttccaggcgcgtgcgcatctgttccacatcgagcttctggccgatatccagcaccaggctgctgcccagcaggaacttggtcggcgccaggcgatgcaaggctgtggtgatcggcaccaccagcacgccgtgggccagttccggcaggcggtaaaggctggcgatacgctgggaaatgatgtcttggtgcggcgagaacaggtcgtagggcagggtttcccagtcgggaaaatgcagcaccggcaaatcgggggcgaagaagctcagctcctgctccagccgctcggcgctttggctgtcggcggtgagcagcagggtaaagcgcttggctgcgctggcagcctcggcaatcgccaggctgagggccgcaccgggcaggttgccccagtgctgtttacctgccgcagcagggagaagcggtagacgcagaacgggcacggaaggttgagctccaagcgttgcgacaaagtcggtaattgtaacggcccgaggtgccgcctgtcagttgctgactgagcctattacggtttgtaggaaatgtagtggctaagacaaacaatggcgtgttttgactcaatatgtagtgccattttatgcggatgtttcggagggttacggacaagtcggcgtcgtcgctcaactagtggccttctggaacccgcgtgtttcctggcctgtagcggggtggtatttttttgcaagtgctttttgttggggttggcgcattgctcaatgtgcggtcggacgacataatgtagccccttttttctgcccctacatgtggaaggttcccgtgactcagaagcccgaccagtgtcttggtgaatggatcgaccgtgaagcactcgctgaagcgatgattccgcttatcggtcagctgtaccgcaataacaatgtggtgagctcgatctatggccgcagcctgatcaaccaatcagtcatcgcgattctcaaagcccaccgctttgctcgccatcgctccgccgacgacagcgaactctccgtccacgaaacattccctctgcttaaagccatgagcgagctcaagctcggcgcggcctcggtagacctgggcaagctggcttacaaattccgcaaagaaggtgccggccgcagcgccgagcagttcgtgcgtgaagagatggccgatgtggttggccagcaaaacgccgctgcccgcaaaggcaccgacgttgtgctctacggcttcggtcgtatcggccgcctgttggcgcgcatcctgatcgaaaaaaccggtggcggcgacggcctgcgcctgcgcgctatcgttgtgcgcaaaggcgccgagaacgacctgaccaaacgcgccagcctgctgcgccgcgactcggtacacggcccgttcaacggcaccatcgtcatcgacgaagaaaacaacaccatcaccgccaacggtaacctgatccaggtgatctacgcgaagaacccggctgaggtggattacacccagtacggcatcaaggacgccctgctggtggacaacaccggcgtatggcgtgatgccgagggcctgggccagcacctggcctgcccgggtatcgaccgtgttgtgctgactgcgcctggcaagggcaagctgaagaacatcgttcacggtatcaaccacggcgaaatcaccgctgacgacaagatcgtgtccgccgcgtcctgcaccaccaacgccatcgtgccggtgctgaaggctgtgaatgacaagttcggcatcgttaacggtcacgttgaaaccgttcactcgtacaccaacgaccagaacctgatcgacaacttccacaagggcgatcgccgtggccgtagcgccgcgttgaacatggtgatcaccgagaccggtgctgctaccgctgctgccaaggccctacctgaactggccggcaagctgaccggtaacgcgatccgtgtgccgacgccaaacgtgtcgatggccattctcaacctgaaccttgagaaagccgccacccgcgaagaaatgaacgagtacctgcgctacatggcgctgcactccgacctgcataagcagatcgacttcgttaactcgcaggaagtggtgtccactgacttcgtgggttcgcgccacgccggtgtggtggacgctgaggcgaccatcacccaggacaaccgcgttgtactgtacgtttggtacgacaacgagttcggttacagctgccaggtggttcgtgtgatggaagacatggccggggttaacccgcctgcgttcccgcgctaagccttagcggtaaatgaaaagccccgactggttcggggcttttttatggctgctgtttttgtggtgtttggactggcctcatcgcaggcaagccagctcccacctttttgaattgtgaaccggctcaaaactgtgggagctggcttgcctgcgatagcaatctatcaggcaccaccaaccactgaggcctgcgccgtgcgcagttcatgccgattgcccttgaacagcaccaaagtagcaatcaaccccagaatcgccgccccgctgagccaaatgcccggcgccgccttgttatccagcacatgaatcaggtacgtacaggccgctggcgtaaacccgccaaacgtcgccgtcgccaggctgtaggccagtgagaaaccggtagtgcgcacttccaccggcatgatctcggtcagcgccaccaccatcgcgccgttgtacgagccgtacaggaacgacagccacaacagcaccatcagcaaatggctgaagctcgggttggccaccagccacgacaacgccggatacgcggtgagaatcgccagaatcgtcgcgccgagcagtagcggtttacgcccgatcttgtcggacaccgcgcccatcaccggcagccagatgaagttggagatgcccacgcacacggtcaccagcaatgcgtcgaagtcggacaggtgcagttcggctttaccgaaggtcggggtgtatgcggtgatcaggtagaaggacacggtggtcatcaccaccagtgccatgccggcgatgacgatgccgaagttctgaccgatcgaacgtacgatctcctgcagggtagggcgatgtttacgcgcctggaactcaggggtttcctccagcgagcggcgaatcacgaagatcaccggcacgatcaggcaaccgatcaggaacggcacgcgccagccccagtcacccatttgttccgggctgagccagtggttcaggcccacgccgagcaaaccggcgaacaccacggcggcctgttggctggcagactgccaactgacgaagaagcccttgcggccgggcgtggcgatttccgccaggtacaccgacacaccgccaagctcgacgcccgcggagaaaccttgcaacagacgaccgaacagcaccagcagcggcgccgcgacgcccagggtggcgtaaccgggcacgcaggcgatcaagaccgtgccggcagccatcaaggcgagggtgatgaccaggcctttcttgcggccatgacggtcgatgtaggcgccgaggaaaatcgcgcccagtggacgcatcaggaagccggcgccgaaggtcgccagggacagcatcaaggaagcaaaggcgctgtcggtgggaaagaaggttttggcgatggccgtggcgtagaagccatagaccatgaagtcgaacatctcgaggaagttaccgctgacaacgcgaaaaatcgccctgcctttgcccgtggaagtggacatgtcattcactcattttggctatcttattagtgatccctggtcatcactcgtccttgctgcgcttttgtaaccatatgtgtattggccactacccgcaataggaaccgatagctagctgactaaatgcgcaagtgtcttggcgggtagaaatcactgtgggagctggcttgcctgcgatggcggtgggtcagccatagatcagtcggctgacagtcggctatcgcaggcaagccagctcccacagaattttgtgttgatcagttaaggagggaattgcgcaagctatccgacaagcccttcggcgccagccagataccgagataggctttcgccaattcctcatcgcggctgctgaacaccaccttgtcgttgatctccaggttcaagccgcgcccagggcgaacgtcgagggcatagcgatcgccactgcggatatcgcggaaactggcatgcagtcgatccagttccggcttcaagcgggcgagggcggcgctggtttgctggcgctccagggcggtggtggcggccttgatcacatcgctacggtcgatgtcgcgaaagtaatacagcgtcaggcgcaaatccttctgttggtcccacgcctgtttcgcgagcatgtcagccggtgcgtacagcgcggccgcatacacatcggcccagagatagaccagcaccgcctggtttttcagcgccagttgatgggactgcgcggggaaatcggcctgcttgagccgatcagcctcactggccagcaccgcaaccgaaaaaatcatcattaaacagaaaaccacatgccgcataatggctcgtcctgcaaaggtgcgtgtcagcagtgtaatgccagtttcctgcttctgtagtaaaggcaagactggcctacgacgcgaccaagggttaatgttcgcggcgttgagccttatatagactgtgccccggctcacacacttgagccaaattgtccttcatgcccgctggccgcggcatgatttagccaggcgtccaaccgtacgcctggcctgttctgaggagtacgcatggctgtctacaactacgacgtggtggtactgggttccggcccggctggagaaggtgcggcgatgaacgccgccaaagcggggcgcaaggtggcgatggtcgatagccgtcgccaagtcggcggtaactgcacccacctggggaccatcccgtccaaggccttgcgtcactcggtgcgccagatcatgcagttcaacaccaacccgatgttccgggccattggtgagccgcgctggttctcgtttccggacgtgttgaaaagcgccgaaaaagttatctccaagcaagtcgcttcgcgtaccggctactacgcccgcaaccgcgtcgacctgttcttcggcaccggcagctttgccgacgagcaaaccgtcgaagtggtctgcgccaacggcgtggtcgagaagctggtggccaagcacatcatcatcgccaccggttcgcgcccgtatcgcccggccgatatcgatttccaccacccgcgtatctacgatagcgacaccatcctgagcctgggccacaccccgcgcaaactgatcatctacggcgccggcgtgattggctgtgaatacgcctcgatcttcagcggcctgggtgtgctggtggagctggtggataaccgcgaccagttgctgagcttcctcgactcggaaatttcccaggcgttgagctaccacttcagtaacaacaacatcaccgtgcgccataacgaagagtacgagcgcgtcgaaggcctggacaacggcgtgatcctgcacctcaagtccggcaagaagatcaaggccgacgccttgctgtggtgcaacggccgtaccggcaacaccgacaagctgggcatggaaaacatcggcgtcaaggtcaacagccgtggccagatcgaagtcgacgagaactaccgcacctgcgtgaccaacatctacggcgccggtgacgtgatcggctggccaagcctggccagtgctgcgcatgaccagggccgttcggcggcgggcagcattgtcgacaacggcagctggcgttatgtgaacgacgtgccgaccggcatctacacgattccggagatcagctcgatcggcaagaacgaacacgaactgaccaaggccaaggtgccttacgaagtcggcaaggcgttcttcaagagcatggcgcgtgcgcagatcgccggtgagccgcaaggcatgctgaagattctgttccaccgcgagaccctggaagtcctcggcgtgcattgcttcggctaccaggcctcggagatcgtgcacatcggccaggccatcatgaaccagccgggcgagcaaaataccctgaagtattttgtgaacaccacgttcaactacccgaccatggccgaagcctatcgggtcgcggcctacgacggcctcaaccggcttttttgagcggctccggccggtggcctgagccggccggggagaccgatttcagtaattctcgagggtggcagtggccaaaccgggaaagtctgtaatcaggctatctacgccgaagtcggcgagcctgcgcatcagcgcgggttcgttgaccgtccacacggacacgtgcaaaccctggcgctgggctttttccagacgctcgggggtgcacagcgtccagttcaatgccaggtattcacagccgtagttctgcgcgaccttcagcgggtcgagccaggcgtattcggcgaccaggccgcgcgacaggtccggggtgagttccaccgccgctttcaacacctcccgcgaacttgaggtcacggtgaccttgtccatcaggccatgacgcacagccatctcacgaattgccagcacggtcgtcgcggcgcgggtgcgcgatgcgcttttgacttccagttgccagtgatcgaagtcgcatttttcgaacagctcttccaggcgtgggatcgggcatggctgtacccaacccgggccgcctttgcgtgcgtccatcttcaccaggtcggccgccgagtactcgacgactttgccgcgccggtcggtggtgcgtttcagggtcgggtcgtggatcaccatcaactcgccgtccatggacaggtgcaaatccagttcgcagcggcgtacgccgtgcttgaggcattcctggaagctggtcagggtgttttccggtgcttcgcctttggcaccgcggtggccgtaaatcagggtcacagttgctcctttgcgccagatagcccggcggggtcatacgaaattcaggtgtcttgggcgtcgctctgttcccgcgccaggcgtcgttcctgggcttgtttctgcaggatgtagcgcgccagcaattggcgttgggcgtcggtcatggactcgaattccgtgcccacatcaaaaccgtcgcccttggcatcgcaatgcgtcacgcgggcacgcagcagcaagccgagcgcctggggcatcaataccagcttgaccgccaggtgcgtatcgggcgccagcggcgttgggtgctggaagtcgataccgccttcggacaggattaccggctgcggcgcaccgacctcatcaagtaggccgcgcgccatgatctggctgagcaggtccatgcgtttgttctggactttgaggaaggcggcgaggctgcgatccttctcgttgatctggcgcagcaggtgctgggcttcgaattcgctgaggtgcaattcgctgagtagattgaacagcggcgaatcatccagcaacacttccttgctcgccgcttcgggggcggagagggtgctgatttgaagtgcgatcatgtcgtcgatacggtagtattcgcggcgttcttcttcatctaatgtcgacatggcgaacccaaagtagcggtaatggtctgagtgtaaagctgcttacctgaccccgccaccgggacgtcttcttttcctccgaacaagccccgacatgttcagacctctcttcgtatttatcggcacgcgttatacccgtgcaaagcgtcgcaatcattttgtgtcgttcatttccttgacctcgattatcgggctcgccttgggcgtggtcgtgatgatcgtggtgctgtcggtgatgaacggcttcgatcatgagatgcgcacccgcgtgctgggcatggtgccccacgcgaccatcgagggcgattcgcccatcagcgactggccgagccttgccgacaaggtcaagcagaaccccaaggtggtggccgttgcgccgtttacccagatgcaggggctgctgaccaacgacggcaaagtgcagaaaatcctgctcaatggcatcgacccggcccaggaacgcaacgtctcgatcatcgacaagttcatgcttcagggcaaactcgacgacctggcgcccggcagtttcggcatcgtgatcggcgacaaggccgcggacaagctcggcgtgggcgtcggcgacaagctgaccttcgtcgcgccggaagtcaccgtgaccccggccggcatgttcccgcgcatgaagcgctttaccgtggtcggcaccttccacgtcggcgccggcgagatcgacggctacctcggcctgaccaacctcaccgacctggcccgcctgcatcgctggaagccggatcaggtgcagggcctgcgcctcaagttcagcgacctgttcgacgcgccgcgtactgcgtgggaaattgcccagcacctgggcgaatcccagtactacgcccgtgactggacccgcacccacggcaacctctaccaggccatccgcatggaaaaagccatgatcggcctgctgttgctgctgattgtcgccgtcgcggccttcaacatcatttccacgctggtgatggtggtgaacgacaagaagggcgatatcgccatcctgcgcaccttgggcgccacgccggggcagatcatggcgatcttcatggtgcagggcaccgtgatcggcgtggtcggcaccttgatcggcaccgcggtcggcatcctcgccgcgctgaatgtcagcgccgcgattgccgcgctggaaaaagtcatcggccacaagtttctcaacgccgacgtctacttcatcgactacttgccgtcccaggttcaggcccaggacgtgttgatggtgggcggcgctgcgttgctcctgagtttccttgccaccctgtatccagcctggcgcgcggcacgtacccagccagcacaggccttacgttatgagtgaatcgggcatgagtgaaaaagcaatcttgagctgccgcaacctgggcaaatcctacgaggaaggcccggagtccgtggtggtgctgtccaacctgcaacttgaacttcatcctggcgagcgcgtggcgatcgtcggcagttccggctccggcaaaagtaccttgctcaacctgttgggcggcctggatacgccgtcccagggcagcgtgtggctggcgggtgaagaactttcggccctcggtgagaaggcgcgtggccaactgcgtaaccggtcgttgggctttgtgtaccagttccaccacttgctgccggaattcaccgcgctggaaaacgtgtgcatgccgctgctgatcggcaaaaccgcgatcccggaagcgcgccagcgtgccaaggccttgctggaacgcgtcggcctcggccatcgcctggagcacaaaccggccgaactgtccggcggcgagcgccagcgtgtggccatcgcccgtgccctggtcaacaaccccggcctggtgatgctcgacgagcccaccggcaacctcgactcccacaccgcccagggcatcaaggacttgatgctggaactgagcacccagatgcgcaccgcgttcctggtggtcacccatgacatgagcatggcccgccagatggaccgtgtgctgcacctgcaggaaggtcacttggtcgccatctgacccgtttcaagcccggcgcctggcgctgggctttttcatttttttaaacggtgcccgcgaatgttcagaccgttatcgattttcatcggcacgcgctatacccgcgccaagcgccgcaaccgttttgtttcgtttatctcgatgacctcgatgatcggcctcgccctgggcgtgctggcgatgatcgtggtgctgtcggtgatgaacggctttcagcgtgagatgagctcgcgcatcctcggcatggtgccccacgccaccatcgttggcgtgaacccgattgacgactggcagcccgtggccgctgcggcgatgaagaacccgcaagtcaccgctgcagtgccgttcacgcagatggacggcatgttctcctacaagggcgcgatgcagccgatcgaaatcagcggcgtcgacccggcccaggaaggcaaggtctcgatcgtggcccagcacatcgtgcggggcaaactggaagacctgaaagccggcgaattcggcgtggtcatcggcgacatcaccgcccggcgcttccgcctgaacgtgggcgacaagctgaccctgatcgtgccggaaatcagtagcgcaccgggcggcattaccccacgcatgcagcgtttgaacgtagtcggtatcttcaaggttggcgccgaactggatggctcgatggccctgatcaacatggccgacgccgccgagatccagcattggcagccgaaccaggtgcaaagcgtgcgcctggcggtgaaagacctgtacgcagcgcccaaggtctcggcggatatcgccgccagcctgggcacggcctacaagccggacgactggacccacacccagggcagcctgttcagcgcgatgaagatggaaaaaaccatgatcggcctgctgttgctgatgatcgtcgccgtcgccgcgttcaacatcatcgccaccttgatcatggtggtgaacgacaagggcgctgacatcgcgatcctgcgcactatcggcgccacgccacggcagatcatggcgatcttcatggtgcagggcacggtaatcggcgttgtcggcaccctgatcggcggcgtgctgggcgtgatcgcggcgctgaacgtgagtgagctggtgggctggctggagcgcgtgagcgggcagcatatcttcagttcggacgtgtatttcgtcagcaacctgccttcggaactgcagggcggcgatgtgctgctgatttgcacggccgggtttgtgttgagctttttggcgacgatctacccggcgtatcgggcggcgaagattgagccggcgcatgccctcaggtattcctaaggtctgagaccgctatcgcaggcaagccagctcccacatttgaatgtgttcacagatcaaaatgtgggagcgggcttgcccgcgatagggccggcccagcttgcatcaagctccctttgatcgttcccacgctctgcgtgggaacgcctcactggacgctctgcgtccgctctgggtgacgcggagcgtcactggctgcattcccacgcggagcgtggggacgatcagcgatcaggcgggcaactcaatcacaaacctggtccacccctctccagattcacaataaatcctccctccatgcgcccgcacaatcgactgggtaatcgccaaccccagccccgcatgctcgctgctgccttcacggcgcgccgggtcggcccggtagaaccgatcaaacagtctgggtagcaacgccgccgggataccttccccggtgttttccactgaaagtttcacaccgtcttccagccgcacccgcacttcacctcctggcggggtaaacctcagcgcattatcgagcaaattcgacagcgcgcggcgcaacatgccgcgatcgcccgtcgtatgcgccgtgccctcgcgcaccaggctgacttgggcgtcttccgccagcaacgtgaagaactccagcagcgcgtccacatcattttccagcgccaaggcttcgcgcttgggcatcagcaaaccgtggtcggccttggccaggtacaacatgtcattcaccaactgcgccatccattgcagctcttcgaggttgctgtgcagcgcctcgcggtaatcctccagcgggcgcggctgggtgaggatcacctgggtgtgggtcagcaggttcgacagcggcgtgcgcagttcgtgggcaatgtcggcggagaaggccgagaggcgctggaacgcgtcgtccaggcgcccgagcatggcgttgaaggcctgggccagttcggccagttccaccggcatgtgctgttgcggcaggcgctgggtcagggagttcgcggatacgctggcggccacttcgcccatgcgccgcaacggccgcaagccactgcgcgcagcccaggcgccgagcagtgcggtggccagggccgacaagccgacggtcagccagatcaaatgctgcatgcgttgcaggaagtgttggtgatgggtgatgtcgagcatcagcgtcaactggggcgagccgggttggccttcgaccaacggcgcgttgtacacgcggtagtcggtgccggcgttttgcaggctgtgcaggcccggcgcttcgggcaggcttacgccgggcgctccatcaaaccagcgctggccgttggcgctgatgcgcagcgccaattcgggttggcgattgagctcggcgcgcaattgagcttcacgttgcgcgaacagttgcggcgagtcgacaccctgcaacgtgctgcgcagcgccaccagttggccgtcgagttgctgctggtccagctcgataaagtgcgcctcgctggcatggttgaacagcacgccggcaagcagcgaaaccaccgccgtgcacgcggcaaacaatagcgccagacggctggccagagacaggcgcttgatcaattgaggcgttcctccagcacataacccatgccgcgcacggtgtggatcagcttgttggggaagttgtcgtcgactttgaggcgcaaacggcggatcgccacttcgatgatgttggtgtcactgtcgaaattcatgtcccacacttgtgaggcgatcagtgacttgggcagcacctcgccctggcggcgcaggagcagttcgagcagggaaaactccttggcggtgaggtcgatgcgctggccgtcgcgttcgacgcggcggcggatcaggtccaggcgcaggtcggccagttgcagcgcggtttcttgcggtgcgctgctgccacggcgcaacaggctgcgcacccgggccaacagttcggaaaaggcgaagggcttgaccaggtaatcgtcggcgcccagttccaggccgtgtacgcgatcttccacggcatcacgggcggtgaggaacagcaccgggatgtccaggccggcgctgcgcacggcttgcaggatttgccagccgtcgcggccgggcagcatcacgtcgaggatcagcaggtcgtaatcaccggtcagcgccaaatgctgcccggtggtgccgtcggccaccaattcggtggtaaagcccgcctcggtcaggccctggcgcaggtaatggccggttttcggttggtcttcgacgatcagcagtttcatgggcgactcttggcagcggggagcaacgggctttataccgtgggcgccggggcaggggcgcaacctgacaaagttgtaatctagcagtcagctggctggcagcggcgccatcttagagtgctggccaagctgttcacagacttttggagaatcgacatggcgttgcgtacacctctgatattggcgggttgcctgttggcgctgagccttgatgcgctggctgacgcggcccacacgttcgccttcggccagccggcagcggccgataaggccacgcgcaccgtggaagtggtgctgcaggacatttccttttcgcccaagtcgttggacgtaaaggccggtgagacggtgcgctttgtgttggtcaacaagggccagttgctgcacgagttcaacctgggcgatgcggcgatgcacgccgaacaccagaaagaaatgctcaagatgcaagccagcggcatgctcaccgcaaccggcatgggcaacatggaccacagcgccatgggccatggcgcgatgaagcatgatgaccccaacagcgtattggtcgagcccggcaagactgccgagttgacctggaccttcgccaaggccacgggccttgagtttgcctgcaatattccggggcattatcaggcgggcatggttggcaagctgaccgttgagtgaggcgattcttaagggcgggggcaaaggctggtagactggcgcggtttatttagccaggtttccgccatgcatcccgcagccgaacattcgccgctgggcaagtccagtgaatacatctccacctacacgccatcgttgctgttcccgatccctcgcgccgccaagtgggccgagctgggcctgagcgccgaaaccctgccttacaagggtgtggatttctggaactgcttcgaactgtcctggctgctgccgtcgggcaagccagtggtggccatcggtgagttcagcatcccggccgactcgccgaacatcatcgagtccaagtccttcaagctctacctcaactcgctgaaccagaccgcgtttgccgacacggcaagcctggaagcgacgttgcgcaccgacctcagcgccgctgccggcaagccggtgagcgtgcgcatccgcagcctcgccgaggttgaagccgaaggcgtgcaggccctgccgggcgtgtgcattgacgacctggatatcagcgtcagcaactacgaacacccgcgcccggaactgctgcgctgcgatgactcgcgcattgtcgaggagagcgtgcacagccacttgctcaaatccaactgcccggtcaccagccagccggattggggcagcgtggcggtggagtaccggggttcggcgctggatcacgccagcctgctggaatacctggtgagctttcgccagcactcggacttccatgaacagtgtgtggagcggatatttcttgacctgcaacgtttgctcaagcctgagaaattgacggtgtatgcgcggtatgtgcgccggggtgggttggatatcaacccgtatcgcagcactgaggctgtgcagttccagaatctgcgcctggcccggcagtagccttcacgccaaacaactgtgggagcgggcttgcctgcgatagcggtctttcagtcatacatcttgtgactgatacaccgtcatcgcaggcaagccagctcccacattttgtttctgtgttgggcttgggttcggttagatcccgatattgcccaaggtcaccacaatattgcgcaaggtcccggcaatgcctgggtggtccagttcgaagcgttcaaccgccaggttcacgccatcggcaatgctggggtcttggatcgcgccttccaagggctcttgaacctcaagttcggcaatcaatgactccagttcgtcgcgtttttccgcagacatctccgggttctgaatcaattgctcgcgcaattctctgacttggtctttcagctgttcgcgggcaggcatgacgttcttccttttatcgataggcactggcatagaccgcggcacgccgggaaaggtctacgggctgacctgtagattaatccaccggcagcctcagtgcatgatctctatcagggcttctcgcctttgagccggcgcaggccgatgtccgccaggcacgtacccagctcgccaaggtgatcgatcaccgaatgcacgcccagcccatacagcgccaccgtggctttgccgcgtttgtgctcgcgttgctgctcggtcagcgccagccattgttcgggcgccaggccgcacagtgaaccgcaggaggccaggccaatcgtccacaacccggcattcaggcccgcttgcagcaaacgcggctcgccgctgaccagcacgcagccttccaggcgttcgatgttcaattccatcaaggcttgccagcacgcatgcggggccggccagcggatggaggagggcgacgctgccttgacccagtcgggcagcacggcggccagcggggtggtcactgagggcggcaactcgtccagccaggcgcaaggcacgccttggtccttgaggctgcgcaggattttcagcgcgcccggcgtggcgtgggagtcgggggagggcgaatcggtgcgcgcctgggaaccaaaatccaccaggcagccacttaggccaaacagcacggcagttaaagagggggcgctggcgacggcaatctcggcgtgaggcatttcgacatccctgaaataaccacgacgctaacggggcgggatgacaagcaaatgacatagacgctaattgtaggaattttgtgcattttacgtatgtcgattccccatagctgcctaattcaacacttccgtcatatactgacgatcttattcagggcatagcgcccatgacagaccattcaaggagccaaagctatgcgctggagccagtacttcgctcagctatctgtgtgtgccactattctattggcgccgttcgccgcccaggcggcgtcggaagacgacccatgggaaagcgtcaaccgcccaatcttcaccttcaacgacaccgttgatacctacgcactcaagcccatcgcccagggctatcagtttgtcactccgcaatttgtgcaaacgggcatccacaacttcttccgcaacatcggcgatgtcggcaacctggccaacaacgtgctgcaactcaagccgcacgctgccggcgtggacaccgcccgtttgttgatgaacaccaccttcggcgtgctgggctttgtggatgtcggcaccaaaatggggctgcaacgcagcgatgaagacttcggccagaccctcggctactggggcgtcggcagtggtccttacgtgatgctgccattgctcggcccaagcaccctgcgtgatgcgccgtccaaatacgtcgacagctacacccaaccgtaccgctacatgaacgacatcggctggcgtaacagcaccttcggcctgaacatcgtcgatacccgtgccagcttgctcgacagcgagaagctgatcaccggcgacaagtacacctttatccgtaacgcttacctgcagaaccgcgagttcaaggtcaaggacggcaaggttgtcgacgatttttaagctgtgatgttttgaaatgaaaaaggcgaccccagtggtcgcctttttttgtgcgcgaaattcagtgcattttcaggatcttgaggcccaagtgctgatcttcacccttggccctggtccataccacttcggtatctgcctccagtcccgaaagggaggcatgctccgagtcgatgcgcacggtcagccggtcgcccaccttaaactgacgcggcgcctgcacttgcatgccagagctggataggtccacgcagaccccggcaatctcctgcccggcgtggatcaacgacacatcggcatccactcgcatgcggatgaaatcgcgtttttcggcgtagtcgcgctcgtgttcgctcacgggttccatccttactttgtgttgtggtcgtgggtgttcttataactcccggtgatttgcggtgtaaagacgcccggcgaccatcggcatgagcttgaaacccctgacggatgggagtaccgtctgcgccttagaagggcacctctgctttacctttgtgcatgggcaaaatcccagtgctttgtaggacagagtggctagaaagcgaatccagtacgtgagcccggccattgccgagccgcctacgccaacctaattctggcgccgtttgcccacatgcaaaaaaccagtgccacgctgctgataatcgatgacgacgaagtagtgcgcgcgagcctcgcggcctatttggaagacagtggcttcagcgtcctgcaggccagcaatggccaacagggtctccaggtgttcgagcgcgacaagcccgacctcgtgatctgcgacctgcgcatgccccaaatgggcggcctcgagctgattcgccaggtgaccgagcttgcgccgcagacgccggtgattgtcgtgtccggtgccggcgtgatgaacgacgccgtcgaggccttgcgcctgggcgccgccgactacctgatcaagcccctggaagacctggccgtgctggagcactcggtgcgccgcgcactcgaccgtgcccgcctgctgctggaaaaccagcgctaccgcgaaaagctcgaaaccgccaaccgcgaactcgaagccagcctcaacctgctccaggaagaccagaacgccggtcgccaggtgcagatgaacatgttgccagtgagcccctggaccatcgatgagttcaagttcgcgcaccagatcatcccgtcgttgtacctgtcgggtgattttgtcgactatttccgcgtcgacgagcgccgcgtggcgttctacctggccgacgtctccggccacggagcttcctctgcttttgtcaccgtgttgttgaagttcatgaccacacggctgttgttcgaatccaagcgcaatggcaccttgccggagttcaccccctccgaagtgctgggccacatcaaccgaggcctgatcagctgtaagctgggcaagcacgtgacgatggtcggcggcgtgattgatgaagaaacaggtctgttgacctacagcatcggcggtcacctgccgatgccggttttatacactccagacagtgtgcgttacctggaagggcgtggtttgccggtgggcttgttcaatgaagccacctacgaagaccacatcctggaactgccgccgaccttcagcctgacgctgatgtccgacggcatcctggaccttcttccagagcctacactcaaagagaaagaagccgccttgccccaaaaggtcaagtcggcgggcggcagcctggatggcctgcggcaggtttttggattggccacgctaggggagatgccggatgatatcgccctattggtgttgagcaggaatctttgatgagtaccggaagaatccaattcgccgagcaagacgggaccttcgtcctgaagtttgtcggtgaagtgcgcctgaccttgtgttcggcgctggatgcaacgattgagcggattttcacagccctgaatttctcggcgatcgtgatcgatctgaccgaaacccgcagcatcgacagcaccaccctgggcctgctggccaagttgtccattctgtctcggcagaaggtcggcctgttgccgactgtggtcaccacccacgaagacatcacccgtctgctgcagtccatgggcttcgaccaggtgttcaacatcgttgaccgcccgatcccgtgcccggaatgcctgaccgacctgccgtcgcaagaccagtccgaagaagtggtacgggtcaaggtgctggaagcgcacaagatcctgatgggcttgaatgagtccaaccgcgaagccttccacgacctcgtgaacgccctggaacgccactaagcccccgctgctgagaacaacacagtcaaatgtgggagctggcttgcctgcgatagcggtgtgtcagctacctattcatttctgacccaccgctatcgcaggcaagccagctcccacagtggaactgcgttcggtttgaggttggcgaaggacacaaaaaaagggcggcaccctcacaggtgccgccctttttgttgccgactaccttacaacttggcagtcaacaacgcctccagcttctcctggtcccgagcaaactgacgaatcccctcggccagcttctcagtcgccatcgcatcctcgttggactcccaacggaactgcgcttcagtcaaatgcacccgcgcctcaccggcatggcctggcgccaacttgcgctccagcttgccttcatccgccgccagcttctccagcaggtccgggctgatggtcaggcgatcacagccggccagttcttcgatctggctcagattacggaagctcgcgcccattaccacagtcttgtagccattggccttgtagtagttgtagatgcgcgtcaccgactgcacgcccggatcatccgagccggtgtagtcgttgccgttggccttcttgtaccagtcgtagatacggcccacgaacggcgaaatcaggaacacacctgcctcggcgcaggccacggcctgggcaaacgagaacagcagcgtcaggttggtttgaatgccttctttttccagcttctctgccgcgcggatgccttcccaggtggaggcgatcttgatcagcacgcggtcacggctgacgccggctttgtcgtacaggtcgatcagacggtgcgcacgcttgagaatggccgcttcgtcgaacgacagacgggcatccacctcagtggaaatacggcccggcactactttaagaatctcttgacctaccgccaccgcaaaacggtcgctggccaggcccacgtcgccgttgcagtccttcacgcactcatccagcagcttggcatagcctgcgatcgaagcggccttgagcagcagggaaggattggtagtggcgtcttgcggcttaagcttggcgagggtagaaaaatcgccggtatcggctacgacggtggtgaattgcttgagttgttccagcttggaagtcatgggcgtgctctgtcctgtgggtctgatgacattacccgagcgccgacaagcgctcaagggcgcaaatgcgttcgatcgtttgcgagggcaacaacctgaaaacagccgtttgaatcaccggctgcactgctaactaggagaccaaaaccgccgacaggttcaacccaactgcccgatgaccaccccggtcaaaatgtggaagctggcttgcctgcgatggcgacggcacaggcactgccatatgtctgatgtactcatctcaaaatgtgggagctggcttgcctgcgatggcggcggcaaagacaccaccagcctccagacatacatcaatccaactgtgggagcgggcttgctcgcgaaagcggcctatcagccagcaactaaacccactgacacccaacccctcaccgcccctccaacaactccccagcctgatccaacaacgccaacggatcactcgccttatgaatatccaccgacaacaactgccgaaacttacgcgcccccggaaacccggtccccaaccccaacacatgccgcgtaatgtgatgcatcaccccaccactggccaaatgctcggcaatataaggccgcaactgcgccaacgcctgcgcccgactaatcaccggcgccgcactgccaaacaactgttgatccacttccgccagcaaatacggattgtgataagcctcccggcccaacatcaccccatcaaacacctgcaaatgcgcctggcactgctccagcgtcttaatcccaccgttcagcacaatctccaactcggggaaatcctgcttcaactgcgccgccacgtcatagcgcaacggcggaatgtcgcgattctccttcggcgacaacccctccagaatcgcaatccgcgcatgcaccgtaaaactggtgcaccccgcgtccttcaccgtcccgacgaaatcacacaactcggcataactgtcacgcccattgatcccgatccgatgcttcaccgtcaccggaatcgacaccgcatcccgcatcgccttcacgcaatccgccaccagggcagggtgcgccatcagaatcgcgccgatcatattgttctgcacccgatcactcgggcagccgacgttcaagttcacctcatcgtaaccggcagcctcagccatacgagcgcacgcggccaggtcagcgggaacactgccgcccagctggagtgcaagcggatgctcggcctcgttatgacgcaggaagcggtcgtggtcgccatgcaggatcgcgccggtggtgaccatctcggtatagagcagggcgtgcttggagagcaggcgcagaaagaaccggcagtgacggtcggtccagtccatcatcggggcgacggagaagcggcgggagaggggagcggtttgtaggggcattgggggtctgagtcagcggggtgaatggggtgcagtttatcagggatgggtcttgggggtgggaggcgcgtgttttgcgaccttcaccacttcgagcgcggacgttgccgtgtgtggaatatgccaagaatttgtaggcgatcactgcgtacccgatacggaatcaggtaagaccaattgggtactgcccattcccgggtgtgtttgacccgaccgtcacggcccatggaggggaactgagctagcttgtcgacgctggcgaagatggcgtcggagaagtcgtcagctgcctttgggttttcgagagcaatatagtttgcttcgtcttccagatttttgagtgctttttcaagccactcaacctgcattccggctccagcgcctagcacgcatcgctgccacttggtcttcggtggcgaatttgccttggtcggcttcttttactgccagctcgatctgagcggtcagcgttttttcgtgttcgatgtagtcgcggaggacgtccatcgctaggtaggtcgcagtctggccgttggttttggccaggtcggcgagagagttggacaggtcttccggtaggttcagggatatcccagtcatggcggcctcgagggtggacggttgtggggcatcttacaccgtggagcgctggcttgaatcagcaggtcgtcgctgtgtgtatccggaagtgatttgttccatctcactgccggagcatcgtggtctgaccccgatatgaatgtatggattgtttggcaaagctcaggcgaaggaaatgctcaaactcaagcgccgggcagccaaagtcggtagccactaaagagcacgataatgttcgttttgatactgtcgtgctggagagattcagggcttttgggccgggttggtaagcacgcaagaacgccgctttggccgattgtctcaagacgcacacgccagatgaactgaaggcctaagtcgataagcctcggatgacgcggcttattgctgtcctgtgactagctttttatcagcgattgtataaataaatctgtcccctttttgcgaagggccagggagttttcgcagcttgttcgtgtattcacccaccggcaagaaggacggaattcagctgatcccggtcagtgaggtcgcggccaaggatgagttcaactcgatcaaaaacaagacccgtgacgatgttctggccagcttgcgcattccgccacagtcgatggggatcgttccgcaaaatgctgggggcattgggtcgatcagggaagcggcgcagatctatgcggcgaatgagatagagcctatgcaggcgcgaatggagcagttgaacgaatggctcggtgatgaggtgattaaatttaaagaatatgatctttgtcttgttggtagagtgggatctcataattgaatctgactgcgattggagttatcgcagtcagaactattgtttaagctaaggctttagccattccttcatagtgagttttgtctagtcgttcaatttctctgaatatatctctgacgatatattcggattctgacgctatattgtctgctgcgctatcatcaaattcaataatctggttgtgtgagtatttgttgataaagcgatatattctttcgcacgttacttcgtcagtaatggcctggtccatcaaacctctaaagtcgcctctgccgtgagggtatttaaatgtaaggaatgcttctaagagctttcgtgacatattggctactgcgaatgctgcttccagtgcgagagtttcctgatctatgtattgcttaagcgttgcatacaggaaatggtattctgagttgaatcctgtcaagctttttggtgctatgtttatagcggattttctacggtctgtgagggatgcctctatgttgtaaaagcgtgaacgtattatggggtttttattctcgtcctttttattgttttttcctgctagccagtcgcgcgctagtttgaagtagttaaagctatgagtgaggatgaaaagttgctgtgcagtttggcagtgagttctaaggaaagaatgggcattaaataaattattagagtcgaagctagagacaggatcatcaaaaatcacaatggatttcgaaatttctctatcgttttcagaaagttttgtaaggaagtaaattaatcctattgcatttttttcaccctcacttaagttttttgcttggctattctccgggtgcctgagtatctggtagcctttttgaatggtatcaaactttaatgatatttggtttcttccgagaaatttatgaagtagtctgttgaattcatcagcgccaatactttcgttattaagttttttttcaagctctgtaatttcattaccaatctcctcggtttttttgccaaggtcaatgattggctgtgtgtgtgaatcataagattgttggttttttatgaagtcgctatcgtttagttcttctgttaggaaatgtagttctaaagaagatttagcagagctaatttgctcttggaagtgctgcgcttttttattatgctgcgagattatgctttcaattttatcgcatatttcatcatggtcgtgaaataaagatgagggtagaggggcggcagagcctgagctgataaacgggttgtgaattttctcatctaaggaggttttccagtcggctaatcgtttgttgattgtaatatttatatgttccagttctctttcaagttgagggagttgtgcgtagtattcttcatataaatctatttgggagacctgttttaactgtgggatgatcattaggtctatcatctggtgtgcattttcgagcttggatttgaatgttctaaatgcttcgttaaagtggttgttgagagcttccagtcgctctttagacagatttccttcgcaaaactcgcagttacttagattttcatggatttgaaggccgagttcaacccagctttgaattcgtgcgttctcaagcaagtggctaattttagcggatgtaatggtttctttgaatagtgcatttagttgtgttgatgtttttaagtggctaatgctgcttagcctgttaatggagtgtgttattgctggtttgaattttggggatgttgctttttggtttgattcaaaatctgatggagataaaagataaattttcgcctttaattcgtttgaatggctgcttatttttgtttgtacttttgaacggttgtagctgacgaagtaattgtctgaactatctagtatttgaaagcggtttttgatgttttttgctatagcgcttaatatcgtctgattggattctgataggatcttttgcgcttcagttgctttttttaattctgcttctctgtcttttaattcgctttgcttttcttttagttgtttcttttcttcgattttatcttcggaaattaaaagtatacttttgactatgctatcccagtttatattttctctaatgaagtttgagttgaatacgcaaaggtcaagcggcttggaggagatattgttgttggcgattatccccatagatgtgtttacgctgagcactcctttgggaaagtcctctatgatttgccccttggcgatgcactcaaatactttggaaatagttgacttaccgctcccgttccaaccataaattagattgtattgagtgaaatcttcaagtgaagcaggctttgtatagtcttcaaatattccaaaatttgtgagttttgctatcgaagttatcattggacttccttttctatatttattatgaagtgttggctacatttttgttgtcgcttttcctacatttacgcaagaggctaacgacgttcagattcagaatttggtccgtgccaaaaccactgacactagccttcgatcctcggcagagcctcaaacacccagcatttgacggtgccgcgctcaatagcgctatggactgcgtgattatggttaatgtaacgaggagagaaactgttcttcatagccttggtcatcgcatcatctaggttgatggtgatgccgtgtactttgaactgatccgcaagctcctctaggcgaaacgcaagcagattggattttattgcgtggttgtaccgtactcctttgccatccaaatgcctcagtgctgcccagaagtcggcaagaatatccgcctctaagggctcggcaatacctatgttgcccacgtcagggacgctgaggcccagttttgctgacagctgggtgatctcttcttgaatggatgcgcgtatccctcggttgcgggtgcgctgcagttctttaagaagtgcgatgcgatgtcgagagatggctatctgctgggtaatgctcggtaacccaatgggagcgttgctcctcttgctccagtggtcccataaggcatcgtcgcattcttcctggtagcggatgatcttgcctcgcagctcagacttcaccttgttttggctgattgagtatagccaagccggtagcttgcgaaggggaaggcaggtcatcgcgtattgtttgccatcacctccagttgtggtgatttccaccataactgaactgaacctctccgtaactttcgagtgttggcttttccagtccagccccatgttgattacgattggctttatcgccacgagcggctcattgtctctcccgaccaggacaacggtgtcctcgtagaacgggacgggtatcagttgctgtgctgtatgcatgggaagtctccctgccactatcgaagatgcctgatagtagcggcccttagtggcgattcacaacgtctctctttccaacaaatcttacctctctgcacagctctaactatctacggcatcgccagggatggctacgatccaggccgattaactagtgtttgcagatgcgcactgttttggtgcgagataatctcatcgggattagttcgaccttggcgcccgccgtcgttccctcacctcgcctgcgggctaatgggtcgatttttctgcggacctgcggaccgctctcggcggctcaggctgggcgcttgcttggagtttgggaggtggcagaatccggaactctgcgagggtggatggtttgcggaacgcctatcagcacgcacggacggttgaattctgtaggtgcctcgggaaaaaggttagtttttttgagggggcgtgattggattggaaggcccgtatttgttgggcttgagacctaattttgatgggttcggttgggttaagtcaaaggtcagcagttcataactagctgtttttaaaggaattaatgtattgaatgtttaacgctaataaaggttaggaaataatcagatctaaccgaaaagctaaccttgccaaactttcgaaaagccttaataggtaaggctttcagggcacccagcaaaaaactaaccctcctaacctcatgcccgtgggtcatcatgagagcgcgaaagatggctaggtcgaggcactttttttgaggctgcgtacacattgcgcagcactcacaacctttacgttcatgcgcccgcactctcacctgcacggcgtcaaatggttgccgttggcaacggttgctgggattgaagcgacattcactaacgacaagcgctatagcgagaccaggcgtatgggggtcatggcgtcatcgcactaagcttatccaggtcggcgcgcagctcgtacagcgggaaatgctcacctcgcttgccgatcaggcatttatccctatgcgccgggaagggttggccaccgccgccgccatggaacgtctgcctggcgccgctgtttcgacacttcaaaaaagttgtgcccagatcccagtcacgggtccactcctccagggcggcagtaacggcatagttcacgtcgttacagtcacgtaagctcatcacaaccacccatttgcacggccattgtccaggcgctggctcatggcgctcatttgctcggcagttaaagcacctgccaccatcagcccccataggaaaccgcgtaactggttttgcgtgcgcagcatgccagcgtgattcaaggcttcaaatcgaaagtcttctacctggggccgcaggtatggcaacgcggctgcggggtcggccagagcgataagatcgtcaaaatacagattggcggcgtcaatagcggcctggtccttcagcggctcgtacacagataattccttttcgagtgagtggcaggtgttacgtaaaaccactctagggggtgttggtatgccagtccagggggttatggtttccgcttgcaaacaaaaaggcccccgcacctgatcaaagtgtggggccttttttacataatcggcgttctattcacttgtcgtcagaaactctgacctactcacagcgacgaatgaacgtactcaggctaagccttagtcatcgatatcgaaataatcatcgcctgcggcatggttattagcttgcatgaattctgttaatgcgtcatctccaaactctatgcggagcgcctctctggccagcccaatgtgttggaaatagaaatctaagccttcatccgctgcgtacttagcatcttcctccataatcgagaccaagtgcttttccaacagatcttgtaattgacccgcagtttttattccgaaatgttctagttcaaccaagagctcgtcaaaatcaccctcggtggtccggtttgcagaaggaaaagtcttaacgagaatcgagtccaatatttcgacgttgagcggagacgttgaggtttcattttgaagatcgtcagcgagataaattagacgatcctccagcaaccgatcgaactcgatatctaccgtttcgagaagcgcggaagctcgattgattgagcgccggagtgggagagggacgcttgcctcacgcttatattgaagtttgtgtgatgctgcggcccaaatatgttgggccattgtcctaacctggatttcgacgcgtatcccaccaaggtcgctccagctagggatgcttagccatttagctggagcttcaatgatgtaatgttgggactggtagccgaattgagtgtctgacaatcttagtgaagtatcttcggcacttttgatgagcagcgaattacgtagcaattcgtctacagctttgagatctctgcgaaagagcaagattagacgtagtccaacgagatcatctaactcttctattttttcaagtaacaatgattttcgcaccaatttctcctcgatagaggaccactctttcacccgagcctctattggaacacctaatgtcacaccttttgagataagtaagtgctccagttccgaggaaagcgctgcttttaaacgcttcgctcgtggttcgatatttgagtaacttattttcagttctggttgattcatccttaatctccacactttttgggcaacgcttttttaaaggaagggaacaacttgaacgtgtgcgagtgacttaactctgagtagtcatctgtcgactccagcagtgctggagtcgagatggtcatccattcagaaatttcttaaggagcacttactttctcgaattgtacaactgatagagtacttttccagaaacgtctccagtccttttcgtgcaagcgacatattaatgtttgggccgatggtgatttctttgatccatgagtgttggatagggtattcaaaatagggaattattacgccgcctctagttcgaaagtttacgtcatgactcttttctaaagttgactgaataattagtctggtttcttgctcgtcgtaaaattctttacgttttacagcgcagccatggaaaaacagtttattagctagttttagcatggctctttcaatgttaatatgctcagtattggtagggctaataatttcgtccattaacaggatttcatttattttggtttcgtggtagtcaacctcttcaagccggctcactacttttttctcacgttctatattttcgtctattagtactttttgtgaatcaaactctattgagtagcccgagtttttagggcagtaggacatccattgtcgcaaattatcgccagcctttgcgaatgaaactatataagtatttcttttcgtaaggttattttgaacgagctctgggatcttatcgtaaaatactctaattgcgctctggagtggttcattcgaagtttcgaaagtgctcatatgagcgcaccttcttcgaattagatcgattcctgcgagcatctcttgagaatcatttaaaaagcctatgtcggtagcccatagcgctcgcctctgtatgatgcctattaggccattaacatctgtgtagtggtgaagatccatttagtggcctttgtctagcacgtgtaaatattagcagatagggcagtttgccatcatgcaaggctattttctacactaaggctgaaacaacataggagagttcgtttatacagtgtgacagtggcatctggatgagcgattcgacgggatttgatgagccgaatttttgcgtcttttccatctccacttatcggcagcttttggctgttatctgcctgatgcctaatgcggttagtcagggtggaggtacgggtcgaaaggagcccaatggtacataattggtacgagctgaggcttggtcatctgtaggcctttgttataggggctctttggtttagtacttccaatccatcatcggaacgactcacaaggtatggagtgatctcgggaactggctaaaatcaactgagaaacttcccacacttttctcagcttgcccctcagacctcccctagctaacctcccccagccgctgccaatccagcggccggatgtggaagtccgaccaagctgaaggcgttcaatcgcccataaacacctaccgacgtttttttacgtctgtatgattgcttatggcggctgtgcgcggggcacttcggtgcgccgggtcctttagccctggtcttccacacctgcgtacagctgccaccctcatgtggaagtgagtttggtagttcctggaattctaaaggagcttcgccatgtacaaggtcacacctaatccgccttatgccccaaacgttgaacccactgacgccaagcttcatgctgccgctcaacgtgctatccatcactacctgccgccgtctgaagaccaagatcccgcagagcaaccacccggcaacctattctccgtcagccccaacattgacaccgaaaccctcctagccaacgccgccgaaaacctcgattccgccaatcaaatggccgccaccctggccttcgacctcgaagacccgcaccgagccatcatcctcggcatccaacaactcatcgaactaagcgcgctactcgtcagccgagcccaggagcaagtcgcgcccgccgccaacccagccacagcctgacaccaaccctgccgccttacccaaggcggcaacctgaacccatgctgtcaccgcgcaaaatttcataattcccagcgcctttgaggtctacgatcctcttcaagagaggccccccgcacctccagcccatagggaactgaaaacatgatctcgaacctggttaaagtcgcgctgattgctggcaccttgctgttgggcgcttgttcgacgggttcgtcgggcgggagcagtgacccttgtttttcaggcggatgtcaggcgtttggggaccatagcccgagcaaggctgccaagatgaattttggcgggagtgcgctggggagtagttatggggagtatgggtcggggttgttgcatgatgattgatgaggtggtggggcagtcatttgttggttgactgacccaccgctatcgcgggcaagcccgctcccacattagggtttccacattgaggtgtggtggtgtgggaaatgtcagtggccgcctttcatgcggcgggcgatcaggtagatgcctaggccgacgagcgctgtggcggcgccgatgtagccggtgctggtccagccgtaacccgccgtgatcgccatcccgccaaaccacggccccagcgcgtttgccaggttgaatgccgcgtggttggacgctgccgccaggcttggggcttcgtgggcgatgtccatcaggcggatttgcagcggtgcggccaacgccaccatggtgccgaccaggcccatgctcagcagcacgccccacagcgacgatgccgcgaaggggaagaacagcaacacggctatcgaccacaccaatatcaagcccacggcgcgaaattgcatgcggtcaaacagtttgccgccggcgatgttgccgatgatgccgccgacgccaaacgcggcgaggccgaaggggatccactggggggagactttggtcacttcaagcatggtcggggcgaggtagctgaacacgcagaacatgccggcaaagccaatcgcgccgatggacagggccatccacacttggggtttggtgaaggcgcgcagttctttgcgcgggtcgctgcgcggttcgtcgtggcggtcgggtacgaattgccagacgagggcgatggtgcatacggcgatggcgctgaccagggcgaacgccgagcgccagcccaggtgttggcccaggaaagtggcgatggggttgccgagcagcatggccagggtgaggcccatcatcacgcgggccacggcgccggcgcgtttgtcgttgggcaccatgctggaggcgacgacggcggcgatgccgaagtaggcgccgtggggcaggccgctgataaagcggaaggccaccagcgagccgaaggtcggggtgaaggcggtggcgaggttgcccagggcgtacaggcccatcagcaataagagcatgtgtttgcgcagtagcttggcgccgaggatggccagcagtggcgcgccgaccatgacgccgagggcgtaggcgctgatggcgtggccgacttggggttcgctcaagttcaaattgtgggcgatgtcgggcatcaagcccatgatggcgaattcgccggtgccgatcgcgaaggcgcccacggccatggcagcttccattttggcggcgctgcgcgcgggcagtacgtgcccgggtgtttgctggatagtcatgggtaactctgtttggaaggattgcacgaaggactgccgccgatgctacgcaagcaacggcgaaggtgtctagaacagccgtttgcagcagagttcagtttcatccaagcgcctgtgacgccacgtcgcgcctgtcaggcttgacacctacgcgttaaaacccgcgatttagagctgtcaattggccaaaggacgcataaacgccgtttagcgtgatattctgcgcgccgtcttggtctagtctttccccggtgcgtacacccgtatacgtcccggcggttggctgtcgcccaggtagctgaagccaataatgataaaaagtcagcgcagaagggacataaacagtgaggtcgatacgtcggccttgtgtgcccaccctgcggctctcatgtgaatgtgcaaaccccgcggcgcgctgcctggcgcggcgtgattgagggttgcccatgatcaggggcggtggggcggatggcgttttatcataggtgctactgatgtttaaaaaagtaaacactgccctgctggggctggctttgtcgatggggatcacgtccgttcaggcggaagaggcaaagaaagtcgatgtgctgctgatcggcggcggcatcatgagtgcgaccctgggtgtttggctcaacgagctgcagccggactggtcgatggagatggtcgagcgtcttgatggcgtggccgaagaaagctccaacggctggaacaacgccggtaccggtcactcggccctggctgagctgaactacaccccggaagacaagaacggcaacgttgagatcccgaaagcggtcgagatcaacgaagcgttccagatctcccgtcagttctggtcctggcaggtccagcagggcgtgctgaagaacccgcgttcgttcatcaactccacaccgcacatgagctttgtgtggggcgatgacaacatcaagttcctgaaaaaacgctacgaagccctgcaggcgagcccgctgttcgccggcatgcagtactccgaagacccggcgcaaatcgccaagtgggttccgctgatgatggaagggcgtgacccgaaccagaaaatcgcggccacttggaccccgatcggcaccgacgtgaacttcggcgagatcacccgccagttcgttgcccacctgcaaaccacgccgaagtttgacttgaaactgtcgagcgaagtgcaggacatcaccaagaacgccgacggttcgtggcgtgtgagctacaaaaacctcaaagacggcaccaagactgaaaccgacgccaagttcgtgttcatcggcgccggcggcggtgccctgcacctgctgcagaagtcgggcattcctgaagccaaggaatacgcaggcttcccggttggcggttcgttcctggtgaccgataacccggccattgcagagcagcacctggccaaggcctacggtaaggcttcggttggcgcgccaccgatgtcggttccgcacctggacacccgcgtgctggatggcaagcgtgtaatcctgtttggcccattcgcgaccttctcgaccaagttcctcaaagaaggctcgtacctggacctgctgaccagcaccaccacccacaacatctggccaatgaccaaagtaggtattcgtgaatacccactggtcgagtaccttgccggccaactgatgctgtcggatgacgaccgctacaacgcgctgaaagagtacttcccgaacgccaagaaagaagactggcgcctgtggcaagccggtcagcgtgtgcagatcatcaagcgtgacgaagagcagggcggcgtcctgaaactcggcaccgaagtggtcagctccgccgacaacaccatcgcaggcctgttgggtgcatcgccaggcgcgtccaccgcggctccgatcatgctgaccgtgctgcaaaaagtgttcaaggacaaggtggcgacccctgagtggcaagccaagctgcaccagatcgtaccgagctacggcaccaagctgaacgacagccctgaagctgttgccaaggaatgggcctacaccgccggtatcctgcaactgacgccgccgcctgcgattccgcagttgaacgcgccaaaggcaaaccaggccaccgaggctgccaagcctgcggctgagccgagcaagccggcgtctgacctggcgctgtaagccaaaggttaaaccgctgtaagaagcccgctgaaccggtaacggtcagcgggcttttttgtgcccagtgtttacaccttgaagtgcctgacttgctcatgcaggtgcaaggccagtgcattgccggaatcgcacagcaggtacagccgccatcctcgcggcactgcagcccttgatgacggcggcgttatcgaccggcagcagcgccgagcgcagcggtggttggcagtgagccgggctgatcatcagctttgctggggtctgtatcgtgatcgccgggcaatacagcaatagcggccaaagcgtcgggctggttatgtatttgctgccactggccgccgcgttggggcttacgctggccaccctgtatgagcgccgcagtgggcaacgccaggacgcaggcttggtgctgccgcagttctccagtcgctgctgaccttgatcggcttcacctttgcagtaaccgaccgtcgcgtgcgcttcctgaggcctgccagttcagcaagctgacagacatcacctgttacaaagaaaccaggcctaagcaggagcgtggctgaaacatgggggcattttttactggtgcaggtgttgggcggtaacgcccgaggatttttgtatgttgctacgttatgcagcaatggcggcagtggtcgtcgcggcatccgggtgtgtgcaagaacgcgttgtgcatgaccgcaggccggtacagcgtgaatatgtcgaagtggttgcgccacaaccgccaccggtccaggtgatggaagtcgaacccgcggcacgttacggctatgtgtggtcgcgcggttactggcgctgggaaggcgggcgatacgtcgcggtacacggccattgggagcaagtgcgcgaaggctatcgttatgtgcatccgcactgggtgcagcgcaatgacggttaccactggcagggcggcggctgggtgcgttgagcctgcgctagatcggcttctgggtgcccagtagccgaacctcccgcaacaacgcagcaccgagttgatcggtgcccagttccttgtagcccactgccttgatctcgccgttctcttcggcctggatgatgatcaccggcgtttctttgcccgtggcttcgtccacatgcacggcatattggggaatctccagcttgatcggcgtacccgccgctttgccttgcacgttgatcaagaacgctgcacagccggtgtcgacgtccgcgctggtggcagagcgaccactgacgaaacagcttttcggcaggtcgggccaggcgatggtgtcagcggcggccagggtggaggccaagctcaaagtagcgagtagcaggatgcgcacgtgagtctgtctcttgatcaaggttgaacgcggttttaccaaagcctgaacagcgtcgcaatggtgtggctcagcccagccgtttcatgcctgtggccttggccgcgttttgatcaaaggtggcggtgtattcacaacccgccgcatgggcgcagcgctctatcaggtagtcggcgaagtcggctttgcctgcggtgaatcggcgcagagcctgccagatgatctcggcatgttcgacggtcaattcacgtgtgcgcaacagcgtttccagcacggtcaccacctcactcttggccgactcgtagcagctttgtaacacccagaccagttccaccaccgacaccaggctgacaaagcccggcgacagtgtggtgagtgattcgatcagctccgaggccttgggtgattggaccgggtcgtcctgggtgacataacgcaccagcacattggtatccaggccgatcatcgcgcttttgctcctcgggtggcgatggcgtggttcatggcatcgatcgatacggcctgggcgggcttgcggatcaaccccttgaggtcctgcacggttttgctcgcggcaatgatggaaaactttccgtcttccgtttcgacaaattcaacccggtcgccggtttccaggcccaatgcagtgcgcacttggataggaatggtgatttgcccttttgaggtaagtgttgcagtggccatagctaatagctccatcgtgatattccttaccctaaggtaaggattgatgaagggcaagatccgttggtccataggtcgctctgctggtgtgagtaaatgggaacaggtaaaaccctagttcgaactgttcgcgctcacacgctttcctgcatcccaaagagatacaagctatgaccgaccgccacctcatcatcccgcccgccatgcaacccattgttgagcgcgcgggctacgtgccagccgtcaaagttggaaacactttgtactgcgcaggccaggtcggccgcacgccggaactggccgtgattgaagaccctgaggcgcaattcatggctgcctggggcaacctgcggcaggtcttggaggagggcggttgcagctttgatgacgtggtcgacatgaccacctatcacgtgaacatgagccagcacatggcggtttttcgcgaggtgaaaaaccgcctgtttccacgcgggcattgcgcctggacgaccatcggcgtgtcagaactggcgcatcccgggttgctggtggaaatcaaatgtgtggcggtgcaacgctagttattgcaccacgcgatagcacggcacatacgccgcgccgcccggcaacttcatacggtgctgggcaacaaacgcctgtagcagctcatccagcggcttcatgatcgccgggtcgccgtgaatctcgtacggcccatgctgctcgatcaagcgaatgcctttgtccttgacgttacccgccacaatccccgaaaacgcgcggcgcaggttggccgcgagctcgtgcggcgccagcgcgtggctgagttgcaggctggccatgttttcgtgggtcgggtcgaacggacgctggaagccttcgtcgatcttcagcagccagttgaagtggaacgcgtcgttgcgctcacggcggaactgcttcacggccttgagcccggcagtcatctggcgcgccacttcggcggggtcgtcgatgatgatctggtaatgcgcctgcgccgcttcgcccagggtggcgccgacgaaggcgtgcaactgttgcaggtacggcgcggcgtgtttcggcccggtgaggatgaccggaaacggcacgtcgcggttgtccgggtgcatcaggatgcccagcaggtacaggaactcttcggccgtgcccgcaccgcccgggaaaatgatgatgccgtggccgacgcgcacgaaggcttccaggcgtttttcgatgtcgggcaaaatcaccagctcgttaacgatggggttcggcgcttcggcggcgatgatgcccggctcggtcaggcccaagtagcgcccgccggtgatgcgttgtttggcgtgggaaatggtcgcgcccttcatcggccctttcatcacgccggggccgcagccggtgcacacgtcgaggctgcgcaggcccagttcgtggccgactttcttggtgtatttgtattcttcggtgttgatcgagtgcccgccccagcacaccacgattttcggttccacgcccgggcgcagcgtacgggcgttgcgcagcaggtggaacacgtagtcggtgatgccttgggagttgctcaggtcgatgcgctggctgtccagctcgttctcggtgtagacgatgtcgcgcagggcgctgaacagcatttcgcgggtgctggcgatcatttcgccatcgacgaaggcgtcggccggtgcgttcaacagttccaggcgcacgccgcggtcctgctgatggatacgcacttcaaaatcttgataagcgtcgaggatggtcttggcgttgtcgatatgcgcgccggtattgaggatggccagggcgcactggcggaacaacgtgtagatgctgccggtgccggcttcactcagttgttggacttcacgttgggacagggtttcgaggctgcccttggggctgacggaggcgttgatgacttgacgttggagcattctgattccttgaaggcgcagccatcgcacccgtctagggcagcgatggcctgaaaatggtgagcgccgaattcggtcgcacgagactgtagtttggccgcctctcgggcagggcgcaaacaccgtccagcaccatcatgccgcagaacttactgaatcagcttccagtttttgtagaaaacccgacgcagggtaaacaccagcccggcaaagcctgcgatcacggcgttgagcactgacggcagcaaggtcggccgcacgatatcaatgaacaggcagtaacgttttgcgtcgttcttgttgaaggacgcgtgcatcagcgtgtcatcgaaaataaacagcgggtcgtcgtgccagtagtgcttgtgcttgcccacctggatataaacaccctcgtggtgcggcgccggcgccatgttgtagagcacgcggaacatcatgcgcagcgggccgaagtggaaggacgtcgaacggttttcgttgaataccgagacgccaatggtcttcacatacggcagttttttgcgcagttgcggaatgtccaaagtggtttcaatcgggcggccgtaccattggaaaaacaacatgccgcgctttttctcggccatgcgttcatccaggtagctgatgatctcatccttgttggccatggcgtcgtcgatcacctgctgcaggtcttcacgccaggccggcggcaggtcgcgcatggtgtagacatggcggttgcgcaggctcagcaggtcgaacagggtgttgaacggcgccaatatccaggtgttacggccgctgccgatgaagtactttttgatcgtgtcggcgtcatacaggccgttgcgcaggaagtcgtagaccccgcaaaccagcaccaggccgagaaataccgcagtggtcatgggaaacaggcaaataatcagcaggacgccgattgcccaggcgaccgacactgcatttttgcgtaaggcagacttgctcatgaaactcagctccagctggacgccattcgacaggtccggatccgtggctgcgagtggtgaggatgttgaaacatgttgatacatccttcttatgataaggcgttcagcgacgaataggcgttttaaatattgcgaaattgtgaaggaattgaacaaatcttcacggttatggtccggcacagagttttactcagcaaacccgtgggagggtgaacggtagcaggcatacgccaaaaagccctgcgccgattgaattttgtaaacagaagatttgcgactatcgtgacgcttcggttttttggacgtcatagaccggtacgattaagttgaatggccaccattggccttcggcaccttggaagaggcagaaattttatgatcatcaaaccgcgggttcgtggctttatctgtgtgaccgctcaccctgttggctgtgaagcgaacgtcaaggaacagatcgactacgtgacccaacacggcgtcatcgaaggcggccctaaaaaggtgctggtcctcggcgcttccaccggttacggcctggccgcgcgcatcagtgccgcgtttggctgcggcgccgacaccttgggtgtgttttttgagaaagaaggcgaagaaggcaagctgagctccgccggctggtacaacagcgctgcgttcgagaagtttgcggttgaaaaaggcctgtacgccaagagcatcaacggcgacgcgttctctgacgagatcaagcgcctgaccatcgaaaccatcaagaaagacctgggcaagatcgacctggtggtctacagcctggccgcgccacgccgtaccgacccgcaaggcgtggtgcacaactccactctcaagccgatcggcaaggccgtgaccctgcgcggtatcaacaccgacaaaggcgttgtggtcgacaccacgcttgagcctgcgacccaggaagaaatcgacggcaccgtgaaagtcatgggcggcgaagactggcagctgtggatcgacgccctgcgtgacgccgatgtactggccgaaggcgccaagaccactgcgttcacctacctcggcgaaaagctgacccaggacatctactggaacggctccatcggcgaagccaagaaagacctggacaaaaaagtcctgaccctgcgcgacaacctcgccgcgctgaagggcgacgcccgtgtgtcggtgctcaaggccgtggtcacccaggccagctcggcgatcccgatcatgccgctgtacctgtcgctgctgttcaaggtaatgaaagagcagggcacccacgaaggctgcatcgagcaggtctacggcctgttcaaagacagcctgtacggcagcgagccgaagctggacgccgacggccgcctgcgcgccgacctggccgagctggagccgaaagtccaggacgccgtggccgcgctttggaaccaggtgaccgacgacaacgtcaacgagatcagcgattttgccggctataaggctgagttcctgcgcttgttcggctttgaaatcgacggcgtggattacgaagccgatgtgaacccgaccgtgaaaatcaatggcctgatccaagcctaaacacggtcaaaaaatgtgggagcgggcttgtgtgggagctggcttgcctgcgatgcagccaccgcggtgtttcagttgcaccgcggtgatgctatcgcaggcaagccagctcccacacatgtctgctccatacatgtctgctccacacaatgtccgttccacacacatgtctactcctgcacttcatcgcgctcccgcgcaccctcacaatctgccagactccttgcgctatcaagccacgctaacggaggatctgatgacgattcgtgcagtagtttttgatttcggcggtgtcctgttcgactggaacccgcaccacctgtaccgccagctaattgccgacgaacacgagcggcagcactttcttgacaccatttgcacccaagcctggaacaccgagcaagacgccggccgcagcctggccgaaggcacgcgccacttgatcgagcagtacccaaagcacgaaagcctgatccaggcctattacgaccgttggcccgagatgctgcgaggttcgttgccggaaggcgtggcgatccttgaagcgctgcataaggccaatatgccgctgttcgggctcaccaactggtcggctgaaaccttcccctatgcgcgcgacaactatccgttcctgcagcatttgcgcgatatcgtggtctcgggcgagttgaagctgatcaagccggaccctgcgatctatcacgccagcctcaatcaggtgcgcgcccatctgccggatattcagccgggtgaagtggtgtttatcgatgatgtcgccggcaatatcgaggcggccgtcgcactcggttggcagggcattcaccacgtgtcggtcgagcgcaccgcggcgcgcctgcgggagttgggcgtggtcttctagagcgcccacttctccatggcgaaatccacaaaggcgcggagcttgggcaggcggtaacggtcctggcggtagagcaggtgcatggggcggctggacagttggtaggtggtcagcaaggccaccagcttgccgctctccaggtccggttgcaccagggcatcggcgagcatgatgatgcccatgccgttgacggccgcctggcgcaagccttgcgagctgttgatggtcaatgagcccgccaccgggacttccacctcgccttcttcgccggtcatgcgccagagcttgtcggtgtcgcgccagttgtcggtcgccgggtaggcgaacgccaggcagtcgtgctggcgcaggtcgtcgggcgtttgcggcgtgccacgtcgcgccaggtacgcaggtgacgcgcagagggtgagggtgtaggcctgcatgggcctggcgatcaggctggaggtttccagttcgccaagacggatcgccacgtcgaagccgctgtcgaccaagtccattcgctcgttgctcagctccacgtgcaggttgatcagcgggtagcgctgggagaattcgctcaaggccggtgccaggcgctcggtgccgaacaccggtggcgcggtgatgcgcaggctgcctttggggacttcgctgtgcgcctgctctgccagcaactcggagtcggccaccagccccagcacttccaggcagcgctggtaatactgcccgccaaattcggtgaggctttgtttgcgcgtggtgcgcttgagcaggctgacgcccaggcgctgctccaacgcgcgcaagtgattgccgaccatggtggtcgacatcccgcactcttgcgcggccgccgtcatgctgccggtctcgaccactttcacatacaccgacattgcctggaacagatccattatcaagccctggtttaaagtcattgcaggaatacgcagtttatccagctctagtggctaacgatactgcacgcatcccaacgatgcactggagcttgccactatgaccgccgcctgcctgatgaccacgtatcaacccctggccctgagcttcacccgtggcctcggcacgcgcctgtgggaccagcagggccgtgaatacctcgacgcggtggccggtgtggcggtgaccaatgtcgggcattcccaccccagactggtgacggcgatcagtgagcaggcgggcttgttgctgcacacctccaacctttacagcatcgactggcaacagcgcctggcccagcggctggcacagctgtccggcctggaccgtgcgttcttcaacaactccggcgccgaagccaacgagacagcgctgaaactcgctcggctgcatggctggaaaaaaggcatcgaagaaccgctggtggtggtgatggaaaacgcctttcacgggcgcaccctcggcaccatggcggccagtgacgggccgtcggtgcgcctgggcttccagcgcttgccgggggattttctcaaggtggcttttggcgacatggcggcactggaagccattacacaacagttcggcacgcgcatcgcggccgtgctgctggaaccgatccagggcgaaagtggcgtgctgctggcgcctcccggctacttgaaagccctgcgcgatcactgcacgcgccacggctggctgatgatgctggatgaaatccagaccggcatcggccgcaccggcgcctggtttgcgttccagcacgaaggcatcaccccggacgtgatgaccctggccaaaggcctcggcaacggcgtgcccatcggcgcctgcctggccaaggctgcggtggcgcagctgttcacccccggcagccacggcagcacgttcggcggcaacccgctggcctgccgcgtcggctgcacggtgctggatattattgaggagcaaggcttgctgcagaacgctgcgcaacagggcgagcggctgctggcgcggttgcgggtggaattgagcgagcatccacaggtgctggcgattcgcgggcagggtttgatgatcggcatcgaactggctcgcccttatcgcgacctggcctaccgctcagcgcaggagcacggcctgctgatcaacgtgacgcgcggcacgatcatccggttgctgccgccgctgacgctggaggccaaggaagtcgagatgatcgtgcgggccatcacccgtctattggactgaaacccgataaaagtcttggagcaggcttgtgtgggagctggcttgcctgcgatagcatcacctcggtccaaaattaagaccgaggcgcttgcatcgcaggcaagccagctcctacataagcccactcaattggccgggccattcaaccattcctggttcatggtttcggtatcgcccaggtactccagcaaccaactcatcgccggcgacagcttgctctgcgcccacgccacgcacgacgggctggccgggaacggtcggctcaattgcagcgccaccagctcgccgcgttcaatccacggcagcacttgatgcgccggtgccatgccgacgcacaggccatcgcgcaggcaatccagcgccgaggcccagttgggcaccaccagccggcgttggttatccagggtccaggtgtcgcgcttgggcaggttgcgcgaggtgtcggtcatgcacagcgacgcgaacgggcgcagttggtcgtcactgagcaagtcgtccatcgccgccagcgggtgcctggcgctgaccacgcacagccagttcagcagccccatatcacgaaaggtgaagtggctcgccaccggcacggcgctggtggcgccgatcacgatgtcggtgcgctcatcggccaaggcgtcccacacgccgttgtacacctcgtattccagcagcaattccacctcggggaactgccggtagaagtccagcaccaactgccggcagcgctggggtttgacgatggagtccacggccaccttcaattggccgctccagccattcgccacctgttggcacaagcgccgggtgccgagcatttttttcatcacgccgcgggcttcgtctataaataaacggccggcgggcgtcagctctacatcgcgatgcctgcgcacaaacagcggcaccgccagccattcttcaagctggcgcacggtgtagctgatggcggacggcacgcggtgcagttcctgtgcggcggcgctgaagctgccgtggcgtgccactgcatcgacgacgtccagagagtattcggaccacattacggctgccttcaaaatatttgataagagtgtccaattattatcgcttcacacactcactgtcagcttcataataggcgccagtcagcaaatagtttgatggcaggttcagcaaggcttcaatgaaaaattcttttggtttcacttggtatctggcggggctgagcatgctcggttatctcgccatggacatgtacttgccggcgttcggcgccatgggcgagcaattgcacattagcgcgggcgccgtgggcgcgagcttgagtattttcctcgccggctttgcggtggggcagttgttgtgggggccgttgtccgaccgactggggcgcaagccgattctgttgaccggcctgagcctgttcgtgctgggttgcgccggcatgttctgggttgaaactgcgccgcagctgttggcgttgcggtttatgcaggcgattggcgtgtgttccgccgccgtgagttggcaggcgctggtgatcgaccgttacccggctgacaaggcgcaccgcgtgttcgccagcatcatgccgctgatgtcgctgtcaccggcgctggcgccgttgctgggtgcgatggtgttgaatcatttcggctggcaggcgatcttcgcggtgttgctgggcgtgtcgctgctgttgctgctgccgacgctgttgctgcgcaagatgccgaaacgtctcgcagagcagggcgaaccttcgcgcctcggttatgggcagttgctgacctcgcgcgtattcaccggcaacgtgatgatcttcgccgcctgttccgccagtttctttgcctggctgaccgcgtcgccgttcatcctcggcgatatgggttacagcccgaatgacatcggcctgagctacgtgctgccgaccctggcttttctgatcggtggttacagctgccgcagcgcgttgcagcattaccagggcaaaaccctgttgccctggttgctggtggcgtattgcatcagcatggtggcgttgtacctggtcgccacgttgacggtgccgaccctgaccacgttgctgataccgttctgcctgatggcgctggtcaacggtgcgagctacccgattgtggtggcgaatgcgctgatgccgtttgcggaaaattccggcaaggccgcggcgctgcaaaacaccttgcaactggggctgtgctttctcagcagcctgttggtgtcgtcgatgattgatcagccgctgttgatcactgtgattgtgatgttggcgaccgcgccgttggcggtgttgggctattggctggcgcggccgaaggcggacaattccgagctcgccaacgcctaaagctggaaatgcaatcaaacctgtgggagcgggcttgctcgcgaaagcggtgtgtcagccggcctattcgatactgacacactgcattcgcgagcaagcccgctcccacatttggagtcggtttcttcagtgcattagaaggtgacttccatgttcagcgtcggcgtggaggtccgagtaccccgcccaccgtccacgccgaacttgttgtgccagtactcataccccacgccgagatacaggttcggcttcacgcttttacccggtcgcaccgccaccatcagcgcgctgcgcatcagtgtttccggtgcggtatcacggccgtggtagtcctcgcctttttccccgacgtaattgataaacccctgaaacttcgccgcgtggttggcgatgtcgaacgggcgcatccacgccagattgagcatgtaggtgtcgtcgaacgtgtggttcgactcctgcgcgccggggatgccggtgtggttcctttccttgtagtacatcaggctcaaatccagcacgccgacggtgttgaacttcaacgtcgggccgatcaccagcgcgcgttttttggctgaggcggcgttgttgttgcggttggcgtcgaagcccagggtcagggcgtagtcctttatcagcccggtgccgagcggcatatcaaatacccgcgacgcgtacagctggtgccggtacacggcgtagacctcactgccgccatggtcggtgcccttgcgcgggtcgtggctgtcggacaggaacacatccaggttcaggtagttgctgccgtattggtagccgctggcgtgggtgaagctgtagatgcgcttgctgaaatcatccgggttattcggattggtgaagtgctggccgtagcgaaaacctacgctgttgttcatccattccaccgcgacagcctccccgccgccgagaagggtgagtgcaacggttgcgccctgtaatgcctttttcattgttataggtcctttggcgttctggctcatgacggccggattatttttgtaacgccgatggagggtatcttgttcgattgattgtatacaactctatggacatccagtccaaacattgcatacagtgttcgcacaacaaaaacagagaacccctcaccatgactatcccgaaggcgtcaccgcagcggccagaagatgagaatctcggcgtcgcggccaacatggcttacggcctgcagcatgtgctcaccatgtacggcggcattgttgccgtgccgttgatcgtcggccaggcggccggtttgtcgccggcggacatcggcctgttgattgccgcgtcattgtttgccggtggcttggccacgctgctgcagacgctcgggctgccgttttttggctgccagctgccgctggtgcagggcgtgtcgtttgccggtgtggcaaccatggtggcgattgtcggcagtgatggcgcaggtggggtgccggcgattctcggggcggtgatggccgcttcgttcatcgggctgttgatcacgccggtgttctcacggatcaccaagtttttcccgccactggtcaccggcattgtgatcactacgattggcctgacgctgatgccagtggcagcgcgctgggccatgggcggcaacagccgcgcggcggatttcggcagcatggccaatatcggcctggcggcgctgaccctggtgctggtgttgttgctgagcaagatcggcagcgcgaccatctcgcgcctgtcgatcctgctggccatggtgattggcaccgtgatcgcggtgctcctcggcatggccgacttctccggcgtcgcccaagggccgatgtttggtttccccacacctttccatttcggcatgccgacctttcacctggcggcgatcatttccatgtgcatcgtggtcatggtgaccttggtggaaacctcggcggacatcctcgcggtgggcgagatcatcgacaccaaggtcgactccaagcgcctgggtaacggtttgcgcgccgatatgctgtcgagcatgttcgcgccgatcttcggctcattcacccaaagtgcgtttgcccagaacgtcggtttggtagcagtaaccggggtaaaaagtcgctttgtggtggcgacgggcggggtgttcctggtggtgctcggcctgctgccctttatgggccgggtgattgccgcggtgcccacctcggtgctcggcggcgccggtatcgtgctgttcggcaccgtggcggcgagtggtattcgcaccttgtcgaaggtggattaccgcaacaacatgaacctgatcatcgttgccacctccatcggtttcggcatgatccccatcgccgcgccgaacttctacgaccactttccaacgtggttcgcgaccattttccactcgggcatcagttcgtcggcgatcatggcgatcctgctgaacctggcgttcaaccacttcaccgccggtaactcggaccagcaatcggtgttcgtggcggggactgagcgcagcttgtgcttccacgatgtggcggcattacgcgatggggattacttcagcggcggcaagttgtttgatgctgaggggaaggagattccggtggtggcggatgtacccaggaagacggtgaagcccgagacgaccgaagtctaaaaatgtgggagctggcttgcctgcgattgcggccagcgagccactgcatctgtaactgatgtaccgctatcgcaggcaagccagctcccacattggaacctagccagccttgaggactttgtgcggcattgaacaggcctcatccaaaaacttcaccactgtgcccatgcacgcctggcgctcttccacgtggggcatgtggctggagtcttcaaacagcgcccagcgcacgtccgcgatttcatccaggaacggcttgaccaccaacggcgtggcctcatcgtgccggccggagatcaccagggtcggcaccttgatcgccgacagccggccaatcacattccaatccttcaagctgccgatcacgtgaaactcggtcgggccactcatggcgtggtacacggtggggtcggcatccacggcggcaaaagtgcgcgccacttcttccggccacgggttgacgcggcacacgtgctggtcataaaaaatccgcgaagcgacgaggtattccgggtcctggtaggtgccggcctgttcgtgtttaagcagggtttcatgcacgccttccggcagcagtttgcgcaggcggttggcttcgctgacccaggtgcgcatgcacgtgggggagttcgccgggataaacgcgcgcaggcccttgggctgcaaaatcgcgtgttcgctgccgagcatgccgccccaggattgcccgaggatcgcgtagttatcgctgatttgcaggtggtcgagcaggttgtccagttcggcgaggaacaggtcgatggtccagaacgacgcgtccttatccggcaagtgggtggagcgcccattgcccagctggtcgtagtgaatcaccgcatggccgctggccgccacgtctttgaaggcgtcgacgtagtcgtgcgtgcagccggggccgccgtgaatgatcaccaacggtgtacggccggtggtcaggtcgccggtcacgcgataccaggtctggtaggcgccgaaggccgcatagccttcgcggactttctcgaagaattccatttcgtaccctgctctgaaaaaaaggatcagggctacgataatcgtcacgcgacgtttaagtaactagcaaaacagctaggttttgctgacgggtcagtcttccagcaaacgataatgggtggcgcgcaccaccgcttgcacacggttcttggcccccagtttgtgcatcgccgaggccaggtgcagggtcactaccgccaatgagcggctcaactgcgtggcgatttcagcggccgtaaggccatcggcggcccatttcaggcattcgcgttcgcgtttggtcaggtgaatatgcgggtacgtgcgtagttctttgctgaacagcgggtaggccgcttcctgcagggcatgggtgatcaggctgaagtccgccagggtctgctgcgcgtccttcaataccgtacgcgccttgccggtgcgcaggccggtcagtgacgcgaagccgccgcgcggcaggtggatgggcacgctgacaccgcaggtcagttggcgctcatgcaggtaggaggacaccggagcgtggcacgggtcgatgatcttttgcagtgcggtatcggctttcgcctcgtaggaccacacgaacggcgacaccgtgctcagggccagatgttgcaccgggtcgatctggtagaagccttcgctgcaccataacgcgtgccagtcgggcggcgtattgcgcagttccagcaccgaaggggtgatcagtgagccgtcctggtcaatcggcaccggcgtgtagtcgtacaccagcgcatcgaagcccaactgctgggcgaggataaacgtattgtccatctgttcatccaggctcctgcctggcatgagacggttattgaaggcagtaagcttggccagcatccgttctgctcccgaattcatttgaatctcgacttgcggcaagtagaatgccacgccccggcgaaggactgccaggccaaacctataagaaatactaggttatggacgcgcggcatcctcggtagtgttggcctgtaaacggctgctacctgccaggccgatacaacacaaggaatgtatgcatgtggcgtgaaattgcccccgaccagcagtacaacgtgcaagtcgacggccataacctcgtggtctacagctttggcgatggcgatgaggtgctgttatgtctcaacggcggtccgggcctgccgtgtgactacttgcgcgacgcccatggctggctcaaagaccataacctgcgagtggttgcattcgaccagcttggcaccggcgcatcagccagacccactgacgttgccttgtgggaaatcggccgttatgtcgaagaagtcgaaaccgtgcgccaggccctcggcttgggccgtgtgcacttgctcgggcattcctggggcggctggttgggcatcgaatacgccatccactatccccatgcgctgaaaagcctgatcctttcaaataccgtcggcgacattccgcacctgtcccaggaacttgaacgcctgcgcggcgccctcggcagcgaaaccgtggccatgatgcagcgccacgaggccatgggcaccctcgatcacccgcaataccaggccgccatcaccttgctcaactaccgccacgtctgccgcctggacgaatggcccgagccggtcaaacgttcgctcggcgactggaacatgggcccctacgaaaccatgcaaggccccaacgaattcctctacatcggcaacctcaaggactggaaccgcatccccgagatggccgagttcagaatgccgatcctgatcaccaccggccagcacgatgagctcacgcccgcctgtgcccagcgcatgaaacttgccgccaggcatgccgaactgcacgtgtttcccaacagcagccacatgcctttttatgaggagccccacgcgtacttcccggtgctgctggacttcctcgcgcgtcaccggggctgacggatgaacctggcgcgttaccgttttgtgctgtcccggccgctgcaattgctgccggtgctgtttggcatcagcctgatcacctttgtgctggtgcgttcgattcccggcgacccggcgcgggccttgctcggctcgcgcagcacgccggatgccctgctgaaaatccgtgcccaatacggcctcgatcagccgttgtggctgcaatatttctacttcctcaagaacctgctcaagggcgatctcggccaatccctgctgtataaggtcgacgcgttgaagctgatcgtcacccgtatcgagccgacgctggtgctggtgctcggcagtgtggtgctggcgctgttgattgcgctgccgttggcaacctgggcggcgcgcaataaaggcggctgggcagacaacctgatccgggtgttcaccacggtcggcctgggcatgcccgcgttctggctgggcttgatgttgattctgttgctgagtgtgaagtggggcctgttcccggtgtccggctatgggcgcacgtggctggataaagcccaccatatgctgctgccgtgtctgaccatcgccctggcgctgtcggcggtgctggtgcgcaacctgcgggcgagcatgttgatggagctgcaggccgatcacgtcaccgccgcccgcgcgcgtgggctgtcggaggccgccgtgttccgtcggcatgtgttgcccaattcgctggtgccggcggtcaacctgctggcggtgaatatcggctggctgatcagcggcacggtggtgatcgagagcctgttcgcgattcccggtattggccaattgctggtgcgcggcatcttcacccgcgattacatggtggtgcagggcgtggcgatggtgctggcgtgtgcgacggtggtggtcaacttcctcgccgacgtggtgacggtcaccctcgaccctcgggtgaagatgcaatgagcagccgcccactgattgccccctggcgtttgcgcctgcgttttggttttcgcaatggtcggctgaccgctgcgtggggtctgttaattctgctgctgtggttggccctggcactgtttgcgccgtggatcgcgccttttgaccccattgcgcagaacaccgaaatcagtttgctcgggcccagcctgacccatccgtttggcacggataactacgggcgcgacattctttcgcgggtgatctggggcgcgcgcatcgacctgcaactggcgattgtcggggtgattttcccgttcatgatcggcactttcattggtgcggtgtccggctacatcggcgggcgcttcgacagcttctgcatgcgtgtgatcgacgtgatcctggccttcccgttcctggtgctgatgctggcgatcatggccatcctcggccccggcttgcagagcttctatatcgccatggcgctggtgggctgggtgtcgtacgcgcggctgattcgctcgcaaatcctggtgctcaaggaaagcgagttcgccctggccgccaagagcctgggctttggccatgggcgcattctgtttcggcatttgctgcccaacgcgatgttcggctcgattgtgttttccatgtctgacgcggtgctggtgctgctcaacggcgccgccgtgagctacttgggcctgggcgtgcaaccgccgaccgccgagtggggcacgatggtcgccgaagggcaggcatttatcaccacggcctggtggatctgcacgtttccggggctggccatcgtcaccttggccatgggtttcagcctgctcgccgatggcgtggcgcacgtgttgggggagcgcacatgagcctgcttcaggtgcaggacctcagcgtgatcgcccaaaatgccgggcgcgatgtcaccctggtcgaccgggtgtcctttgacctggccgacggtgaaatcctcgggctggtgggcgagagcggctcgggcaagaccatggcctgtcgcgggctgatgcgcctgttgccgtcgcccaacctgcgcgtgcaaggcggtgctgtgcgcctggccgggcaagacttgttggcgttggatgacgccggcatgcgcgccatacgcggcgggcaattgggcatgatcttccagaaccccagcagccacctcgacccgttgatgcgtatcggcgagcaaatcgccgagggcattcgcctgcaccagggcgcgtcgaaaaaagacgcgcgcctgcaggccatcgaggtgctgcgccaggtgggcattcccgatcccaaggcgcgggtcgacaattacccacacgagttttccggtggcatgcgccagcgcgcgatgattgccgtggcgctgggttgcaacccgaaagtgctgattgccgacgagccgaccaccgccctcgatgtgacggtgcaggcgcaaatcctgcgcctgttgctggacctgcgcgacaggcgcggcctgtcgatcatcatgatcacccacgacctcggtgtggtggcgcagacctgcgactccatcgcggtgatgtacgccgggcgcctgtgcgagcacggcagcaagtacgacctgctggcccacccgcaacacccgtacaccgccggcctgatcgattgccaaccggcccacagcagcggccacgccttgctgcgcacgattcccgggcagccgccgttgctggatgcattgcccgacggttgccgcttcaacccgcgctgcccgcaggcgcgcgcgttgtgtaccgaattgctgccggaaggcacacgggtggcgtgtcactatccgttgggagatcgcccatgagcctgctgcagatcaaggaccttgaagtgcgttttgccgcctccggcacgggcctgttcggcctcaataaacagtgggtgagggcggtcaacggcgtgtcgctgaacctggccgcaggcgaaaccctggggctggtcggcgagtccggcagcggcaagagcacgctcgggcgggcgatcctgcacctcaacccgatcagcgccggccaagtgctgtttgacggcatcgacatggcccacggcagtgccatcgatatcgcacgccttcggcatgaaaccgcgatgatcttccaggacccgtacgccgcgctgaacccccgccacaccatcggcgaaaccatcgccgaagtgttgcgcgtgcagcgcaaagtcgccccgcaacagatcgcggcgcgcgtcaatgaattgctcgatctggtcggcctgcgccccgaactggccagtcgcaaacctgcttccctcagcggcggccagtgccagcgcgtcggtatcgcgcgtgccctggcggtggagccgcgcttgatcatcgccgatgaatgcgtggcggcgctggatgtgtcgatccagggccagatcatcaacctgctgctggaactgcaacagcgcatgaacctggcgattctgtttatcgcccatgacttggccattgtgcgtcgcctgtgcgaccgcgtggcggtgatgtacttgggcaagatcgtcgaagaagggccggtggaagcggtgtttaccgcgccgcgccatccgtacacggcggcgttgatcgaggcaatccccgagattgatccgcatcggccattgcctgcagaaccactgccgggtgagccaccaagcccgctgaatttgcctacaggctgcgcctttcacccgcgttgccgacatgcccggacgatgtgttccgtggtgttgccgccgacgcatttcctgcacgagcatcgatacagttgcgtgcttgaacagccattgaccctttctgccgtcctaaacaaggagttatgacatgcaatcccgtcacttgaagttgctcgccgccgctacattaaccgcgtggtctcttaccgctggcttggcgcaagccgccggcgtactgaccatcggctgccgtgaagacagcaccaccttcgacccgatcaaaagcgcgcaaaaccgcgacacctgggtgttcgccaacgtctacgacacgctggtgcgcgtggataacctgggcaccaagatggaaccgggcctggcgcaaagctgggagatttccaaggacggcctgacgtacaccttcaaattgcgcgaggcgaagttctccgacggctcgccgatcaccgccgacgatgcggcgttcagcttgctgcgtatccgcgacaacaaggcctcgctgtggagcgacccgttcagcctgatcaacactgccaaagcgtcggacccgcaaacgctggtagtcaccctgaaaaccccggctgtagccttcctctcgcaattggcgtcgccgacggtgtcgatcctgtcggaaaaggccatgaccaaaatgggcgaagacgcctactcggaaaacccggtgacctccggcgcgtttaccgtggaagagtggcgcaagggcgatcgggtcattctcaagaaaaacccgaacttctggcaggccaagaacgtcagcctggatggcgtggagtgggtgtcggtcaccgatgacaacacgcgcatgcgcatggtgcagaacaacgaactcgacacggcgatcttcgtaccgttctcccgcgtcgaagagctgaagaaagacaaaaacgttgtgatccacgccgacccgtccacccgtgaagatcacttgctgatcaaccacgcccacggcctgctggccaagcagcaggtgcgcgaggcgctggacatggccatcgataaacaatcgctggtcaagaccgccacttacggtcaaggcaccgtggcctattcctacatcccaaaaggctcgctgtaccactacgccaacaacctgcaacgcccgtatgacccgaccgccgccaagaaactgctggaagaggctggcgccaaggacttgaaactcaactacgtggtcaacgccggcaacgaagccgacgagcagattgcggtgatcatcaaggaccagttggccaaggtcggcgtgaccgccaacctgcagaaggtcgacccaacccaaagctggcagatgctggtagacggcgagtacgatatttcggtgatgtactggaccaacgacatcctcgacccggaccagaagaccaccttcgtgctgggccacgacaccaaccagaactacatgacccgctacaagaacgacaaggtcaaggcactggtggcggcggcgcggatcgaggccgacccggtcaagcgtgagcagatgtatgtggaattgcagaagctggcgaaacaggacgtgaattggatcgacttgtactacagcccgtacatcaacatctcacgcaagaatgtgagcaacttcctgcagaacccgctggggcgtttcaccctggaagaagtggtgaaaaactaaagcacaccgcttgctcattcccacgctctgcgtgggaatgaatcctctgacgctccgcgtcacccttgcataagtcttgaacccagttggcagctggacgcggagcgtccttggaggcattcccacgcggagcgtgggaacgatcatgtgggagccaggcttgtgtgggagctggcttgcctgcgatggcatcaactcggtgtgtcaggtacaccgcggtgatgccatcgcaggcaagccagctcccacatgaacacggttccacatttttggtttgtggtgtgtcagcagttactgcgcatcaaacgcctgcccattgatgccggcactgtccggccccatcaggtacaggtacaccggcatgatttcttccggcgccggccgttccatcgggttttcaccggggtaggcctgggcgcgcatgctggtgcgtgtaccgcctgggttgatgctgttggcgcgtaccgaggcgacgtcttccagctcatcggccagggtttgcatcaagccctcggtggcaaatttcgacacgccatacgcgccccagtaagcccggcctttgcgcccgacgctgctggaggtgaacaccaccgacgcgtcctgggacagcttgagcagcggcagcaaggtgctggtcagcatgaacatcgcgttgacgttgacgtgcatcacccgcatgaagttttcaccggacaactgctcgatcggcgtgcgtgggccgatgatcgatgcgttgtgcagcaggccgtcgaggtggccgaactccttttcgatcatcgcggccagctcatcgtattgatggggcagggcggtttccagattgaacggaatcaccaccggctgtggttggcccgccgcttcgatctcgtcatacacctgggccaggttggcttcggtcttgcccagcaacagcacggtggcgccatgggcggcataggtttttgccgctgcggcgccaatcccgcgaccggcgccggtcaccaggatcacccggcctttgagcagttctgggcgtgcggagtaatcaaacataaaaaacctcgacagaattcaagctaatacaggccttgaagtggaatccatttcaggtgggagctggcttgcctgcgatggcggtctgccagccagcacctctggcgacaggtaatccgttatcgcaggcaagccagctcccacagtgatctcagtgctagtgagtacttcgaacaatcagcaactgcacagtgcgttatccagcaccttgcgcagttccagcgggtgatccaccaccacatcggcgccccagttgcgcgggttgtcgtccgggtggatgtagccgaacgtgaccgcggcggtgcgggtgccggcgtcgcggccggactcgatgtcacgcaggtcatcgcccacgaacagcacgctggccgggtccaggtcgagcatcttgcacgccaggatcagcggttccgggtctggcttgctgttcttcacgtggtccgggcagatcagcagcgccgagcgctgggccaggcccaactgctgcatgatcggttcggcaaagcgcagcggcttgttggtgaccacgccccataccagcttggatttttcgatgtcctgcagcagttcttccatgccgtcgaacagtttgctgtggatcgcgcagcccttgaggtagcgctccaggaattccaggcgcagttcttcaaagcctggggattccgggtccatcgagaaggtcacggcgaccatcgctcgggcgccaccggagatttcatcacggatatgctggtcgttgatcggcgccaggccgcgatcggcgcgcatcgcctggcatatcgcgatgaagtccggcgcggtgtccagcaacgtaccgtccatatcgaagagaaccgctcgcaacttcacaggcttactcctcgcgcagggtctggatcatgtagttgacgtcaacgtcgttggccagcttgtagtgcttggtcagcgggttgtaggtcaggccgatgatgtctttgacggtcagcccggcctggcgactccaggcgcccagctcggaggggcggatgaatttcttgaagtcatgggtgccgcgtggcagcagcttcatgatgtattcggcgccgatgatcgcgaacaggtaggccttggggttgcggttgatggtggagaagaacacctggccacccggcttgaccatgcgaaagcacgcgcggatcaccgaggacggatcgggcacgtgttcgagcatctcaaggcaggtgaccacgtcgaactgctcgggcatttcctcggccagggcttcggcggtgatctggcggtattccacgctcacgccggattccagctggtgcagttgggccacggccagtggcgcttcgcccatgtcgatgcccatcacggtggcgccacgttgggccatggcttcgctgaggatgccgccgccgcaaccgacgtcgagcaccttcttgccggccaggttgacgcgttcgtcaatccagttgacccgcagcgggttgatatcgtgcaggggtttgaactcgctttcgcggtcccaccagcggtgggccagggcttcgaatttggcgatttcggcgtggtcgacgttgctcatggtgaatcctctaaatctgataaatcggtttgccggtcttgaacgccagggttcaagatcggcgttattcgctgtgcccgctgatgcgttggccccaggcgatggccgtggcggtcaactgttgttcatccatgcgggtcaattgccggtcgtcgagcaactgcttgccggcgacccaaaggtgtttcacacagtcgcgtccggtggcatatataagctgtgagaccggatcgtagatcggttgttgcgccagccctgaaagatcaaaggccacgatatcggcagccttgccgacttccagcgagccaatctcgctttccaggcccatggcgcgggcgccgttgagcgtggccatgcgcagggcgcggtgcgcatccagggcggtggccgagccggcgacggccttggccagcatcgcggcggtacgggtttcgcccaacaggtcgaggtcattgttgctggcggcgccatcggtgccgatcgccacgttgacgccagcctgccacagacgctccaccgggcaaaagccgctggccagtttcaggttcgattccgggcaatggatgatgctggtgttgctttctaccagcaaagccaggtcatcctcgctgatttgggtcatatgaacggcctggaagcgcgggccgagcaagccgagacggcccaggcgcgccaatgggcgttcaccggtcttctcgacggcttgctgcacttcgaaggcggtttcgtgcacgtgcatatgaatggacgcgtccagctcttcggcgatgatgcggattttttccaggttttcgtcgcacacggtgtacggcgcgtgcggcccgaaggtgatcttgatgcgcgggtggtgcttgaggtcgccgaacagctcgacgccctggcgaatcgcctcgtcgggcgtgctggcgccgggaatcgggaagtcgaggatcggaatcgcgatttgcgcgcgtatgccgctgttatgcacgcagtcgctggcgaccttggggtagaagtacatgtcggagaagcaggtgatgccgcctttgagctgctcggcgatggccaggtcggtgccgtcgcgcacgaaggcttcatcgacccatttggcttcggcgggccagatgtgcttttccagccaggtcatcaacggcaggtcatcggccaggccgcgaaacaggctcatcgccgcgtgcccgtgggcgttgatcaggccggggctgagcagcatgcccggcagctcgcgtacttcactggccgccagcttcaaggccgcagcccgcggcccgataaaggcaatgcgcccatcacggatgcccaggccatgttccttaagcaccacgccggcaggttcgacaggcaccagccaagtgggcagcagcaacaggtcgagcggggcggcagtggaggtcatcgcaggcttcttcccaggcagctataaaagaagggcgaagtatacccgagcgtcctggctggcggatcgctataatcggcggcttttgttcatgagtgcggggtaagggatgcgcgaccgactgttagcggcagacaacgtgagggccatcgagtggcgtgatggcgcactgcacctgctcgatcagcgtgccttgccgtcccggcaagcctgggttgcctgcactaccgcggctgaagtcgccgacgcgattcgcacgatggtggtgcgcggcgccccggcgattggtatcagcgccgcctatggcctggtgctcgcggcccgtgaacgcatcgctgaaggcggtgattggcaggctgcgtgggaagaagactacgcgctcctggccgatagccgtccgaccgcgtcgaacctgttctgggccttgaagcgcatgcgcgatcgcctcgaccgcgtcaagaagcacgccgacccgctggcggtgctggaagccgaagccatcgcgattcacgaaagtgatcgggaagccaatgtggtcatggcccaattgggcctcgatcggattcgcaaacaccaaggcaacgctcaggcgatcctgacccacggcaatgctggtgcgctggccacgggcggcgtcggcacggcccttggggtggtccgcgcggccttccttgaaggtttggttgagcatgtctacgtcaatgaaacgcggccctggctgcaaggttcgcggctgacggcgtgggagctggcaggcgagggcatcccggtgacggtcaatgctgactcggccggcgcgcatatcctcaagaccaagggcgtgacctgggtgatcgtcggcgccgactgcattgccgccaacggtgatgtgatcggcaccatcggcacctatcagctggccgtgtgcgcgatgcaccatggtgtgcgcttcatggtggtggcgccgagttcgacgcttgatttgatgatggccaccggcgaagacgtcagcctggaagaacgtgaggcggctgagttgctggatgtgatgggccagcgcttggaggttgcggcgtttaacccggtatttgacgtgacgccggccgacctgatcgatgtgatcgtgaccgaaaaaggcatcgtcgagcggccggatacggccaagttggccaagttgatgtgccgtaagcggctgcattgaggaaggtggcgcctgtgagattgcattcgcgggcaagcccgctcccacatttgaattgtgaacacattcaagtgtgggagcgggcttgcccgcgaatgggccttcaaagtcaacaaaatccttggatctgtaccttgaaaatagcatcaacccacttctgagcccctctcgtccccctcaagcctgtcatccgtcaaattactagcctccatgcgcatcagggggataggtgcgtggcggcgattgtgataacatccggcggtttccagggttgccccgaggggctgcctataacgtgcagatccgtgtcataactcgttgatttgtcgtaagtcgttgtcaggcactctgccggcagcggcgagcttcgttcgtcccataggatgtgacgaggtttcacccgaaaaaggaatcaggcttctcatgggcgaactggccaaagaaatcctcccggtcaatatcgaagacgagctgaaacagtcctacctcgactacgcgatgagcgtaattgtcggtcgggcactgcctgatgcgcgcgatggcttgaagcccgtgcaccggcgtgtgctgttcgcgatgagcgagctgggtaacgactggaacaagccgtacaagaaatctgcccgtgttgtcggtgacgtgatcggtaagtatcaccctcacggcgacactgcggtgtacgacaccatcgttcggatggcccagccgttttccctgcgctacctgctggtagacggccagggcaacttcggttcggtcgacggcgacaacgccgcggccatgcgatacaccgaagtgcgcatgaccaagctggcgcacgagctgctggccgacctgcataaagaaaccgtggactgggtgccgaactacgacggcaccgaaatgatcccggcggtcatgccaacccgtattcccaacctgctggtcaacggctccagcggtatcgccgtgggcatggccaccaacatcccgccacacaacctcggtgaagtcatcgacggttgcctggccctcatcgacaaccctgagctgaccgtcgatgagctgatgcaatacatccccggcccggacttcccgaccgccgcgatcatcaacggtcgcgccggcatcatcgaagcctatcgcaccggtcgcgggcgcatttacatgcgtgcccgctcgatcatcgaagacatcgacaaggtcggtggccgccagcagatcgtcatcactgagctgccttaccagctgaacaaggcgcgtctgatcgagaagatcgccgagctggttaaagagaagaaactcgaaggcatcaccgagctgcgcgatgagtccgacaaagacggtatgcgcgtagtgatcgagctgcgtcgtggcgaagtgcctgaggtgatcctcaacaacctctacgcccagacccagctgcaaagcgtgtttggtatcaacgtggttgcactgatcgacggtcgcccgcgcattctgaacctcaaggatctgctggaagccttcgtgcgtcaccgccgcgaagtcgtcacccgccgtaccgtgttcgagctgcgtaaagcgcgcgagcgtgggcacatcctcgaaggccaggcggttgccctgtcgaacatcgacccggtcatcgccctgatcaaggcttcgccgacgccgtcggaagctaaagaagccctgatcaagatgccgtgggaatccagcgccgttgtggcgatggttgaacgtgccggtgccgattcgtgccgcccggagaccctggacccgcaatacggtctgcgtgacggcaagtacttcctgtcgccggaacaggcccaggccatcctggagctgcgcctgcaccgcctgaccggcctggagcacgagaagctgctggccgagtaccaggagatcctcaaccagatcggcgagttgatccgcatcctcagcagcgccgtgcgcctgatggaagtgatccgcgaagaactggaagtgatccgcgccgaatacggcgacgtgcgccgtaccgaaattctcgatgcgcgcctcgacctgaccctgggtgacatgatcccggaagaagagcgtgtggtgaccatctcccacggtggttatgccaagacccagccgctggctgcgtaccaggcccagcgtcgtggcggtaaaggtaaatcggctaccggcgtgaaggatgaggactacattgctcacctgctggtcgccaacagccacaccacgctgctgctgttctccagcaaaggcaaagtgtactggctgaaaacctacgaaatccctgaagcctcgcgtgccgcccgtggtcgcccgctggtcaacctgctgccgctggacagtgatgaatacatcaccaccatgttgccggtcgaggaatacaccgaaggtcacttcatcttcatggcgaccgccaaaggcaccgtgaagaagaccccgctggaatccttcagccgtcaacgcagcgtgggcctgatcgccctggagctggatgaaggcgacgtactgatctccgccgccatcaccgatggcgagcgtgaagtcatgctgttctccgacggcggcaaagtgacacgcttcaaggaatccgacgttcgcgccatgggccgtaccgcccgcggtgtgcgcggcatgcgtctgccggaagggcagaagctgatttcgatgctgatcccggaagaaggcagccagatcctcaccgcttccgagcgtgggtatggcaagcgtaccgccatcagcgagttcccggagtacaagcgtggcggccagggcgttattgccatggtcagcaacgatcgcaacggccgtctggtcggcgcggtccaggtgctcgatggcgaggaaatcatgctgatttccgaccagggcaccctcgtacgtacccgtgtggctgaagtgtcgagcctgggccgtaacacccagggcgtgacgctgatcaagctggccaaagacgaaaaactggtcggcctggagcgtgtgcaggagccatcggaagttgaaggcgaggagctggaaggcgaggaatttgaaggcgaggtgatcgcagcaggcgatgacaacgttgacgagccaaccctcgacgctgccgcagacgaagaagaaccgcaggaataagcggacacacagggggcggatgaagattcgcccccttgttgtttgtcccctttgaaacacaagtttttgtgcggactcggtccctgtgggagctggcttgcctgcgatagcatcatctcggtatcacgtagctaccgaggtgcctgtatcgcaggcaagccagctcccacaaaggtccgctccagagaaagcgcgttaccgaacatgattgcagccccaaccagagcagagtgagattggatgtgagcaagagagcctataacttctgtgccggtcccgcggcgcttcctgaagcagtcctgcagcgtgcgcagggtgaactcctcgactggcatggaaaaggcctctccgtgatggaaatgagccatcgcagcgatgagttcgtgtccattgccaccaaggccgagcaggatttgcgcgacttgctggacatcccatccgactacaaagtgttgttcctgcaaggcggcgccagccagcagtttgcccagattccgctgaacctgctgccggaaggcggcactgccgactatatcgacaccggtatctggggccagaaggccattgaagaggcctcgcgctacggtcacgtcaatgtggccggcaccgccaagccttacgactacttcgcgattccgggtcagaacgagtggaagctctctaaggacgcggcctacgttcactacgtcgccaacgaaaccatcggcggcctggaattcgactgggtgccgcaagtgggtgacgtgccattggtgtgcgacatgtcctcggacatcctctcgcgcccgatcgacgtgtccaagtacggcatgatctacgccggcgcacagaaaaacatcggcccgagcggcatcctggtcaatatcatccgtgaagacctgctggggcgcgcgcgttcgctgtgcccgaccatgctcaattacaaggtcgcggccgataacggttcgatgtacaacaccccgccggcgtttgcctggtacttgtccggcctggttttcgagtggctcaaggagcagggcggtgtcgccgccatgggcaagctgaacgaagagaagaagcgcaccctgtatgacttcatcgacgccagcggcctgtacagcaacccgatcaacctgaccgaccgctcgtggatgaacgtgccgttccgtctggctgatgatcgtctggacaagccgttcctggccggtgccgacgcgcgtggcctgctgaacctcaagggccaccgttcggtgggtggcatgcgcgcctccatttacaacgctgtcgacatcaacgccatcaaggcgctggttgcctacatggcagagttcgaaaaggaacacggctaatgtctgagcaagaactcaaggccctgcgcgtacgcattgacagcctggacgagaaagtcctggagctgatcagtgagcgcgcgcggtgcgcccaggaagtggcacgggtgaaaatggcgtccctggctgaaggcgaagtgccggtgttctaccggcctgagcgcgaagcccaggtgctcaagcgcgtcatggagcgcaacaagggcccgttgggcaacgaagagatggcgcggttgttccgtgaaatcatgtcgtcgtgcctggcccttgagcagccgttgaaagtcgcgtacctcggccctgaaggcaccttcacccaggcggcggccatgaagcacttcggccacgcggtgatcagcaagccgatggcggcgatcgacgaagtgttccgtgaagtggcggccggtgcggtgaactttggcgtggtgccggtggaaaactccaccgaaggcgcggtcaaccacacgctggacagcttcctcgagcacgacatggtgatctgcggcgaagtcgagctgcgcatccaccaccacttgctggtgggcgagaacaccaagaccgacagtatcagccgtatctactcccacgctcagtcgctggcccagtgccgcaagtggctggacgcgcattacccgaatgtcgagcgcgtggcggtgtccagcaacgccgaagcggccaagcgggtcaagggtgagtggaattcggcggcgattgccggtgatatggccgcgggcctctatggcctgacgcgcctggctgaaaaaatcgaggatcgcccggataactccacgcgcttcttgatgatcggcagccaggaagtgccgccgaccggcgacgacaagacctcgatcattgtttccatgagcaacaagcccggcgcgttgcatgagctgctggtgccgttccacgacaacgggattgacctgacgcgaatcgaaactcgcccttcgcgcagcggtaaatggacgtatgtgttctttatcgacttcatcggccaccaccgcgacccgctggttaaaggtgtgctggagaaaatcagtcaggaagccgtagcactcaaggtgctgggctcttacccgaaagcggttttgtgaggctttaacatgagtggcaacttcctcgccctggctcagccgggcgtgcaacaactgtcgccttacgttccaggcaagcctgtggacgagctggcgcgtgagttgaacctggacccgtcgaagatcgtcaagctggccagtaacgaaaacccgctgggcccaagcccgaaggtattggcggcgattcgtgaagagttggccgagctgacgcgctatccggacggcaacggttttgcccttaaatccctgctggcggaaaactgccgggtcgagctgaaccaggtgaccttggggaacggttccaacgacattcttgaactggtgggccgcgcgtatctggcgccagggctcaatgcggtgttcagcgagcacgcattcgcggtctatccgattgttacccaggcagtcggcgccgatgcgcgcgtgattcccgccaaggattggggtcacgacctgccggccatgctggcggccatcgacgcccagacccgcgtggtatttatcgccaacccgaacaacccgaccggcacctggttcgatgcgcaagcgctgaacgacttcttgcaagacgtgccggagcacgtgctggtggtgctggacgaggcctatatcgagtacgccgaaggcagcgacctgccggatggcctggcttttctcgcggcttacccgaacctgctggtgtcgcgcaccttctccaaggcctatggcctggcctcgctgcgggttggctacggcctgtccacggcggtggtcgccgacgtgctgaaccgcgtgcgccagccgttcaacgtcaacagcctcgctctggcggcggcgtgtgccgcggtgaaagatgccgagtacctggaagaagggcgacgcatcaacgaaagcggcatgctgcaattgcaagaaggcttccgtgagttgggcttgggctggattccgtccaaaggcaatttcatttgtgtcgatctcgctcaagtggccgccccggtgttccagggcctgctgcgcgaaggtgtgattgtgcgtccggtcgccaactacggcatgccgaaccacctgcgtatcaccattggtttgccggcggaaaacagccgctttctggaggcgttggccaaggttctggctcgtggttgatgtcactgcattgcaacctgctgtgcctatgatcggtcgcctggtggtggtcggtctggggttgatcggcggctctttcgccaaaggcctgcgtgaaagcgggctgtgtggcgaagtggtcggtgtggacctggacccgcaatcgcgcaagttggcggttgaattgggcgtggtggatcgctgtgaagcagacctggcgctcgcgtgccagggcgcggatgtgattcagctcgcggtgccgattctggcgatggagaaattgctgggcttgttggcgggcatggacctggggcaggcgatcctgacggatgtcggcagtgccaagggcaatgtggtgcgcgcggcgcaagtggcgtttggcggcatgccggcgcgctttgtgccggggcatccgattgccggttccgagcagagcggggtggaggcgtccaatgcgcagctgttccgccgccacaaggtgattctgacgccgcttgagcagaccgatccggccgccttggcgttagtggatcgcttgtggcgcgagttgggcgccgatgtcgagcatatgcaggttgagcgccacgacgaagtgctggcggcaaccagccatttgccgcatctgctggcgtttggcctggtggactcgctggccaagcgtaacgaaaatctggatattttccgctacgccgccggtggcttccgcgatttcacgcgcattgccggcagtgatccggtgatgtggcacgacatctttctcgccaatcgcgaagcggtgttgcgcaccctggacaccttccgcagtgaccttgacgccttgcgcgatgcggtcgatgccggagatggccatcaattattgggcgtgttcacccgtgcgcgggtggcgcgcgagcatttcagcaagatcctggcgcgccgggcctatatggaaactgctgtgaacgccgatgagcagacctttatcgccaaccccggtggccgcttgagcgggcaaattcgggtgcctggcgacaagtcgatctcccatcgttcgatcatgttaggttcgttggccgagggcgtgaccgaggttgaaggttttcttgagggcgaagatgccctggcgaccctgcaggcgtttcgcgacatgggggtggtgattgaagggccgcaccatgggcgtgtcaccattcatggcgtgggcttgcatggcctgaagcccgcaccaggcccgatctatctgggtaattccggtacgtcgatgcgcctgttgtccggcttgctggcggcgcagcgtttcgacagcgtgttgactggcgatgcttcgctgtccaagcgcccgatgagccgcgtggccaagccgctgcgggaaatgggggctgtgatcgaaaccggcccggaagggcgtccgccgttgaccattcgcggtggccaggcgttgaaggggctgacctatgcactgccgatggccagtgctcaggtcaaatcctgcctgttgctggcgggtttgtatgccgagggtaaaacctcggtgaccgagcctgcgccgacccgtgaccacaccgagcgcatgctgcgcggcttcgggtacccggtgcaagtgcagggcgctacggcgtcggtcgagtcaggccatgcattgaccgcaacgcatattgaagtgccgggggatatttcttcttcggcgtttttcctggtggcagcgtcgattgccgagggctccgagttgttgctggagcatgtcggcatcaacccaacacgtactggggtgatcgatatcctgcggctgatgggcgcggatatcaccctggaaaacctgcgtgaagtcggtggtgagccggttgcggatctgcgcgtgcgggctgcggcgctgaagggtatcgagattcctgaagcgttggtgccgttggctatcgatgaattcccggtgctgttcgtcgcggcggcgtgtgcgcaagggcgcacggtattgcgcggcgctgaagaactgcgcgtgaaggagtccgaccgtatccaggtcatggccgacggtctgctggccctgggtgtgaagtgtgaaccgacaactgatgggattatcattgacggtggactgatgggcggcggtgaagtgcatgcccatggcgatcaccggattgccatggcgttcagcgtggcttccctgcgtgcggcggcgccgattcgtatccgtgactgcgccaatgttgctacatcttttccgaattttcttacactgtgtgcccaagtcggcatccgtgttgcccaagaggctcaattgtgaatatcaaagcaccggtgattaccatcgacgggccaagcggctcgggcaaaggcacgatcgccggcatcctggccaagcgcctgggctggtgcctgctggattccggcgcgctgtaccgcttgctggcatttgccgcacgcaaccatggcgtcgacctgaccaacgaagaatccttgaagctgctggcggcgcaccttgatgtgcagttcgtcggcgcgacggaaggtcatccacagcgcatcatcctcgaaggggacgatgtgactgatgatctgcgtaatgagcaagtcggctcctgggcttcccaggttgccgcgctgccggccgtgcgcgacgctttgctgcagcgtcagcgggcttttcaggagcatccgggcctggtcgctgatggtcgcgacatgggcaccgtggtgtttccggatgccccattgaagattttcctgaccgccagcgccgaggagcgggctcgccgccgctacttgcagttgaagggcaaagtcgatggtgttagtctgtcgagtctgctagatgagatccgtgcacgcgatgagcgtgatacccagcgtgcggtagccccgcttaagccggcggctgacgccatacagctggattccacggagttgtccatcgagcaggtgctggaacgcatcttgagtgaaatcgccattcgcgatatcgccgggtgaccaagaaggctgcaggggaccagtcatagtcctgtggtgcttcttttaattgaaactgacccacaccgtctggggtgtggagatgggcgtattcttcgcccttatcaacaggaattaaaatgagcgaaagctttgcggaactctttgaagaaagcctaaaaaccctgaaccttcaggcaggctccatcatcaccggtgttatcgttgatatcgattaccaagctcgctgggtaaccgttcacgctggtctgaagtctgaagctctgatcccgctggaacagttctacaacgatgctggtgacctgactatcaatgttggtgacgaagttcacgttgctctggactcggttgaagacggtttcggtgaaaccaagctgtcccgtgaaaaagccaagcgcgctgaatgctggattgttctcgaagcagccttcgcagctgaagaagtggtcaagggcgttatcaacggtaaggttaaaggcggcttcactgtcgacgttaacggcatccgtgcgttcctgccaggttctttggtcgacgttcgtccagtgcgcgacaccacgcacctggaaggcaaagaactcgaattcaaggtcatcaagctcgaccagaagcgcaacaacgttgtcgtttcccgtcgcagcgtcctggaagcagagaactccgccgagcgtgaagctctgctggaatccctgcaggaaggccaacaagtcaaaggtatcgtcaagaacctcaccgattacggcgcattcgtcgatctgggtggcgtcgatggcctgctgcacattaccgacatggcttggaagcgtatcaagcatccttccgaaatcgtcaatgttggcgacgagatcgatgtcaaggttctgaagtacgatcgtgagcgtaaccgtgtttccctgggcttgaagcagctgggcgaagatccatgggttgctatcaaagctcgttacccagaaagcactcgcgtcaccgcgcgtgttaccaacctgaccgactacggctgcttcgctgagctggaagaaggcgtggaaggcctggtacacgtttccgaaatggactggaccaacaaaaacatccacccttcgaaagtcgtacaagtcggcgacgaagtggaagttatggttctggacatcgacgaagagcgtcgtcgtatctccctgggcatcaagcagtgcaaatctaacccatgggaagatttctctggccagttcaacaagggcgataaaatctccggcaccatcaagtcgatcaccgatttcggtatcttcattggtctggacggcggcatcgacggcctggttcacctgtccgacatctcctggaacgaagtgggcgaagaagctgttcgtcgtttcaagaagggcgacgagctggacaccgttatcctgtcggttgacccagagcgcgagcgtatctccctgggtatcaagcaactggaaagcgacccgttctctgaatacgttcaggacaacgacaaaggcgcaatcgttaaaggcatcgtgaaagaagttgacgctaaaggcgccatcatcactctggccgacgatatcgaagcaactctgaaagcctccgaaatcagccgtgaccgcgttgaagacgcgcgcaacgttctgaaagaaggccaggaagtagaagccaagatcatcagcgttgaccgcaagagccgcgtaatccagctctccatcaagtcgaaagacgatgctgaagagaaagaagcaatccagagcctgcgcgacaagccagctacctctgaaattgctgctggtcctaccactctgggcgacctgttgcgtgcacaaatggaaaaacagaactaagttctgtcagaccatagaaaaagggcgacttcggtcgcccttttttgtgcctgaaatttgttgaatcaacaacttagaaccaaggcgtgcagtcggctgtcagaactgactatagttttaatgctggctatccccgtgttgctgcttcaataaggatttgaatgaacaagtttattgtcatcttctcaatcgtactgcttgcagggtgctccaccagtgccaagactcatgccaggcatggcgtcagcggcatcgagattgactgttcggggcttggttccaattgggagaagtgcgagaagcgtgctgcccgtgagtgcaagatgcagggctacaaggttgtaacgcgttccagtgacgctaaagacgaagagggcgactacgtgtttggttggaacccggcaggtgcagtgacccgcacgatgctggtgatctgcaaatgaagaggtaaagtactttttgggggcgttaaaccaacctgaagataagttaaagcgtgggctgttcaaattcaccaagtcatgctaaaacctttggagcgcttttcctagctgcttgaaaaagaagggaaaaatatgacgaagtcggagttgatcgaacgaattgtcacccatcaagggctgctttcatccaaggatgtagagctggctatcaagaccatgctcgagcaaatgtcccaatgccttgccacgggggatcgaatcgagatccgtggctttggtagtttttccttgcactaccgcgcgccgcgagtgggccgtaacccgaaaaccgggcagtccgtcagccttgacggtaagtttgtgccgcatttcaaaccgggcaaggaattgcgcgatcgagtgaacgaagacgaggaagagggcgtctgagtggttttagggcaggagtaagttatgcgtgggattaaacgcgtttttctggtgttggcagtgctggctgtcgcactggtggttttagcctttgtgttggaaaaccaacaaggcgtatctctttcgttcttgggttggaccaccctgcaactgccggtggcagtgtatgttgtggctgcgctgatcgtcgggttgatggtgggtccgctgttgtgcgtgctggccagcgctacccgtcgtcacaagcgaacatcgattgcgcgtgagtagcgtcctcttcactgttgcttgcgcctgtaaggtgggttgggggcataggcttccagcatcctctcagtaacgtacgcgttatttgggggcccacaatgaatgcgccccccccttcagtctatcgggtccgccgatatcgcacatttagcccttttcaccaaaaaacagagagctcggaagggctagccctgggcgagcgttataaaatagacgcttcacggttcaaagtgtgccggatatggggtaacatgcggcccgttaatgataactgccatcttgcatcttcattatatgataggtgtgcaggcgttgggcgttcatttgctaaagcaaacactctcgtatctgtatttaactccgcaaatgtatgtgtcccggacaagtgccagggccgaaactaattagatcccgactaagcctatttagcggatcttgcctttaagtaactatctggtttaagccgactattcaaaaaatcttaatggtgagacgaccgtaaacgactttttgcaattcgtcgttgtttgtgcatgagggaatgtctacccgtcccgtgccatatgcacgcgtcagttgagggggattttctaaacattgagctacgtcggccgataatgaggcttgcgatggcgcagggcaggctttccgtggctgaggtaaatgccacaaattgttgcgtggtaaccctgcgctgtggttgccagccgttgtgatccttcgattgatgcttagcccgctgacgcctggcgcgagcggtattcaatcagcaaagctatgacgtgtgatgagtgtctattgcgcaggtttggaacgattatggttgtgttgtacccgtcccagaagggggaagggcaagaattgctctgaaatgattcttcttggtgtgttgcgctcagggcgcaaagcaagggaaaatttgtatgatcaatttttatgctttagatcgcgcataagagcatcgcatgtcatcgtcggtgttggagcggtggttattttccggcgcagtgtcggcttagggctgtacagtgagggcgttagcaaccgttactaaaggtactgatgctcggggtacttatactggagtgcctgcaaaacgagtcagaatagaaagattgattacggatagaagaagaattttagggtgagcttgatgaaaattccatttaacaaaccaccctatacgggtaatgaagatcaatatgttacgcgcgccatgcgcagtgccaagatgtcgggtgacggtgaatttaccattagttgccaacaatggtttgaagaaacattttcatgtgaaaaggccctgctgacgccctcgtgtacccaagcactcgaaatggccgctattttgatagatatacagccgggtgatgaagtgatcatgcccagctttacctttgtcagtacggcgaacgcattcgtgcttcggggcgcgaaaattgtttttgtcgatattcgcccggacaccatgaatatcgatgagacgcttatcgaggcggcgatcaccgcaaagaccaaagccatcgtccccgttcattatgcaggtgttgcctgtgaaatggacgtgattatggacattgcccagcggcatgatttgtttgtcgtggaagacgccgcgcaaggcatgatgtcgacgtataaaggccgttggttgggcacgatcggacatctggcggcctatagttttcatgaaactaaaaactacacgagtggtggtgaaggcggcttgttgttaatcaatgataagcggttcattggtcgcgccgaaatcatcagagagaagggcactaaccgtagtcagtttttccgcgggatgatcgacaaatatacctgggtggatattggcagtagttatttgccgggtgagttgcaagcggcctatttgtttggtcaattggaagaagcgaagaacattaacgatttcaggctcggcatttggcagcgctattaccaagcgttcgctgggttggtcgcggcggggctgcttgaagtgcctacagtccccgaagcgtgtatcgccaatgggcacatgttttatattaaagtaaagaacatcgacgcgcgcaagtcagtgctcagttatctgaacgctgcgggtgtgggggcggtatttcattatgttccgctgcacagtgcaccggcgggtgttttactcggtcggttcaccggcgaagaccggtttacgacccaggaaagcgagcgtcttattcgcctgcccatctggtatggcatgacagagcctgaaatgcagcatgtcatcaattcggtgataggtgcagttgatgccgcgggtcggtgaattgaagggctcaaaccgcagcatgctgttcggcgctttttttacaagcgccgcgcaagcgtcaaagatacttgttggcttctgcatattaaagttaatcgccctgtacctgggggtcgacggactcggcaagctcggacatttcatgagcttagtgtctattgccgtcctcctggcgggaggagggataagccacggtatcataaagtacgtcgcggaatttaaaagcaacccattcaagttatataagttgttctcgacatcggcgttctacgctttcgggttctgcctggtgtcatttgttttactggcggttttttcagcgcgggtgtcaaattttgtatttgggcatcctgaggactactggatcattgtcctgctggcgctcgctcagtttgtatttgcgttcaatacgctgttttcagggttttttaatggccttggaaaacttaaagtcaacgccagtgttcaagtaatggctaaccttgttgtgctgcccattatctggtggctgatttccgccttcggcctgcccggtgcggcaattgccatgttggctatcttcactatgccggcgctcatctctttggtttacctgaagggtatgccgctgttcagaatgttcacgtggcgcaaggtggatgttgcgctgagcaagaagttttccaagtttgggttgatgttgctggtcagtgcactgatgtttcccgtggtcgagatagttatcagggaatcgctgatagcacgggtaggctactccgaggcgggcatctggcaagggagcatcaagctgtcgagcgcgtacatcggttttttcagtgtgtttctggcgtcgtactacatgccgatggtatcggcgacccaggacaaggccgtgatcaaagcgcaagtgataaagtttatgctgttggtgatggcagtgtttttagctggcgcgagcgtgctgtacatagggcgaagtttctttattccggtgttgttgtcttccgaatttcatgagttggaaaattatataatttatcaactgattggcgacttcttcaaagtcgctgcctatgtcataggctttgttgtggtggcgaaagctgcgacgaaattgtacatcttctccgaggtgctgcaggcactgctgtttgttggcttgacgttcaccgtggggcgcgaagtcggcggtgtgtacggcgtgatgtattcttatatgttggcttatataatattttttgtgatttccattgccggttttatctattgggcgcgcaactgatgggtatgcattttaaccttccgttgtatcttgtattcgggtttctagtcgtcgtcgccgcgtgggacatactcagtgagcacacgcggccacgcgcagttgtttctgccctgatgggcgtgccgctggtcctattggctaccttcagggtgcccggtgtgggcaatgacgatcttgcctacctgaaaatgctgcatgaaatcccctcagtgctggagtgcagtaatatttactgcgactacagctatacaacgtttaacatcgaattcggcttctttatgctcctctcaatgctggcggcattagcgaggaattcttatattttgtttggtgtcagttcgctggttgcggtaagtctgaatgtcaggagtattcggtatttctctccttactttgccttgggcatgctggtttattttacgcatttttatcttgcgaaggacctgaacgcgattcgcttgggagtggcgtcagggttagtatttttggctgcgatgtatctccacaaaaaacaatacatgctgttagtattttatcttgcgctggcgatgatggtgcatgtgtcgtcagccatttttatcatgcctgtcgtattgtatttgctcaagccgacacgcgctgtgtacttggtgctcagtgtcgttcttgttttgatggcgtcctttgtcgactcaaaatggttgttaggtcagatggcgttcattagttttatcagtgaaaaaattgacgcctatctaacgactgcaaagtacggctatgcactgccgttctttgatttggtcaacatcaaaaatttattcctggtggccgccgggtgggtgtggtcgaaacaactggagctgcactatcccaccttcaggctggcgttctgcgtcttttattgcgcgacattcttacgaattgtaatgggcgactttgcaattcttgcgggtcgagggtatgcgagcatatcaatgtttgaatatgtactgttacccatgatcgcagtgcacgtgtttggtaaaaagcgtgggtttttaatcgttgctgtttatgctctcggcgtcctctacatgaatttgagtagccatcgggggtggacaggtggctctgaagtattttttgactttttataatttatctcggtgggcgtatgaagaatattttgttcgtgttgggtggcttggccatgggtggcgttgagacctatgttgtcagattggccaagtacctcagtcaggcggggtgtaatgtaacggttacattactttccaataagtgtgatacaggcctgttcaacgaattatctcgctatgctaccgtccatgtcgttgaacgcgtgccgtttttttccgcgtccagttggataaatgcgttgttgccggtaaagaaagatccggttgtatacgacgttgttcatgtcgttgatgtgttgacgttggcgtatgtttttctgaataaggcgcgactgaagttctctttcctcagtgttggtatctatcactcaatggaaatcagttggtggcgggggcgcaatatctatttcagaaagaaaatgctcgagttgtacgatagaaatgtccagttgacgctgttccccaatgagcgcaccgctgagatggccgcggcattttctaatgtagacgtggcgacgctggatgtattgcccctgggcatttccttcgaaaactacagcgctcggcagccgcttcaatcgtctctgcggatcgtctcggtagggcgtttagtcgatttcaaagtttacaataagcacgtcattacgcagttgagtgagctgcgtaaacgcgcaaactttgaatacttcatctacggttcggggcctgaacacgccgcgctggtttcattggcgcaggcctgtggcgtcagtgaatacgtgcattttatgggcgaggtcgagtatgccgagctgcccgccctttttgatggtgcgttttgttttgtcggttcaggtacgacgatcatcgaagcctctgccgccggtattccttctgtggtgggcattgaatccatagcgttgcccttgacctgtgggttgttttcggatgtttcaggatattcctacaatgaagagtcggcgacgacggtgagaatggggattctggaaaccatcgagaagctgcacattatgagtcccgaacaatacaatgaagtgtccgataagcatcgacaaaaagcgaaagcgtttgatattgtcgaaacatcaaaaagatttgtagagctgtctaatcgcaggcccgtttttgacggttcgatgaatcgctgggttgcgatattgtcatttttcaagtccgtaattgtgcaagggcccaaggcgcttaaatcccgatttgatagtgtgggatgatatgtctttgaatattgcgattgtcactcagtatttttatcctgagagctttattatcaatgatattgttgaggagctggcttgccttgggcacacggttgaagtctttaccgggcaacctaattacccggacggtgagacttatcaagactatgatcaaacggcttgcagtgagcaggtgtacaaggacagtgtaaaaatacaccgcgttccgttgaggccgcgaaagtcaggcggtgcccgcaacctgcttctcaactatctctcctttgtgaaaaacggaatcaggtattttcccaagcagggtgccggtaagcagttcgacgcgattattgtctttgcggtctcgccgattaccgccgctattccagccatcgtattgaagcgttccagcaacgctcatttgatggtttgggtgcaggatttgtggcccgagacgcttaaggcgacggggttcatcactaattcgctgctgttgaaggccattggcgttttagtccgttttatttacgccaaggccgacacggtgctggtgcagtccgaggcgtttatttcctcggcgtccaagtatgtggcaaaagacaagctggtctactaccccaactcttaccgtgttcctgccgctcagatagacccttgcgaccgtctgccgctggaggtcagccgattattgtcgtccaatttttgtgtggtcttcgccgggaacctcgggtttgcgcagtccttggaaacgatagtcgatgctgcaaaagcactgcttcatttggactgcaagattgtcgtggtgggcagtggcagccgtttggattggatgcatgagcagaagcgtcaacacaacctgcataatcttgagctcgttgggcgtttgccttcctcggtcatgcctgaactgttttcaaaaagtgaggcgctactggtcacactcaagcgcgaggaaatattcgcgttgaccatacccagtaagatccaggcgtatatggcagcgggcaagcccatcctggccgcgctggatggagagggcgccagaatagtggagcaggcaggtgccggtttgtgttctcaagcagaggacgcagcagcgcttgccaggaacatcgagtcgctctacgaggcttcgccggaaaaaagagccgcctacggggcggcgtcgttcagctttttctgtaacaattacgaaatgaaaacgcagtgccgtcgattggtacagattattaaagaacgaattggcaacctttagagataaaccatgaaaatattagtgttgggcgtgacgggaatgcttggtagtgcggtgttcaagtatctttccaatcacacatcacatagtgttttcggcactatgcgtgggcaaagcggggcagcgtattttgaagaaaagcatcggggcagcttttattcaaatgttgacgttctggattacgagtcgctggtctcggtgtttgaagacaatcgtccggacgtggtgatcaactgcgtcggcttgatcaagcaattagcccacgccaatgacccgctgtcgacgttgccgctcaactcgatgttgccccatcggttgtccaaattatgcaagctggccaacgcgcggctgattcatatcagcaccgattgtgtatttaccggctcgaagggcatgtacctcgagtcggatatctccgatgccgtcgacttgtatggaaagtccaagtttattggcgagttgaatgatcagcctcacgcgatcactttgcgcacctctatcatcggccatgagttagcgagcacggcgtctctggtggattggtttctgtcccaggaagggtcggtaaaagggttcacaaaggctattttttcgggcgtgcctactgcagaactggcgcgcatcattgttgagtatgtgctgccgaacgagcagttgttcggcctctatcacgtctcggttaaccctattgataagttcacgctgctgaatgagatcgccaaggtctatcaaaaggaaattgatattattcccgatgataaattggcgattgatcgttcccttgactcgacacgcttccgtgaggccgtgggttacctcccaccgtcatggccggacttgattcagtttatgcgtgcacagcgatagttaggagttggtatgtttgataataaagtattgatgatcaccggcggcaccggttcttttggtaataccgtgctgaagcgttttctcgacacgcaagtcaaagaaattcgtgtgttcagtcgcgacgagaaaaaacaggaagatatgcgcattgcgctcggcaatgacaaagtcaaattctatattggtgatgtgcgcgattacgccagcatttcccaagccatggtcggtgtgaactatatctttcacgcggcggcactcaaacaggtgccgtcgtgtgagttctacccgatggaagcggttaaaaccaacgttctgggtacggaaaatgtgctcaatgcagccattgccaacaatgtagaacgtgtcgtggtgttgagcaccgacaaagcggtatacccgatcaatgccatggggatttccaaggccatggcggaaaagttggtggtggccaaatcccggatgatcccgcaaggcggcccggttatttgctccacgcggtacggtaatgtgatggcttcgcggggctcggtgatcccgttgttcatcaatcaattgaaacagggcggtgaactcacggtgaccgacccgaatatgacccgcttcctgatgtcgctggaagactccgttgacctggtgctgcatgcattcgaattcgcccagcagggtgatattttcgtgcaaaaggcgccggcgtcgaccgtggcggatctggcgcaggcactcaaggaactcttcaaccgcttaaacgcaattaaagtcatcggcacgcgtcatggcgagaaactctacgagtcgctgatttctcgcgaagagatggccaagtccgaagacatgggccgctactaccgtattccggcggataaccgcgacctgaactatgaaaagtattttgtcgaaggtgaaacgcacatctccgagctggatgattacacctcgcataataccgagcgcctggacgtcgagggcgtcaaagcgctgctgttgaagttggaatttatccaggagcagctcaatgcttaaggttatgacgctggtcggcacgcgcccggaactcatcaagatgagccgcgtgatcgctgagctcgataagcaaactcatcatattctggttcactcggggcagaattatgactatgagcttaatcaggtcttcttcgacgacttggacattcgcaaacccgatcatttcctgggcgccgtgggcgacacagcagcgcagacaattgcacaggtcatcgccaaatccgacgagcttttcgaattggaaaagccggatgccttgctgctttacggtgatacgaatacttgcctggcggtgatttccgccaagcggcgcaaaatcccggttttccatatggaagcgggaaatcgctgttttgatcagcgtgtgcctgaagagctcaatcgcaaggtgcttgaccatttgagcgacatcaatatggtgctgaccgagcatgctcgtcgttatctgcttgatgaaggcgtgcgtcctgaaacaatcatcaagaccggctcgcacatggcggaagtcctggatcactacatgccgaagatccaagcctcggatgttctcgcacgggaaggcctggcagcaggggagtattttattgtcagcgcgcaccgcgaggaaaacgttgatacgcccgacaacctgagagacttgctggcgtcgctgaaggccttggtcgacaaataccaatacccggtcatcgtgtcgactcacccgcgcacccgtaaacgcctcgaggcactgggcgagtcgctggatcatcctttgattcgcttcgttaaaccgtttggcttgctcgactacatcaagttgcagatggaagcgttttgcgtgctgtccgacagcggcaccatcaccgaagaggcttcgctgctgaacctgcctgcggtcaccatccggaacgcgcatgagcgcccggagggcatggatgaaggcacgctgatcatgtgcgggctgaaagctgagcgcgtgcttgatgcggtgcgtgtcgtcacgacacaacacgtgcgtggcgagcgggtaatgtcggtggtcggtgattatcttggcggtgccgtctccaagaaagtcgtgcgcatcgtgcacagctacaccgattacattaaccgcaccgtctggtccaaatcgtaagcaaggagctttgcgtgcacatattcgtgactggggcttcgggattcgtgggaagtcggttggtccaagtgtcagccgcccgcaatgatgttcgcgtcactgttgcagcaagaggcagccgctttacctgtgcaacggctacgcgcgtggttcgattcgatgacctctcgactgcagacttttcggctgaacttgccggtgtggatgcggtggttcactgcgccgctcgcgtgcacgtcatgaacgagctggacgcagacccgctacaggccttccgccatgtcaacgtcgagggcacgcttaacctggctcgccaggccgcagcggccggggtgcgccgatttgtgtttctcagctcgatcaaggtcaacggcgaaggtacagagcccggcgtaccgttcacagcggatcagccagccaaccccgcggatccttacggcgtttcaaagatggaagccgagcagggccttcgggaactggccgtggccaccggtatggaagtggtgatcattcggcccgtacttgtttatgggccaggggtaaaagccaatttcctcagcatgatgcgttggctgcacaaaggtgtaccgttgcctttcggcgccattcataacgctcgcagccttgtggccctggacaacctggttgacctggccctcctgtgcacgagtcacccagccgcagctaatcagaccttcatggtcagcgatggcgaagacctgtcgaccaccgtcctgctacgcaagatggcgtcagcgttgggcaagccggcacgtcttctgcctgtcccggcggttttgctgagcgccgctgcaaggctgctgggcaagcgcagcctttctcaacgtttgtgtggttcattgcaggttgatatcgccaggacgcgcgctgttttggattggacgccgccgctgtcagtggaccaggcgctgaaagtgacagcctccgattacatggaaaatgaaaaaacatgagtgagtggtggatcgttcttgctgttgcattgatttcatttttgatgactgctgtattaagacgctatgcgctttcgcgcagcatcattgacatcccgaatgcacgcagttcccattcggtgcctaccccgcgaggcggtggtgtcgcgattgttctggcgtttctggtgatgatccctgtgttggggtggctggggctggtgggtggcgacatgttgatcgcagtgggaggcgcgggtgcgctggtggccgtcttgggttttatggacgatcatggtcatattgccgcccgctggcgcctggcaggccattttgcagcggcggcatgggcgttgttctggatgaacgggcttgcgccgctgacggtgtttggctgggacctgcacctggggctgatcggcaatatcctggctgcgatctatctggtctggatgctcaacctctacaatttcatggatggaattgatgggatcgccagtgttgaagcgatctgtgcctgccttggcggctgtctgctgtatgcgctgagtggtcatcagggcatgatttggctgccgctgctgttggccgcggcggtcggtgcgttcctggtgtggaatttcccgcctgccaaaatcttcatgggcgatgccggcagtgggtttttgggcgttatcctgggctgtttctctattcaggccgcctgggttaactcttcttttttctgggcgtggttgattttgctgggcatattcgtggtcgacgctacgtttacgcttgtgcgccgcctgctacggggcgataaggtctacgaagcgcatcgcagtcatgcctatcagtttgcttcacgcaagtttggtaaacacctgccggtgacgttggcagtggcggccattaacctcgtttggttattgcccattgcactcggtgttgttctgtatggatgggatggagcgtgggcactggttctcgcatacgtgccgctgttcctcctggcaatcaagtttcacgccggcgagcttgagcgataacggtggcaactgagtcgcacgtgcagccagccttaaagccttcagagggttcatggatggccttacaaaggcaaagtaataggatgttaagaggtgtttgaaaccgctatggataagttacgggcctatttggtcgctttgcccagacgaaaaaaacgactgattcaggtcggcacggatgtgtttgtcgtttgggctgccttgtggcttgcgttcgttgtacgcctgggcatcgatgaattggtcaacccggttcggcttcacctctggttgttcatcgccgctccagtgattgccattccgctgttcatccgcttcggcatgtaccgagcagtgatgcgctacttcggcaacgacgcgttgatcgcgattatcaaggcggtcagcttgtcctcgctcatccttggcgtggtggtttactggtacagcaaccatcaaaatgtggtgccgcgctccattatcttcaactactggtggctcagcctgatcatggtgggcggcgtgcggctgggcatgcgccaatacttcatgggcgactggttttccgcggcacaacatgtgccgtttaccaaccgcgaggatggcctgccgcgtgtcgccatctacggcgcaggttctgccggcaatcagctggtagcggccttgcgaatgggccgtgtgatgcggccggtggcatttattgacgatgattcaagtatttccgagcgcgtgatttccgggctgcaagtgtataagcccaagcacatccaacgcatgatcgacgcgacgggcgcgcaggaaatattgctggcgattccttcctccaaccgcgggcgtcgccgtgagatcctcgggtttcttgaaggtttccctctgcatgtacgcagtgttcccgggttcatggaccttgccagtggcagggtgaaggtcgacgatatccaggaagtcgatattgcagaccttttgggtcgggacacggtgcctgcccagcacgaattgctcgaacgctgtatcaaagggcagaacgtgatggtaacgggggcgggcggctcaattggttcagaactgtgccggcagatcctgacattgcgcccgacatcgttgctgctgttcgaacacagtgagttcaatctgtacagcatcctgtgcgagctggaagagcgtataaatcgcgagtcgttaccggtcaaaatcttgcccatcctgggttcggtgcgtaatcaatccaagttgctggatgtgatgaaagcctggcacgtcagcacggtttatcacgctgccgcgtacaaacacgtgccgatggtagaacacaacatcgccgaaggtgtgttgaacaatgtcatgggcacactgaacactgcgcaagctgcattgcaggcaggcgtggccaatttcgtgctgatctctaccgacaaggcggtgcgcccgaccaatgtcatgggcagtaccaaacgcctcgccgaattgaccctgcaagcccttagccgcgaagtagccccggtattgtttggcgacaaatcgaacgtctcgcgtgttaacaagacccgattcaccatggtgcgtttcggcaatgtactcggctcctccggttcggtgattccgctgtttcataagcaaatcaagtcgggtggcccggtgacggtcactcacccgaagataacccgctacttcatgaccatcccggaagctgcgcagttggtgattcaagccggttcaatgggcctgggcggtgacgtattcgtgctggacatgggcgagccggtaaagatcgtcgaactcgcggagaagatgattcacttgtctggcctgagtgtgcgctcggataaaaacccgcatggcgatatcgccatcgagttttcaggcctgcgccctggtgaaaagctttacgaagagttactcattggcgacaacgtagttgccactcagcacccgatgatcatgagtgccaatgaagatcatctggcctgggatctgctcaagggcaagctgagtgaactgcttgctgcggtggatcaggacgattactcccgcgttcgacagctgctgcgcgacaccgtaagtggctactcgccggacggtgaaatcgtcgatctgattttccagcagcgtcgtttggagccttaaactcacactctgtaacccctgcgtttttgactccttccagacatcgcctaagtttgaaaagcagcttcggaaagctgcttttcttctaacgatgtcatggagcgtcaccaatgcaaaatacctacatctcttccctgatctttgccttcctcaccacgttctcagttgccgccaacgcagcgccctctatcaaacccgaagccccaacccccatcgccgcgcagatgaacaaggccgagcaatccgccaaggtcaacctgaacgccgccgacgccgaaaccctgcgtcgcgacctcttcggcatcggcgcggccaaagccaaggcgatcatcgcttatcgcgaaagcaatggcccgttcacggcagtggatgagttgttggaagttaaaggcatcggcaaggcgttgctggagaagaaccgcgacaggctggcgatcaattgaggatgtgaacgttgccagggaggccggtcattgaccggccttttcagcctctgcaacctgcgccttcaaactggcgcgtaccacgtccaggatgcgcgtcgccagctgcgtactttcgacactgcgggccagtaccagcgcgcccaccagcgtcgacatcaacatcaggctttgttcatcggcattcgcgctgccaagcgccgcctcgacttgtttcaaccgagccccaagtaccgcatccgtggtcgggctctgttggcctttgaggccaagttccgcagacatggtcgttagcgggcagccctgatccggcgaggtctggtgccattcagacaggtagctgtcgataaacgcatccagcggccgttcctggctgaacagcatttcgcaatgcgcatccagttctgcagcggctgcctgcagggctttttccaccaactcgtgtttggatttgaaatgggcataaaacccgccgtgcgtcaggtccagcgctttcatcaacggctgcaggcccgtggcgccaatgccgtcgcggcgaaagcgcaccgaggcttccttgatgatgcgttggtgtgtctgggctttatggtctgacgaataacgcataggactgcctcgtgaacatgcgcgcattttaacgggtaacgctgttttaaacatcccgagaagctcaaccgcgttggcatgaaaagtgattacatcttgcccagtgattgttcaacaatcgtgaggtggtcatgacgctcagcttgtctttagccgatcagatagcgcttgaattgcgtgccgacatcattggcgggcggctgttacctggaatggcgctggtcgaggtggacttggtcaaggcctataacgcttcgcgcaataccatccgcgaggccttgcatcgactggggcaggaggggcttacacgctacgtgcgcaacaaaggtgtgatggtgcggcggttggagcgagacgaggtgcgtgatctgttcgtcgtgcggcgtaccctcgaattgcaggccatcacccagagcggcgcgctcaccgacgctcaggccgagcacatgcaaaacgccattgaagccaccacgctggcccgcgaccgtgaagactggcgcgccgtggcgacgcacagcctggtgtttcaccagcagattgtcggcctgatgcgcagccgattgttcgatgagttcttcgcccaggtcattgcccaactgcgcctggttttttgctccgccattgatgagcaacgcttccagtcgccctggctggagcgagaccgcgagatttacgcgttattggttcaaggggacaaaccggcggcgggtcaagcgatgagcttgtacctggatgattcggagcgcctgacattggccctgtttactcaaccctgatcgaggatcgcagcatgtacaaagactatccggccgcttaccaggtcagtaaaggttcggccctgcaggtggacacggcgttctacgagcgcattcgtgacagggcggacaaacgcacgttggtcgagcagttcgaagtgccgattcgcacgggcagggcatggaaagtgccggccgggcatgtgttccgtgtcaccacgccggtagggccgcaggtcggtgattttaatgtgtggaacgccaacgacccgcgcgaacgcttgtgggcggcgcgcacccgccagttgcaaggcgcgcatgtcagcacccatgaccggctgtggtcgaacctgccgtttttgcggcctttggtcaccatcaccgatgacagcctggcgaactacggcatcgatgaacatggcgggcgcctgcatgatttgcttggcacgcgttgcgacccgtatgtgaaccgcatgctcaccggcgaagactttcaccaccattgccattcaaacctgacacgcgctgtactgccccatggcctgaccgaattcgatgtacatgacgtgttgaatatcttccagtgcacgggcctcaaccacgatgacatgtacttcatgaaagcctgcccggcgcagaagggcgactacctggagttttttgccgaaattgatttgctctgcgcgctgtcgacgtgcccgggtggggatctgtcactgccgatgtgggggccggatgcgcaagacccgctgacggtatgtcgcccgctgggtgtggagatttatcggttggaggatgagttgctcaagggctggagccaacccgagcgtgcggcctataaaggccagcacgggttgcatatcgccaaggcggcgtgggagtagcggcaggttcagcggtcctgggcgtcctttgagtccgcttgggcgttgcgctcggctacgcgtttgcgttgttcgtcggtgagttccaccttgttggcgctgtcacgcagcatcaataaaccaccgacgatcgaaccgatcgcgaccactaaaatcaaccaggcataccacggcatagggctctccttgaggcagcaaaccgtggggaaatttcccacgataatagctgctttgagtaacgggctttcttagtagttcattgtaggcccgttctgctccagtagcctcacagcccggtcaacatcgcatccgccggtgcatcggcgcggtcctgcgcggtcagttggaagtacacaaaccccaccaccatgaagcccaggaaaatcagcccgatcagcgcgttgaaccaggccatggccaccaggcacaccagcgccagtaccagcgcaatgcccggcacaatcgggtagcccggtgcacggaaggtacgctccagcagcggctcggttttacgcagcttgaacaggctgagcatgctcatgatgtacatcacgatggccccgaacacggccatggtgatcatcgccgccgtcagtgtcatgccgcccaggttgatcaggccgtcgctgtagatggccgcgataccgaccacgccaccggcgatgattgcccggtgcggtgtctgaaaacgcgacagtttggccaggaaagacggcaggtaaccggcgcgggccagggcgaagaactggcgcgagtaaccgagaatgatgccgtggaagctcgccaccaggccgaacaggccgatccacaccagcatgtgcagccagccggagctgtcgcccaccacggttttcatggcttgcggcaacgggtcattgatgttcgacagggtgcgccagtcgcccacgccgccggcgaagaacatcacgcccatggccaggatcaccagcgtcaggatgccgctgatgtaggcttttggaatggtgcgtttagggtctttcgcttcctcggccgccatggctgcgccttcgatggcgagaaagaaccagatggcaaagggaatggcggcgaacatcccggcaatggccggggcgctgaaggtgtcagaaccggcccagccattcagggcaaaattgctgaagctgaacgcaggcgcgaccacgcccatgaacaccagcaactcggcgacggccagcacgcacaccaccagttcgaaggtggcggcgagcttcacgccgagaatattcaggcccatgaacacgatgtaggcgccgaccgccgcgtgtttggggtcgagtgccggaaactgcacattcagataggcgccgatagccaaggcaatggcgggcggggcgaagacgaattcgatcaatgtggcgaggccggcgatcaggccgcctttttccccgaaggcgcgacggctgtaggcaaacggcccgcctgcgtggggaatcgccgtcgtcagctcggtaaaactgaagataaagcaggtgtacatggcggcgaccatcagcgaggtcaccagaaagcccaacgtaccggccacgccccagccgtagctccagccgaagtattcgccggaaatcaccagccccacggcaatgccccacaagtgcagagtgcccaaggtgggtttgagttgtgtgttcatcgtgttgcgctccctgaacggtttggaatgattcagggtgttgcagcggccatgccagtgcgccattcattgtcgtaaagacgccgaactgtcgtcgaggagacggtttggcgtttgaaatcttctgtcatcgcaccagttaagtgcaggggcgtttgagctgccgtcatcgcgggcaagcccggctcccacaggggttgcggttacctgtgggagccgggcttgcccgcgatgaggccccaacagccaccaccgacctctgtaaaccccgcataaacccactctttacgccgtctttacgcccggcccccaccgtcgctctcgttcctttacgccactcctgcggacaattgccccacacgcggcaatcgccgcaaaacggagagacttccatgagcgttctggacggggtgtcactgctattggccgtggcgctgttcatttatctgctggttgcgctgttacgcgcggatcggaactaggagcaggctatgcacagttatgactattggctgatcatcgccttctttgccgtggtgctggtaccggcgccgttcctggggcggttttactacaaggtgatggaaggccagcgcacctggctgacgccggtgctgggccctgtcgagcgcgcgtgttatcgcttgtcgggcgtggatgaacatcaggaacagagctggcagaagtacacgctggcgctgctggcgttcaacctggcgggttttgtgttgctgttcgcgatcctgctgttccaggactatctcccactgaacccgcagaaattgccggggcaggaatggaccttggccttcaacacggcggtcagtttcatgaccaacaccaactggcagaactacagcggtgaagcctctctgagctacctcagccagatggtcggcctgaccgtgcagaacttcgtcagcgccgcgactggcttggcggtactggttgcgctctgccgtggcatcgggcgcaaatccaccaagaccttgggcaacttctgggtcgacatgacccgcgccaccctctacggcctgttgccgttgtgcctggtgttcgcgttgttcctggtgtggcagggcgtgccgcaaaccttcgcgcactacgtaaacgccgtgaccctgcaaggcgttgaccaggtgatcccactcggcccggcagccagccagattgcgatcaagcaactgggcaccaacggcggcggcttcttcggcgtcaactcggcgcacccgtttgaagacccgaccgcgtgggccaacctgttcgagctgggcgcgatcatcctgatcccggtggcgctggtgttcaccttcggccactacgtgaaagacctgcgtcagagccgcgcgatcctcggctgcatgctggccctgttcctgatcggcggcgcgacctcgttgtgggccgaataccagcccaacccgaccctgaacaacccggccgttgagcaaaccgcaccgctggaaggtaaggaagcacgcttcggcaccaccggcaccgtgctgtgggcggcggcgaccaccgctgcgtcgaacggctcggtcaacggcatgatggacagcctcaacccgctcagcggcatggtggcactggtcaacatgatggtcggcgaagtgatcttcggcggcgtcggcgccggtatgtacggcatgttgctcaacgtgttgatcgcggtgttcctcgccggcttgatgatcggccgcacgccggaatacctcggcaagaagctgcaggccaaggaagtgcaattgctggtagtgaccctgctggtaatgccgatcggcacgctggtgctgggcgccatcgccgccagcctgccaggcccggccggcgccatcagtaaccctggcccgcacggtttcagccagttgctgtacgcctacacctcggccagtgccaacaacggttcggcgttcggcggcttcagtgccaacaccgcgttccacaacctgatgttgagcctgtcgatgttgcttggccgcttcggctacatcctcccggtactggccctggccggcagcctggcgatgaagaagaccgcaccgattggccagaacagcttcccgacccatggcccgctgttcgtgaccctgttgaccgtgaccattttgctggtgggcggcctgaccttcctgccgacactggcgctgggcccaattgctgaacacctgagtatgggcttctgagggatatgaaaatgaatatgcctgcaaaaaatgcggccccggtccaaacccaggagcctgccaaaaccgccatctctgccttgtggcgcccggcgctgggccaggcgttcgtcaagctcgacccgcgccagctgcaacgctcgccggtgatgctggtggtcgaactgaccgccatcctcaccaccgtgttgtgctttgtgcccgacaccaacgtgccgaccttcgtcgccgtgcaaatcgccgtgtggttgtggttcaccgtgctgttcgccaacttcgccgaagccttggccgaaggtcgcggcaaggcccgcgccgacagcctcaaggccggcagcgaaggcctcagtgcacgtcgcaaagaggccgacggcagcttcaaggtcgtgccggccaccagcctgcgcaaaggcgacgtggtgcgtgttgccgccggggaaatgatccccggcgacggcgaggtcatcgaaggtattgcggcggtcaacgaagcggcgatcaccggtgaatccgcgccggtgatccgcgagtccggtggcgaccgttccgccgtcaccggcaacacccgcctggtgtcggactggctgctgatccgcatcaccgtcaaccccggcgagtcgacgctggaccgcatgatcgcactggtagaaggcgccaaacgccagaaaacccccaacgaagtcgcgctggacatcctgctgatcggcctgacgctgatcttcctgctggtggtggtcaccctgcagccattcgcccacttcgccaatggcagcttgccgctggtgttcctggtcgcactgctggtgacgctgattcctacgactatcggcggcttgttgtcggccatcggtatcgccggcatggaccgtctggtgcgcctcaacgtgatcgccaaatccgggcgtgcggtggaagcggcgggtgacgtgcatgtgttgctgctggataaaaccggcaccatcactttcggtaaccgtcgctgtgccgcagtgatcgccgcgccgggtgtcagtggccgtgatttggccgaaggcgcattgctggcctcgctggcggacgatacggcggaaggtaaatccatcgttgaatacctgcgtgccttgcacccacaggccgagccgaccctggaacaactgacctcggtgccgttcagtgctgaaacgcgcttgtcgggcgtcgactaccaaggccgtgtgttccgcaaaggcgccgtggattcgctgctggcgtttatcggccaacaacgtcgcgacctgcaaccggcactctcgcgggaaatcgacaagatcgcccaaagcggcggcactccactgctggtgtgcgctgacggcaaattgctcggtgcgatccatctcaaagacgtggtcaagcccggtatccgcgaacgtttcgccgagttgcgcaaactggggattcgcaccgtgatggtgacgggcgacaacccactgactgccgcggcgattgctgccgaggcgggcgtggacgacgtgctggccgaagccaccccggagaaaaaactcgcgcgcattcggcatgaacagaatgacggtcgcctggtggcaatgtgtggcgacggcgccaacgacgccccggcgctggcccaggccgacgtcggcatggcgatgaatgacggcacccaagctgcccgcgaagccgccaacatggtcgacctcgacagcgacccgaccaagctgctggacgtggtgcagatcggcaaggaactgctggtcacgcgcggcgcattgacgacgttctccatcgccaacgacgtggccaagtacttcgcgatcctgccggcactgttcgcctcgatctacccgcaactgggcgtgctcaacgtgatgcacttgcagagcccgcagagcgcgattctctcggccattgtgtttaacgcgctgatcatcgtggtgctgatcccgctggcgctgcgcggtgtgcgcgtgcaggcggcgagtgcagcggcattgctgcggcgcaacctgctgatctatgggctgggcgggatcctggtgccgttcgtgggcatcaaggcgatcgacatgctgctgacggcgctgcacctggtgtaacccggatcgttcccacgctccgcgtgggaatgctgccctggacgctccgcgtcctgcgctgataaacgaattgaggaatctgaaatgtccaacatgatccgcccggccctgagcctgctggtactcatgaccctgatcaccggcgtcgcctacccactggtggttaccggtgtcgcccaagtcgcctttccggcccaggccaacggcagcctggtgcgcgatgccgacggcaaagtgcgcggctccagcctgatcgcccaggattttaccggtgacagctggttccacccgcgcccctcggccggcgcgttcgcgacggtttccagcagcgcgagtaaccttggcccaagcaacccggcgttggccacgcgcattttcgatgacgcgaacaaacagctggtgccaggccaagggccggtgcctctggcctcgttgactacctccggcagcggtcttgatccacacttgccaccgcaggcgattgcctatcaactggcgcgggtggcagcggcgcggaatgtgccggtgtctacactgcagcgcttgctggatgagcacatcgaaagcccgctggtgggcccgccggtggtgaatgtgttggcgctgaacatggcgctggaaagtttgtaagcagtggtgccgccatcgcgggcaagcccgctcctacagaggaatgcattccaactgtgggagcgggcttgcccgcgatggcggcctgaaggactccaaataaacacctgaaggaaccgcaaagcatgagcgactccggccgcgccgacgccctgttagccgatctgccacgggacggccgtggccggctcaaagtcttcctcggcgccgcgccgggtgtgggcaagacctacgccatgctccaggccgcccacacccagctgcgccagggcgtgcgcctgctcgccggggtggtcgaaacccacggccgcgccgagaccgaagccttgctcagcggcctgccgcagcaaccgttgctgcgcagcgaataccgtggcgtgatgctcgaagaaatggacctcgacggcctgctcgccgccaagcccaagctggtgctggtggatgaactggcccacagtaacgcccccggcagccgccatgaaaagcgctggcaagacattcaggaactgcttgccgccggcatcaacgtgttcaccacggtcaacgtccagcacctggaaagcctcaatgaccaagtgcgcggcatcaccggcgtgcaggtgcgcgaaaccctgccggattgggtgctgcaagaggccgacgaactcctgctgatcgacctgccatcccgtgagctgctggagcgcttgcgcgacggcaaggtgtatgtgccggaacaggcccgcgcggccatcgatgcgtttttcacccagaccaacctgatggccctgcgcgagctggcgatgcagaccgccgccgcccacgtcgatgacgacctggctcaaggttatcgccaacttggccaggccgcgccggcggtacgcgggcgcttgttggtcggcgtggacggtgatgcgcaggccgaacgcctggtgcggcatgccagccgcgtggcccagcgtcggcatttgccctggagcctggtgcatatcgataacggccgtgcgcgcgatgagcaatcgcgcctgcgcctgcaaaatgcccaacagctggctgagcgcctgggcggcgaagtggtgttgctgcgggccggggaagtggcgaaaacgctgatccagcacgccgccgagcgccgcgccagcctgctgctggtgggccagtcgcgcatgcgctggcggcgtcgtctgttcggcggcgggctggcggcgcgcctgttgcgcaatgcgcgcggcttggaaatcaacgtcctcgacagtgacgacatgcccgcaccgccgcgcctgccggatgtacgcgggctggtgtggttcgattatggcctggcggtggttgcgaccatcgtggcggcggcggtggcctgggcggtggtcagcgtgctaccgctgccgaacatctccctggtgtttctcgcggcggtgttgctggtcggcgtgcgcagcagcctggggccgtcactggtgtgtgcggcgctgtcgtttttgacctacgactttctgtttatcccgccgaatttctccttcgccattcagcgtgaagaagatgtattgacgctgttgttcttcctgttgatggcggcgttgaccggcaacctggccgcacgccagcggcggcagctgcaagccttgcgcgacacccaggaagaaaccagcgaactgctcgacctgtcgcgcaaactcaccgccgccaccgatcgccaggcggtgatcagcgcggcggcgcatcatctcgaaggctggagcgacctggacctgtgcctggtcaaccgtgacagccagggcgactggaaggtcgagaccggttcgccgctgaatcttactgaggccgaacgcgccgccgccgattgggcctggcagcatgatcaaccggccggcatgggcaccggcaccttgccgttcgggcgctggtggtggtggccgctgtcgggcgaggaggggccgctgggcttgctcggcgtcagccccaaaccgggcctggaattgagcggccagcgccgtcgtctgcttaccgccttgagccagccgctagcccaggccttggcgcgggcacagctggcacaggagctggaatccgcgcgcctgcacggcgagaccgaacaactgcgcagcgccttgctcgcgtcggtgtcccatgatttacgcacgccgctgacatccatgcgcggcagtatcgacagcctgctggcacttggtgaggcgattcctttggaggatcgccgcgaattgcttgaaggcacccgcgatgaagccgagcgcctcgaccgttatatccagaacctgctcgacatgacgcgcctgggccacggcgccctgaagctggcgcgcgattgggtttcgccgggtgatatcgtcggcagtgccctcggccgtttgcgtgcggtgctggcgccgttgcaggtgaagaccgacgtgcctgccgagttgccgttgctgtatgtccatgccgcgctgatcgagcaagcgctggttaatgtgctggaaaacgccgcgcgattctcacccgcccaaggccgtttggaagtgagtgcgggcgtggcggatgaccagctgtttttcgcggtggccgatgaagggccggggattcccgaagacgaacgcgcgaagattttcgatatgttctacaccgccgcccggggtgatcgcggcgggcagggcacgggcctcggcctggcgatctgccaaggcatggtcggcgcccacggcgggcgtatcagcgtcgccgacggcattgacgggcggggcacctgcatcagcttgttcctgccgttgccgactcaacctggcctggaacgcgaggcttgagctaccctctttttttcacggattttgattggacaccatgagccagaccgcgacgattttagtcattgatgacgaaccgcagatccgcaaattcctgcgcatcagcctggcctcccagggctacaaggtgatcgaggccggcaccggtaacgaaggcctggcccaggcggcattgagcaaaccggatttgctggtgctcgacctcggcctgcccgacatggacggccagcaagtgctgcgcgagtttcgcgagtggtcgacggtgccggtgctggtgttgtcggtgcgggcgagtgaggtgcaaaaagtcgaagccctggatggcggcgccaatgactacgtgaccaagccctttggcatccaggaatttctcgcccgcgttcgcgcattgctgcgccaggcgccggcaggagaggcccaggaagccgccttgagttttggcccactgaccgtggacctggcttatcggcgcgtgctgctggatggcgccgaggtggcgctgacccgcaaggagtacgcggtgctggcgcaactggcgcggcatccggggcgggtgatcacccagcaacaactgctcaaggatatttgggggccgacccacacggaagacagtcactacctgcgtatcgtggtggggcatttgcgccagaagctggcggatgacccgacgcagccgaggtttattgtgactgaggcgggggtggggtatcggttgttgaatggctgagattatcggtgcctggactggcctcatcgcaggcaagccagctcccacattttgaatctattcacctatcaaaggtgggagctggcttgcctgcgatggggccctcagccccacccaaaatttcagctctgctcactctcatatttgtccagcgtatccctggcaatctcccgccccagcgcgatcaattccggcgccttgtagaactcgaaaaaccggcacacgcgcttgggcacgttgatcagcacatccggcggatacccggcgatcttgtattgcgccagcgacgtctgcatcacctcgaaactctggttgatcaagtccagcagcgacgccggcccgacgttgtcgatgatgaacgaaccggtcgccgacttcggtgccccggctttttccggcgcggcggcgggttgctgggattcgggctcggccgattccagccaggggttaatctccgccgtctgggcttgcagtgcctcctgctccagcttcatcaactgttcggcttgttttcgtcgaaacggcaagtgtgagcccaacgacttggccaagctgttgaagcggctcttgaacgcaggcgggcgctggatcaccggcagttggtagtgtttttgattggtggcgttgaggttgacggcgatgatcaagtcgcagtggctcgacaccaccggcacgatcggcagcgggttgagcaggccgccgtcgaccagcatgcggttgccctgcatcaccggcgtgaacaggctcgggatcgccgccgatgcccgcatggcctggtgcaggcagccctcctggaaccagatttcctgctggttggtcaggtcggtggcgacggcggtgtagggaatacgcagctcttcgatattgatctcgccgacgatcttgcggatttgcccgaagactttttcgccgcgaatggcgcccaggcgaaaactcacgtcgaccaggcgcagcacgtccaggtagtcgaggctttcgatccagttgcgatactcatccagtttgccggcggcatagattccaccgaccactgcacccatggagcaaccggcgatacaggcgatgtcatagccgcgccgttcgatctcctcaatcacaccgatatgggcgtagcccctcgctccaccggagccgagcaccaaggcaacacgcttattcatggtccatgtccttgccaagtcaggtgcccacaatgcacccattgagggggcggcttcaatcttcgccgagccttgtaatatttttccagaatagcgagcaggctcgggtatgctctgacgataggcgcttctgatttcaggcggcaaacaaggcacttttccttgcgggcaacgtctacaccgtacgactgttttcctttatttgaggtgtcattgatgaaagcctggatgtgtgtacctgtgatcgtgttggccttggccggttgtgccgggaaaaccgcataccgcgatagctgtggcactcaattggatgcggcgtggcatgaactggacttggccaaggccgaaggttttgccggcaccgtgagctactccaaagccttgtccttgttgacgggcgccaagacccagcagcaattcgaagcgtttgaaggctgctccaacaaggccgaaaaagcgaggttctatattcgtgagtcgcgcgccggtcgttaacctgtagcacccaccaggatttttcatcgtcaagggagcaaggaatgtcagctttggtcgatcagttagtcgctcaggtcattggcctggaagtagggttactgagctgccaggctcgccttgccgccgtcaccgacgatgaagccttgcacgacttgcgcactaccgtgcggcgcctgcgcagtttgttgcgcccattgcgtggtttgccgggtgtggaacagctcgagttggccgccagcacggtcggccaattaacgacgccgctacgcgaccgcgaggtcctggcggcgtatctgcatcagcacggttatcacgacgcggctgatcggcgcctgcgcctgcaacccgatgcctatcgccaagtggcgcaaagcccggagctggcgcacctgctgctgatcctcgatgcattccctcgctttatccgcgcctcccaacaccagaagttactcaagggcctgcgcccgcgcatcgaaaagcgcttggccaagcaatggcagaaactgggtgaagcgcttaaagacccgaaccacgatcgccatcgtctgcgcctgctgatcaagcgcgtgcgctacgccgccgaggcttatcccgaactggacaagctgcctgccaaagccgtgtcgcgactcaaacaagctcaaggtgcactgggtgattggcacgactgctggcagtggctggcccaggccgggcaccaagcggatttgcagccctgcgtgcctgtgtggcatcgcaccatgaccaaggcggaaagccaggccgatcgagtgctggacaaactcagcgcggattgtttctaagccggtccggcttttggccggaataggcgctgtacctcaccggcgcgatggttaagatcccttatcggttttcttgatgtgaggtcgccatgcgctttagtgatttgctcgacgctgcccgtcgcaacccgttggacgtcaccatcccggccgaatgggcccaaggccgcgcgacctttggtggcctggtggccgcgctgcaatacgaagctctgcgcgcccaggtgccggcagatcgccctttgcgctcactggccgtgacctttgtcggcccggtcgcgccggacgtacctgccagttatcaagtcgaagtgctgcgtgaaggcaaggctgtcagccagttgctgggccgcgtggtgcaaaacggcgaagtggcgacactggtacaggccagctttggcgcgtcccgcgagtcagtgattgatgtcgcaagcgaaccaccgccgacttttaaacattgggatgaatgccaggaactgccctatatcaagggcgtgacccccgaattcatgcgccatctggccatgcgctggagcgtcggcgggctgccgttcactggcaataaatcgcgcgatatgggcggctgggtgcgcctgcgcggtgatgtgaaggaagagccgctgaccgagtcgcacatcctcgccctggtcgacgcctggcccccggctttactcccgcacctgaccaaaccggcaccgggcagcacgctgacctggaccatcgaatttatccagccactgcaagacctgaccacgctcgattggtgccagtactacgtcaatatcgaacacgcccgcgacggttacggccatgccgccgccgcactctggagcccgagcggggagctgatcgccatcagccgccagaccgtggtggtctttgcctgagcctcagaaccgctggctgccttgagcttccagcttacgaccgtggcgctgaagcgccacgcctgccaacacgccgatcacgccgacggcaaaactggccaggctcaggctgaaaacgccggacgccatcaacagaaacccgatgatcagcagcggtacggcgattaattgcagccccaggttggtcgggtgctgatgggtttctgggtgaatgcgccattgccaggcggggaagttggggtgacgtttgcccatgatggtgaatcctctgtccgttgaaacaacatggggagagtttaggtgggggg

SEQ ID NO: 27 - DNA, 271890 bp, Pseudomonas poae FL10F
aactggttatgcctgatgtgccgaggtgcctgcatcgcaggcaagccagctcccacagaaaatcagctctgcttttggcctgcttttgcttcaaccactcaggtcggctattaggcagccgtgctcccacattttgagctcagtacatcaggtagacgcgtgtactcggtcaaatgtgggagctggcttgcctgcgaaggcatcaactggttatgcctgatgtgccgaggtgcctgcatcgcaggcaagccagctcccacagaaaatcagctctgcttttggcctgcttttgcttcaaccactcaggtcggctattaggcagccgtgctcccacattttgagctcagtacatcaggtagacgcgtgtactcggtcaaatgtgggagctggcttgcctgcgaaggcatcaactggttatgcctgatgtgccgaggtgcctgcatcgcaggcaagccagctcccacagaaaatcctgggtgtgtcaggggttgaggcggcagccttggcgatcacctagccagcgcgccgtgtgcgtgcgccccaacccactcgccgtcacttcactgcgctccgggttgtcgctgaatgcgctggtcggcacgtattgcttcacataacccaggcaatactcggcgggattgttctgcacataccggcacgagcagtactccttggccgtgtacgccgcgatgatgtcggggaaggcttgcaggttgacgcgttcatgccacacccaacccagcagggcgagtaacagcagcagaaaaacgctgataaacggatgacgacgaatcatggttgcaccgccgcaagcacgcgtttgagcagttcgttgtggcggtacgtgccgtcgcggtcatcgccgtaacgcacgatcaccaggtgttcatcgggcagcacgtacagcgcctggccccagtggccgagggcggcgaaggtgtcggcgggcgcgtcgggccatggttttggggcgccctggttgagccaccattgcccgccgggcacggcttcgtcctggccggttttgtacttgtcgaagggttggcggttgaaggcgacccattccttgggcagcaactgctgctcaccccagcgaccgtcgcgcgccatcaacaggccgacgcgcgccaaatcgcgggcggtgaggtaggcgtaggaggaggcgacgaaggtttcgtcggcgtcggtttcccaggtggcgtcgtgaatgcccagcggcttgaacagcgcatcccacgggtagctcatataggccttgtggccgagcatgcctttgagcgcggcggagaggatgttgctgtcgccgctggaataacggaaggcctggcccggtgcggcggcggcttcggtgtcggcggcgaactcggccatgtcggcgcggccacgggtgtagagcatcgccaccaccgaggatttaagcggcgcgtattcgtagtcttcctgccagtccaggcccgaggcccagtgcagcaggtcggccagggtcaccttggggtgctgtttcatcggcgggtagaagcgtgcggcggggtcggtgagtttgaagcggttttcgccgtaggccacaccgagcacggtggccatcaggcttttgctgacggaccaggtcaggtgcggcgtgctggcggtggtaggtgcggcgtagcgttcgtagatgatctcaccatcgcggatcaccagcagcgcgtcggtgcgaatgccttggcgggtggcgtcgtcacggggtggaaaagcgtagctatccagagcatcgacagcgggtccagagagcgtcgcacccctggcccagtccttgtcaggccaggtttcggcatgggcggcgacagtgacaaacagcagggcaacgcacaacaagcctcggaccatggacgcaaactcaagggggcattcaagcccgcgagcctagcccggaaaagtgacaagttagcgacagcgatcctaccaggcgggcaaggttttgctgaaaaagccggtcatggcttaaacgcatacgcttgatagatcgaagtggtgggcggcgtcccgccctttttcccccagcgctcctcatgcccatcagcggcaaactcaatatggctgccagactggaacatccccatcctgccgttaaccagttcgtggatcgacacgggctccacctgctcccataaccccagccgcctgaaggcatattcagcgctactgccgccactgcacagcaccttcagggcctgactgtacgttccatacccagcctccaggtaacgcttggcgctgaccgcaaacaggaaattggcgtacagcaacgtcgtagggtcctcgcctttgaaacctgcggcggcggcggcctgtttgagttcttctctgctcaggtacgtcgactcgccgtttctcaggacaatctgaaagccatcggctgtttcttttacggacttgaacacatccagcgggcttttgccgaattgcatcatcgccagcttgatcaccgcgatggccaggcagttatcggccccccactggctgaagtccccccaaatattctcaggtttgccccttgggtagtcgtgtatccagcggtagtcatacagctgcgaaccaagaatgaccgggcgattgctcatttttgtgccatagctgcggccgtcctgagggttcactccggtcttgccgtcaaggggtgaaccctgcaaaggcccgccgccttgagcatcccattgcgcgggagggagggtccactcgattgaattcggcatgtctttttccctattgaacaaacgtttttcggcatatctgcatcagcatcccatcgtctaattggtggacgggcgcaatcgagttccacccaaacctggtgccgacctccgaggcctgtcatccaaccgtcaccgtaacttcatggtgctgacaccgagcctacctagcctgagtttggacaaacaagtcgaccggccggtacgtggccggcactcggagattcgccatgactcagatcgcccgcatcagcgacaccggcaatgaacgccgtctgcaagccgaacgcctggttggcgcacaggcgctgcaggaagcccaggccctgcggttcaacgtgttcagcggcgagttcaacgccaagctgaaaggcgcggaactgggtctggacatggatgactatgatgttcactgcagccacatcggcgtgcgcgatttgaacagcggtcgactggtggccaccacccgtctgctcgaccaccaggccgcgagtaccttgggccggttctacagcgaagaagaattcagcctgcatggtttgctgcacctgcaaggcccgatcctggagatcggccgcacctgcgtcgacccggcttatcgcaacggcggcaccatcgcggtgttgtggggcgagttggcggaagtcttgaaccagggcggctacagctacttgatgggttgcgcgagcatcccgatgcacgacggcggcatccaggcgcacgcgatcatgcagcgcctgcgcgaacgctacctgtgcaacgaacacctgcgcgccgagccgaaaaagccgctgccggcgctggacctgccgaccaacgtgatcgccgaaatgccgccgctgctcaaagcctatatgcgcctgggcgcgaagatctgcggcgagccgtgctgggatgaagatttccaggtggccgacgtgtttatcctgctcaagcgcgacgagctgtgcccgcgttacgcccgccacttcaaggcggccatgtaatggcccgcctgcgagtgtacgggcgcattgcccgggtgctgctggtggtggcgctgggcttgagcatggccagtgtgtttggtgtgttcgagcgtttgggcgtggcgaattcgatggtgcggcgccagcgttggtcgcggtttttcatggcgcggctgaccaacgccctgccctttcgcgtgacggtgcacggtgagctgccaaaaacgccgatgctgtgggtgagcaatcacgtgtcgtggaccgacatcccactgctgggcatggtcacgccgctgtcatttttgtccaaggccgaagtgcgcacctggccggtggccggttggttggcagccaaggccggcagtttgtttatccgccgtggttcgggcgacagccagttgatccgcaagcagatgactcgtcacctggagcaacagcacccgctgctgatgttcccggaaggcaccaccaccgacgggcgcagcctgcgcaccttccacgggcgtttgctggccagtgcgattgatgccgatgtgtcgctgcaaccggtggcgattcgttacctgcgcgacgggcaagtggatgcgctggcgccgtttattggcgatgacgatttgctctcacacctgatgcgtttgtttgccaacgaccagggcgatgtggaaatccatgtgctcaagccgattgcctgcgccgggcaggagcgcgcggcactggcgttccaggcgcaacaggcggtgcagaaggcgttgtttgggccgttgccggaggcggagcaggtggcggcgcggccagcattcgcggcctgatatgaactgaacaccggttcaaatgtgggagctggcttgcctgcgatagcggtgggtcagccccagctctttcaactgacagacggctatcgcaggcaagccagctcccacagttaggtctcagttgtcagttggagctgtgcgaatttctgcaattctggatagaacacccggaaatcttcactcagcggttcatacaacacccgcaactcctgcatcgcatgccttaattcctcaggctgcgtcagccgccgcgaaatcccgcgcaacacctgctccatcaccgcgaactcgcggtacgaacccagccaatcatccgccgccatgtacggcgcgatctgcgccagccgccccggcaactgcggttcggcggccagcacgcggtatacctgggcggtgaaacgctccagtggctggtcggcatacagcgcccaatcccgcgccaggcagtgatcgaaaaacacatcaaggacaatcccggcgtagcgcttgcgagtcaggctgaagcgtgacaacgcctcgccgaccaacgggtggctgtcggtgaaacggtcgatggagcgatgcagctggatggccgactcgatttgcgggctgtactggccctgcagccgacctttgacgaagtcgccataaaggctgcccagcaattgcgcaggaagttggccgcccaggtgcagatgtgcgagataattcatgccgcgcagtctaccactgccgaatccgtatcgttataacccgatataccgaaatagcctgacctaagatcaaaagcatattggtgtatcgagatataacgatttaaagttcgcctcatcgcgatataacgttttacgacaccgagcccatgccatgtccattgacctcgacgaaataataaaagccctggcgcacccagtacgacgagacattctcacctggctgaaagacccgaaagtgcagttccccgagcaagtgcaccaccacgaatacggcatctgtgccgggcagatcgaccagcgctgcggcttgtcccagtcgaccgtgtcggcccacctggccacgttgcaacgggccgggttgatcagcagccagaaggccgggcagtggcactttttcaaacgcaatgaggaaacgattcaagccttcctcacggcgctcacaactgaactcagcgctgaaatcatcgaaccgctgtaaccaaggaaacgataatgcccctctcgctactcatactggccctgagcgccttcgccatcggcaccaccgagttcgtcatcatgggcttgctgcccgatgtggcggcggacttgggcgtgtcgatccccggcgccggctggctggtcaccggctacgccctgggcgtggccatcggcgcgcctttcatggcactggccaccgccaagctgccacgcaaggccgccctggtagcgttgatgggcatcttcattattggcaacctgctctgcgccctggccagtgactacaacgtgctgatgtttgcccgtgtggtcaccgcgctgtgccacggtgcgttctttgggattggttcggtggttgccgccaacctggtgccggccaacaaacgcgcttcggccgtggcgttgatgttcactggtttgaccctggccaacgtgctgggcgtgccgctgggcaccgcactgggccaggaagccggctggcgctcgaccttctgggcggtgacggtgattggtgtggtggcgttgatcggcctgatccgctttctgccggccaagcgtgacgaagaaaaactcgacatgcgcgccgaactcgctgcactcaagggtgccggcatctggttgtcgctgaccatgaccgcactgttcgccgcgtccatgttcaccctcttcacctacgtcgcgccgctgctgggcgacgtcaccggcgtgtcgcccaaaggcgtgacctggaccctgttgctgatcggcctgggcctcaccgtgggcaacatcatcggcggcaagctggcggacaaacgcctggcggccaccttgatcggcgtgttcatcagcatggcggtggtctccacggtactgacctggaccagcgtcgcggtgatcccgactgaaatcaccctgttcctgtgggccaccgcctcgttcgctgccgtcccggcgctgcagatcaacgtggtgaccttcggtaaggcggcgccaaacctggtgtccacgctgaacatcggcgccttcaacatcggcaacgccctcggcgcctgggtcggcggcagcgtgattgcccacggcttcggcctgaccagcgtgcccttggcggctgccgccctggcgatcctggccctgctggtgaccctgattactttccgtcagagcggcgatgccgacctggcccctgcgaccaactgatcaatccacttaaagagaaaggtgttatcccatgacgactattttcgatccgatcaaactgggcgacctggaattgtccaaccgcatcatcatggcgccgctgacccgctgccgcgctgatgaaggtcgcgtgccgaacgcgctgatggccgagtactacgtacaacgcgcctctgccgggctgatcctcagcgaagccacgtccgtaacgccactgggcgtgggctacccggatacgccgggcatctggtccaacgaccaggtacgcggttgggctaacgtgaccaaagccgtgcacggcgcgggcggcaagatcgtcctgcaactgtggcacgtcggccgtatctcccacgagtcgtacctgaacggtgaaaccccagtggcaccgagcgcaatccagcctaaaggccacgtcagcctggtgcgcccactggccgactacccgacgcctcgcgccctggaaaccgctgaaatcgccgacatcgtcgacgcttaccgcgtgggtgccgaaaacgccaaggctgccggttttgacggcgtggaaatccacggcgccaacggctacttgctcgaccagttcctgcagagcagcaccaaccagcgcaccgacaactacggcggctccctggaaaaccgtgcgcgcctgctgctggaagtgactgacgccgccattgaagtgtggggcgccggccgtgtcggtgtgcacctggcaccgcgcgccgattcccatgacatgggcgacgacaacctggcggaaaccttcacctacgtcgccagcgaactgggcaagcgtggcattgcattcatctgctcgcgtgaaaaagaagctggcgacagcctcggcccacaactgaaaaaagccttcggcggcgcgtacatcgccaacgaacgcttcaccaaggacagcgccaatgcttggctggcctccggcaaggcagacgcggtggccttcggcgtaccgtttattgccaaccctgacctgccggcgcggttgaaggccgatgcaccgctgaacgaagcgcacccggaaacgttctatgccaaaggcccggtcggttatatcgactatccaaccctggccctgtgatgtaaccagctgaaacgaaaaagccccggttcgcaggaaccggggctttttatcgcctgtttgatcgttcccacgctctgcgtgggattgccgccctggacgctctgcgtctgctccttaagcgtgacgcggagcgtcacaggaggcgttcccacgcagagcgtgggaacgctcacacaaaggctgggaaacattccttcacaggcttgcaacaatattgctacaaaatacttagccggctacctatcaaccgcccgccagcccgtatataaagtcaccccaccgatcaaccgaagggacgattgactgtctctggtctttactgttgacacaactggatgcaattacgcattttgtcttaattgcgcaggctggggctcaagcgcagcatgtccagccctgcatcaacccagcgttcggcgtcctgatgcagttgaaagctgtcggggaccagtagccactggccaatcaggccgtggatgaaggcatggatgcacaccgcaccacgggtggtgtccaggttttccggaagttgcccgcgatggaccgcgttgcgcaaggtcaggccgatacgcaggttgcactcaagactgtgggtttgacgttggcgccgcatgtcacacatttcatcggtgaactcgcacttatgaaacaggatttcgttgatgcgccgggttttcgggtccagggccacttgatgataaagacggatcaacagcttgcgcatacagcccagcgggtcgacttcatcctcgctttcactggcccgggccaattcgtccaggggttcgtgcagcgtgtcgagcagtgcctgcagcaaatcggacttgttgctgaaatgccaatagatagcgccgcgcgtcacgccggccaacgcagcgatgtccgccagcgtggtgcgcgcaacgccgcgctcataaaacgcctgttcggcggcgtcgagaatctggctgcgcgtttcctgagcttcctctttggtgcgacgaaccatggcagtaaaacctcaatcagaacacttgggactatcggtaacgcagctttaataggcgctaacgatcatctgaataattgtgggacgacaccgtcatgggcgccgaacgtactaaaatcgaggctttggcagctgctttgtcaacaatctgcgaagcctgtcaagagtttacaaacaaccatgaacgtaagtatattgcgtagcaagctacttatctactcacagcttgttttttacccttccacacttcttgtgcgcattctgcgcgcctgacccgaggatcttcatgcaacttaagccagctgttaccgctctggtcactgccgtcgccctggcatcgctgctcagcggatgtaaaaaggaagaggcggctccgcccgctcaaacccctcaggtcggcgtggtcaccattcaaccgcaagcctttaccctgacctccgagctgccgggccgcaccacggcctatcgcatcgcggaagttcggcctcaggtcaacggcattattctcaagcgcctgttcaaggaaggcgccgacgtgaaggaagggcaacagctctaccagatcgacccgtcggtgtatgacgccaccctgaaaagcgcacaagcaagcctgacccagaccaagtcgatcaccgaccgctacaagcagttggtcgatgagcaagccgtcagccgtcaggaatacgacaccgccgtcgccaaccgcatgaccgcggaagcaaacgttcaaaccgcccagatcaacgtgcgttacaccaaagtgttcgcgccgatctccgggcgtattggccgttcttcggtgaccgaaggcgcgctggtcagcaatggccaggccgacgccatggccgttatccagcaactggacccgatctacgtcgacgtcacgcagtcctcggctgaaatgctgaaactgcgccgcgacctggctagcggtcagctggaaaaagccggcgaaaatgctgccaaggtcaagctgaccctggaagacggcacgccttacagccaggacggcaagctggagttctccgaagtgtcggtcgaccagaccaccggttccgtgaccctgcgcgccgtgttcccgaaccctgaccacaccctgctgccgggcatgttcgtacacgcccaactgcaagccggtgtgaacagcaaggccatcctggctccgcagcaaggcgtgacccgtgacctcaagggcatcccgactgcgctgatcgtgaacaaggacaacaaggtcgagcaacgtcagctggtcgccaaccgtactgccggcgcctactggctggtggaaaaaggcctcgacgccggtgaccgtgtgatcaccgaaggcctgcaattcatcaagccgggcatcgaagtcaaggtcaaggacgccgacaacgccaaacccgccggtagtgcagcagcgcctgctgccgctgctggtcaaggggagtaatccatgtcgaaattttttatcgaccgtcccattttcgcctgggtaattgccctggtgatcatgctggtcggggcactgtcgatcctgaagttgcccatcaaccaatacccggccattgcgccgaccgccatcgacatccaggtgacctacccaggcgcgtccgcacaaaccgtgcaggacaccgtggtgcaggtgatcgagcaacagctcaacggtatcgacaacctgcgttatgtggcctcggacagtaactccgacggcagcatgaccatcaccgcgacgttcaaccagggtaccaacccggacatcgcccaggttcaggtacagaacaagctgaacctggcgaccccactgctgccgcaagaagtgcagcagcaaggtatccgcgtaaccaagtcggtgaagaacttcctgatggtgattggtctggtgtcggaagacggcagcatgaccaaggacgacttgtccaactacatcgtgtcgaacatccaggacccgatctcccgtaccgccggtgtgggtgacttccaggtgttcggttcgcagtacgccatgcgtatctggctcgacccggccaagctcaacaactaccagctgacgccggtggatgtgagcaacgccattcaggcgcagaacgtccaggtggctaccggccaattgggcggcctgcctgccctgcccggcactcagctgaacgccaccatcatcggcaagacgcgcctgcaaagtgctgacgagttcggcaagatcctcatgaaggtgaatgctgacggctcgcaagtgcgtctgcgcgacgttgcccgtatcgaactgggcggccagaactacagcatcagtgcgcagttcaacggcaagccggcgtccggcatggcgatcaagctggcagccggtgccaacgcactggacaccggcaaggcgatccgcgccaccgtggcatccctggaaccgtttttcccgccaggcatgaaggcggtggtgccgtatgacactaccccagtggtgaccgaatcgatctccggtgtcgttgacaccctggtcgaagcgattgtgctggtgttcctggtgatgttcctgttcctgcagaacttccgcgccaccatcatcaccaccatgaccgtaccggtggtactgctgggtaccttcgggatcctcgcggcgttcggtttcaccatcaacaccctgaccatgttcggcatgatcctggccatcggcttgctggtggacgacgccatcgtcgtggtggaaaacgtcgagcgggtaatggccgaggaacacttgtcgcctaaagaggcgacggtcaagtccatgggccagatccagggcgccctggtgggtattgccctggtactgtcggcggtactgttgccgatggcgtttttcggtggttccaccggtgtgatctacaagcagttctccatcaccattgtttcggcgatggcgttgtcggtactggttgccctgatcttcaccccggccttgtgcgccaccatgctcaagccgattgatccggaaaaacacggccaacccaagcgcggcttcttcggctggttcaaccgcaccttcgacagtgccgtgctgaagtacgagcgcggcgtcggcaacatgatcaagcacaagctgccagccttcctggtgtatgcgctgatcctggccggcatgatctggatgttcacccgtattccaagcgcgttcctgcctgaggaagaccagggtgtgatctttgcccaggtgcagacgccggtgggttcttcggctgaacgtacgcaaaaagtcatcgacgacatgcgcgccttcctgctgcacgacaaggaaggtgagccaggcgaaggcaaagccgtgaagtcggtgtttaccgtaaacggcttcaacttcgctggccgtggccagagttcgggcctggcgtttgtgatgctcaagccatggggcgagcgtgattcgacacagtcggtgtttgaagtggccaagcgtgcccagggttacttcttcggggccttcaaggacgccatggtatttgccatcgtgccgccttcggtactggagttgggtaacgccaccggtttcgacgtgttcctgcaagaccagggcggcgtcggccacgacaagctgatggctgcacgtaaccagttcctcggtgcggcggcacaaagcaaagtcctggcgggcgtgcgccccaacggcgtgaacgatgagccgcagtacgagctgagcgttgacgacgagaaagccagcgcgcagggcattagcctctcggacatccagcagaccctggcgattgccctgggtggcagctacatcaacgacttcatcgaccgtggtcgtgtgaagaaggtgtatgtacaaggtgatgccgccagccgcatgtccccggaagacctggacaaatggtacgtgcgcagcaacgacggcaagatggtgcctctatcggccatctcgtcgggcaagtggatcttcggttcgccgaaactctcgcgctacaacggtgtagcggcgatggaaatcctcggcaccccggcgcctggctacagtactggtgacgcgatggcggaagtcgaacgtatcgccaaggacctgccggccggtgtcggttactcctggaccggtctgtcgtacgaagaacgtctgtccggttctcaggcacctgcgttgtacgccctgtcgctgctggtggtgttcttgtgcctcgcggcactgtacgaaagctggtcgatcccgatcgcggtgattctggtagtgccactgggtgtgatcggtgcattgatcgccaccagcctgcgcggcctgtccaacgacgtgttcttccaggtgggcttgctggtaacggtgggcctggcggcgaaaaacgccatcctgatcgtggagttcgccaaagagcttcacgaacagggcaaaggcatcgtcgaagccgccatcgaggcgtcccgcatgcgtctgcgcccgatcatcatgacgtccatggcgttcatgctcggcgtactgccgctggcgatttccagcggtgcaggctcaggcagccagcacgccatcggtacaggcgtaattggcggtatgatcaccgccaccgtcctggcgatcttctgggtgccactgttctacgcaaccgtgtcgtctgccggcgagcgcaacaaaaagccggacactactgaaactcctaaagaggctggccaatgagcaagtcgctactttccctagccgtcacggcattcgtgctcagtggctgctcgctgatacctgactatcagcgccccgaagcgccggtggcggcccagtacccgcaggggccggcgtattcgtcggcccaggcgccgggccaggccgctgccgagcagggctggaagcagtttttccatgaccctgccctgcaacagctgatccagaccgcgctggtcaacaaccgtgacctgcgtgtcgcggccctgaacatcgacgcctatgcggcgcagtaccagatccagcgtgccgacctgttcccggctatctcggccaccggcagcggcagccgtactcgtaccccggccaagctctcgcaaaccggtgaagcgggcatcaccagccagtactcggctggcctggggatcagctcgtatgagctggacctgttcggccgcgtgcgcagcctgagtgaagaagcactgcaaaagtacttcgccactgaagaagcgcggcgcagcacccagatcagtttggtggccagtgtggccaacgcctacttgacctggcaggccgacaaggaactgctcaagctgacccaggacaccctcggcgcgttcgagcagagctacaaactgacctcgcgcagcaacgaagtcggcgtggcctcggccctcgacctcagccaggcacgtacctcggtggaaaacgcccgcgtggcactggcgcgttatacccgccaggtggcccaggatgaaaacaacctgaccctgctgctcggcaccggcctgccggcgaatatcgccagcaagccactgtcggatgacctgctcagcgaagtgcctgccgggttgccatcggacctgctgcaacgtcgtcccgacattgtgcaggccgaatacaacctcaaggccgccaacgccaatatcggcgcggcgcgtgcagcgttcttcccgagcatcagcctgacggccagcgccggcaccgccagcccaaccctgggcggcctgttcaaaggcggctcgggcacctggtcgtttgcaccgcagatcaacatcccgatcttcaacgccggtagcctgcgcgcaagcctggactactcgaagatccagaaagagatcaacgtggccaactacgagaaggccatccagaccggcttccaggaagtttccgacggcctcgctgcgcgtgaaacctacaagcagcagctggatgcccaacgtggcttcgtcgcggccaaccaggattactaccgcctggccgagcgtcgctaccgcattggtgtcgacagcaacctgacgttcctcgacgcccagcgccagctgttcagtgctcagcaatcgctgatcaccgaccgcctggcgcagctcaacagcgaggtcaacctgtacaaggccctcggcggtggctggaacgagcagaccgcgaagaacgagccgttgaaagaagaagcaccggcactgaagttgttctgatcgtgccgctgtaaataaaaccgcttccctcaccggaagcggtttttttttgccggttcattaagcaccgtgaatcaaaggtgggagctggcttgcctgcgatagcggtgtgtcagccacacctgtactgactgacccgccgctatcgcaggcaagccagctcccacagggcaacccgactccgtcttgcgccttgctttctgccaaacctttcagggtaaaattggttacagattcttacagaccacagagggagcttgtcgtaatgatcgtaggaatcgacctggggacgaccaacagcctggccgccgtctggcgcggtgacgctgccgaaatggtgcccaatgcccttggccagttgctgaccccgagtgtggtcggcctggatgatcaaggccgcatcctggtgggtcaagccgccaaggaacgcctgcacacccacccgcacatgaccacgtcgctgttcaagcgcttcatgggcagtgccacggaagtacgcctgggcgaccgttcgttccgccccgaagaactctcggcgctggtactcaaaagcctcaaggaagacatcgagcgcacttacggccagaccgtcaccgaagcggtgatcagcgtgcccgcctacttcagcgacggccagcgcaaggccacgcgcatcgccggtgagttggcggggctcaacgttgaaaaactcatcaacgaacccaccgccgccgctttggcctacggcctgcaccagcgtgacaaggaaacttcgttcctggtgttcgacctcggcggcggcaccttcgacgtgtcgatcatcgagctgttcgacggcgtgatggaagtgcgtgccagcgccggtgacaacttcctcggtggcgaagatttcgacaccctgttgctcgaacacttcgtcgacagccaacgcaatgcccagggcttcccgcccaccagcagtgtgctgcaagccctgcgccgcgaagccgagcgcgtgcgcaaagccttgggccaggacgacagcgccgaattcgccctgcgcgtcgacggccagcagtgggtcagcaccatcactcaggccgaactcgccaagctctacacgcccttgctggagcgcctgcgcgcgccgattgaacgggccttacgcgacgcgcggattcgcgtcggcgacctcgatgaaatcctgctggtcggcggcaccacgcgcatgccgttggtgcgcaaactggcggccggtttgttcgggcgcttcccgtccatcagcctcgaccccgaccaggtggtcgcccacggtgcggcgatccaggccgcgctcaaggcccgttcggcagcgctggaagagatcgtgctgaccgacgtctgcccttacaccctgggcatcgaaacctcgaaccagtacggcggccatatcgaaagcgggcattacctgccgctgatcgagcgcaacagcagcgtgccggtcagccgggtcaagagcgtggtcactctgcacgacaaccagacttacgtgctgttgaaaatctatcaaggcgaaagccgcctggtgcgcgacaacatcgaactgggccagctggaaatccccgtgcccaagcgcaaggccggcgaagtctcgctggacgtgcgcttcacctacgacaacaacggcctgctcgaagcccaggtgaacattccgctgaccggcgagcagcactcactggtaatcgagaacaaccctggcgtgctgagcccgcaggagatccagcaacgcctgcaagccctggcgctgctgaagattcacccgcgcgaccagcaggtcaacaccgtgttgaccgcccgcctcgaacggctctaccaggaaaacctcggcgagttgcgcgagcagctcgggcactgggccgcgcagttccagcaagtgctcgacacccaggacgaacgccgcatccgtgaggcccgcagcgagctgacccgtcaacttgagcaactcgacaacggcttctggcgctgagagaaatcgacatggactgttggacagtgttgcaactggcggacgatgccgacgagcgcaccatcaagcgtacctacgcgcggctgctgaaaagctgccgcccggacgatgatgccgagggtttccagcgcctgcgcgaagcgtacgaaaacgcgctgagcgaagcgcgctggcgcgccgacaatgaggaagtggaaacggtcgaggcgcccatagccgaacaggaccacggcaacctcaacgagttggccgaactgatggacgttcgtcccttgagccctgcgccgttcgaaacgcccgtggcgcaaagcgcttatgacctcgccgagctgatgaacatcagcccgctcagccccgccgcgtttgaagcgccaaagcctgacccggcccacgcgctgctcaccggtctgaacgtacacaaccttgatgaacgctgggcccaggcccagcagcaaggctgtgaacaggcgttccaggccggcctgctgcgccattgcttcgaagcccctggcgagcgcagtgcaatcgtcgggtgggcgatgcaacacctggattggctgacgccctggcaacaggtgacgatgacgccctggcagcacgaagccctcaccggcgaactgctgcaggaataccgccgcacgttgcaggaactgctggagcaaaaagctgagcgcgaattcgtcaaccagctgaagcagtacaacagccaaccctggctgcgtgtgttcgaccagcagcaacagtggcagcgcatcgtcctgcaactgctgcacgacaccgaatggagcgtgccgctgttcgaacgcgtgtgctcggcgtttggctgggacgaccagaaaggtgtgtacccggaaccggcgtggatgtggcgtggtttggtgtcgcgctgcgagcaggaaagcttttacaccaacctgcaagacaaggcgcaggacactcgccgcaccagcgctgatgcactggctgcgcgcttgctgctcacgccgatgaccgctacccaacagatgcgcatcatcgatcggtttggcgaaaacgagtggagtgcgtgccagcaattgggagaaaccctcacgtggcgctacccgcaactgatcgagcgcctgccccagagcgatccgttcttctggcgcaaatttgtccccagaccgatttacacccaggtgctgatccgcctgtgggctatcttcaccttggctgtcggcctgaacctcgtacgcgacaataccgaaaagctggacgttggtgtcctgctcatcttcctggtgctcgggattgtgcctgcggggatcggctttcgtatcacgcagatgtgggccttgatgagtgcgtcctttatggttcaggacctatggctgagccagtacttgatccccaagcgactcaaccccaaccaatattggctggtgttacgccatggcgtgccacagttggcgatgctcctggcctgtgcgctggtgctgggcgtattgggcatggtgacctatgccgggatgctgctgatcaacctgctgcataaaaaacgcatcggccacatgagccataccttcagccacaactacccgtggctgaacggcttgcactgggcgttctggagcccgctgcaagcagtgttcctggtggtcatggtggcggtgattgttgccgcccagcactacttgccctccgtgccctggacccacttcgattggcccaaacgctaaccttgcgcaccgggcctgagcgcaatgcacaggcccgccaacttgcgttcgatcatcgcccacaacccgccctaccccactttcatcccgcccacaccgccaagcaccatggccggcacctgcataaccccaataacaacaggtccaacaccatgagcattttccaaccgcgccagctgtggctggcaaccgctgtcgccagttttgccctgcctgtggtcgctgaagaacacggcttccttgaagacgccagcgccaacctcaacctgcgcaatttcttcttcaaccgcaacttcaccaacccgaccaaagcccagggcggcgcgcaggagtggacgcaaagtttcattctcgacgcgcggtccggcttcacccagggcacggtaggtttcggtgtggatgtgttgggcatgtacgcgcaaaagctcgatggcgggcgcggcaccggcggcacccagctgttgccgctggaccacgacggccggccggcagataacttcgggcgcctgggcgtggcgttcaaggcgcggatctccaagaccgaactgaaggtgggcgagtggatgccggtgctgccgatcctgcgctccgacgatggccgttcgctgccgcaaaccctgcgcggcgggcagatcacctccaaggaaatcgacggcctgaccctttacggcggccagttccgcgccaacagcccgcgcgacgacagcagcatgacggacatgtcgatgttcgggaaagccgccttcacctccgaccgcttcaatttccagggggccgaatacgccttcaacgacaagcgcacgcaagtcggcgtgtggaatgcccaactcaaggacatctaccgccagcaatacgtcaacctgatccacagccaacccgtgggtgactggaccctgggcgccaacctcggtttcttctacggcaaggacgacggcagcgcccgcgccggcagcctggacaacaaaacctggtccggcctgttctcggccaaatacggcggcaacacattctatgtcggcctgcaaaaactcaccggcaacagcgcgtggatgcgcgtcaacggcaccagcggcggcaccctggccaacgacagttacaattccagctacgacaacgccgaagagaaatcctggcaagtgcgccacgactacaacttcgccgccctcggcatcccgggcctgaccttgatgaaccgctacctcagcggcagcaatgtgcacaccggcaccatcaccgacggcaaagagtggggccgcgagagcgaactgggctacacggtgcagagcggcaccttcagggatctcaacgtgcggtggcgtaattcgagcatgcgcagggactacagcaacaatgagtttgatgagaatcggttgatcgtcagctatccaatcagccttttgtaaacgccctggtcaggccatgctccagccgcgcgcgttaactgttcgcggctgacacctgaaaagcgggctcagacaacagcccgctatccttaagaccagcggcagcatttacccgttatagccggcgcgatcatgctgtatcgtgcacgcgcccttgagtcgacacatggaggtcatcgacacggatcaccctcttaacccaggccgccatgaactacctcattgtccttttgtcgatcctgctcagcggctgcatcggtgcgcccatcgccctgacgccgcagaccgaacagcgtttgcaggcccaggccccgatccgcttcctgctgaccttcgatgacggccccagcgcttcaggctacaacaacccgagccgttcagtgatagccgacctggcgaacaacccggtactgccgggcatcaaggcggtgttcttcctgcagaccgaggcgtcgcgctccggtggcagccctcggggtcgcaagaccatggtgcgtgaatacgcagccggtcacgtcctggccttccacaccgccacggggtttcacaccaaccaccgctggctaagtgacgccgagcttgaacgcaccctcagccaaggcgcagcggacattgcctcgatcaccggcgcatcgcccctgctggtgcgcccgccgttctggaactacgacaagcgcaccttcgccgcctaccaacgccacggcatgcacgtactgctgacggacctgagtgccaatgacggcaagatctggggcttcaacggcagcccgcggcggcgggcgaatttgtaccggcaactgtcagtggtgcgcgagcgcatcgccttgggcgaactgccgacggtggatggcgtgataccggtggtggtgacctttcatgacatcaatcgctacaccgcgcggcacatgcaggagtacttgcagatcctgatggacagcgcccgaataaacggcatgaagaccgccgccgaaccgttctacaccgaccacgccacgctggaacgcgcggcgctggcacgtacggtgaaggatgtgaatgaagaggtgcatttgccgggggtgtggaactggatttgggatgcggattcccactgatccagcagacacggatctcctgtgggagctggcttgcctgcgatagcatcacttcggttcgccggacagaccgagttgcccatatcgcaggcaagccagctcccacaggcgcatgtgtttcaattcagtcctgccgcgactccacgccgagttcatcccacaccgactcggcgagatggaaggtcgcattcgccgccggaatcccgcaatagatcgcgctttgcatcagcacttccttgatctcggcacgggtcacgccattgctcgcggccgcacgcaggtgcaacttcagctcttcgctgcggttcatgccgatcagcatggcgatggtgatcaggctgcgggtgtgccgcggcaggccggggcgggtccagatatcaccccaggcgtggcgggtgatcatttcctggaactcgctgttgaactcggtaagggcactcaggctgcggtcgacatgcgcatcgcccagcacttcgcggcgcacttgcaggccgtcggcgtaacgttgtttctcgtccacaaaaaagctcctgtttcaattaggtgtcagctcaatcacctggggtggtgaccgggcctgtcgtggcgagcggcgttgtcgtggcgagcgggcttgccccgcgttgggtggcgaagccgccccaaaacctggcaacgaggttcaccctggaaaaacgcggtgacggtatcagggccgcttcgcggcccaacgcggggcaagcccgctcgccacagcaagcccgctcgccacaacaagccagcaagccacagggtttaatcggccagcaagaacttcagcactcggttgctgaaatccgccccgacctggacgttggacaggtgggctgcatagaactcggcgtactcggcgcccttcacatggttctggataaagtggctaccggccggcggtgtgaccgcatcttcagtaccggcaaccaccaaggtcggcgctttgatcgaggccaactgttcacggaaatccgcatcacgcacggccgcacagttggcggcataccccttgggcgaagtggccgcgagcatgtcggtaatctgctgggcctggtgcgggttggcggcggcaaaatcggcggtgaaccagcgcgcaatcgacgcatcgcgcaacgccaccatggctgccggcccctcacgcaagaccatctcgatacgcgggttccacacctccggtgtgccgatcctggcggcagtgttgcacaccaccaggcgctgcaaacgctcaccggcatggatgcccaaccattgcccaatcaggccgcccatggacaaaccacagaaatgcgcacgctggatatccaatgcatccagcagcgcgatcacgtcgcggcccagttgctcaatgctgtacggcccctcggtgaccaaggacttgccgtggccacgggtgtcgaaacgcagcacacgaaaatgctcggtaaaggccgggatctggatgtcccacatatgcaggtcagtgcccagggagttggacagaaccaacaccggcgcttccactggcccatccagttggtaatgcagttcgccctcggcgagttgtacaaaggccacagcggtctccttacgcggtcaatgcaaaatggtcggccaccgcgcgggtgacccaggtgcgggcctggcccaggtagtgagccgggtcgagcaggcggtccagttcaaccgctgataactcggcggtcacctgcggttcgtccgcaagcaccgcgcgcagatggcgcccttgcgcgacggcgcgcttgcaacattgctccagcagatgatgcgcagtgtcgcggcccaagcgctgggccagcacgatgctgacggcttctgccagcaccaggccttgagtcaaatcgaggttgtgcgccatgcgctcagggtcgacttccaacccctcgcttaccagcaacgcctgcttcaaggcgccagacaccaaccgacaaatttcgggcaaggtttcccattcggcgtgccacaggcccaggctgcgctcgtgttcctgaggcatggcgctgaacattgtcgcgaccaaccccggcacacgggtcgccgcgctgatcagcacggcggcacccaccgggttacgtttgtgcggcatagtcgacgaaccgcctttgccgggcgccgaaggttcaaacacctctgccgcttcggtctgcatcaacaggctgatatcacggcccaacttacccaggctgccggcaatcaggccgagcacactggcgaactccaccagccgatcgcgttgggtgtgccagggttgctcgggcaagctcaactgcaactccgccgccaaggcttcggccacgggcatcgcctgctcacccagcgccgccagggtgccggacgcgccgccgaattgcagcactaacaggcgcggcttcagctcggcaaggcgctggcgactgcgcgtcaccgcccccagccaaccggcgattttcatccccagggtgaccggcgtcgcgtgttgcaaccacgtgcgcccggccaacggtacgctcgcataacgctgggcctgctgggcaaggacttcacccaattgcgccaaatcggcttcgatcaacaccagcgcgcggcgcaattgcaggaccaggccggtgtccatcacgtcctggctggtcgcgcccagatgcacgtaacgttcggcgtcggcgtcttcactggcaatcaacttgcccagcgcctttaccaacggaatcgccgaattgcccgccgtggcaatcgccacgccgagcgcatccacatcgtacaaagacgccaggcaggcctgggcaatcggtgcaacggcggcctgcggaatcagcccgacctgggcctgcgcccgggccagagccgcttcaaaatccagcatgccctgcaaacgcccctgatcgcagaacacttcggccatgctctcagcggtgaagtaagcgtcgaacaattggttgctcgtgcgcagtgtcataacgcgtcccttatagatcgtggtgcaggtacgccgcctctttcggcaggcgcaagctgaacaggaaggcaatcgccatcatcgcggtgacataccagtagaaggtgttttccatgccgatggatttaaggctcaacgcgacgacttccgccgaaccaccaaaaatcgcattcgccaccgcgtacgccaggcccacacccaaggcacgcacctggggcgggaacatctccgctttaaccaggccgctgatggaggtgtagaagctgacaattgccagcgccagggtaatcaacacaaaggccaggaacggactgctgacggttttcaaggtcagcaggatcggcacagtgaacagcgtgccgaggccggcaaaccacagcatggagttacgtcgaccgatcttgtccgccaacatgccgaacagcggctgcatgcacatgtagaggaacagcgcgcccgtcatgatgtagctcgacgtcttggcgtgcatgccgacggtgttcaccaggtacttctgcatgtaagtggtgaaggtatagaagatcagcgaaccgccggcggtgtagcccagcaccgtgataaaggccgcggtgtggttgcgaaacaacgcagcaatgctgccggcgtctttgtcttcgcgcatttccttactggtggtttccttcaatgtgcggcgcagcatcagggagatcaccgctgcgatggcgccaatcacgaacggaatccgccagccccaggcacgcagttcgtcttcactgagaaactgttgcaggatcaccaccaccagtaccgcgagcaattgcccgccaatcaaagtcacgtactggaaggaggcaaaaaaaccacgctggcccttgagcgcgacttcactcatgtacgtcgcggtggtgccgtactcgccgcccactgacaggccttgaaacagccgcgcgatcagtagaaaaatcggcgcccagataccgatgtccttataggtcggcaagaaggcgataaccaatgagccggcgcacatcatcagcaccgagatcatcattgagtttttgcgaccatgcttgtcggccacgcgaccgaacaaccagccaccaatggggcgcatcaggaatccggcagcgaacacgccagcggtgttgaccagttgcacggtagggttatccgacgggaaaaacgccggagcaaaataaatcgcgcagaaggcataaacgtagaagtcgaaccattcgacaaggttgccggaggaagcaccgacaatcgcaaaaatccgtttcctgcgttcttctccggtgtagtgactcgttgttgttgtcatgttttttcactcagtgggaacggttatagcctagacatactttgcaacaaccatgttccgcaagcagacttttggatgtgtgtcgccgggaagtccctcatcgcgggcaagcccgctcccacagttgaccgtgatcctctgtgggagctggcttgcgtgcgatgaggcccggcaacgaactcaatagtcgaagaacaccgtttccttatcggtgccctgcaaaatcacattccactgatacacccctgccccatcctgctcggcaatcaacgtgctgcgccgctctgcaggcacacaggccagcagcgggtcatcagcattcaacgcctcgccgtcaaaataaatccgcgtcagcaagtgcttcaccaacccacgcgcaaacaccagcaccaccaggtgcggcgcctgggtcgtgcctttcagccccggcacgctgccgggcttgatggtggtaaagcgaaagcgcccttcggcatccaccggcactcggccaaaaccttcgaagtgagggtcgacggctttgtcctgctcatcttcgggatggtcgtatttaccagccgcattggcctgccagacttcgagcatggcgtcgttgacgacatcaccgttgccgtccaccacttgcccgctgatggccacgcgttcgccgagggtggccggcacggtcaggtcttcgcggttcagccaggtcaggccgatgtggtaatacggcccgacggtgtgggacgtggtcgcattgagtgtcatctcatttctccatcggcgtggcgtcgcggccgcgcaggacgatgtcccagcggtagccgagggcataggaaggaatggttttttccaggtcaaaacgggcgatcaggcgctgtttggccgaggtgtccggcacgcagttgtagatcgggtcgtattccagcagcgggtcgccggggaaatacatctgtgtgaccaggcgcgtcagcacgctagggccgaacagggaaaagtggatatgcgccgggcgccacgcattgtggtggttgccccacgggtacgcaccgggcttgatggtctggaactgataccagccatcggcgtcggtaacggtgcgaccggtgccggtgaagttcgggtccagtggcgcatcgtgcaggtcacgcttgtggttgtaacggcccgcagcgttcgcctgccagatctccaccagaatgcctggcaccggcaagccattttcatccagcacgcggccatgaatgatgatgcgctcaccttgaggctcgccctcgtgctgggcagtcaagtcattgtccttctcattgacgcgctcggcgccgatggtcgggccggtaatttccgacagcgaatgcggcagaaacaccaacggctgggacggcgaacgcaggttcgtcgactggtaggccgggtgcaggtaatcaggttgagtgcccgcttgcgggcgccggtatccgggcttgtcactcatggagcaatcctctctttttagatgcgttcaatcgccagggccaagccttggccgacgcccacacacatggtcgccaggcctttgctgccaccggttttttccaactggtgcagcgcggtcaacaccaaccgcgcgccgctcatgcccaacggatggccaagggcgatggcgccgccgttcgggttcacctggggggcgtcgtcggcgatgcccaactcacgcagcaccgccagtccttggctggcgaaggcttcattgagttcaatgacgtcaaagtcagtgaccgccaaaccgaggcgctccaccagcttgcgcaccgccggcaccgggccaatccccatcacacgtggtgcgacaccggcgctggccatacccagtacgcgcgcgcgggcggtcaggccgtgttttttcaccgcgtcggcggaggcgagtatcagtgccgccgcgccatcgttcacgccagaagcattacccgcggttacggtcttgtccgggccattcaccggcttgagtttggccagggcttccagggtagtgtcggcgcgtggatgctcatcctgctcaaccacggtctcgccttttttgtgcgcgacgcgcaccgcaacgatttcttcagcgaagaacccggcagcctgtgcggcggccgtgcgttgctggctgcgcagggcgaaggcgtcctggtcggcgcgagacacgtggtaatcatcggcgacgttatcggcggtctgcggcatcgcgtccacgccgtactgtgccttcatcaacgggttgataaaacgccagccgatggtggtgtcttccagcttcatgttgcgtgaaaacgccgcatcggccttgcccatcacgaatggcgcgcgggacatcgactcaacgccaccggcaatcgccagctccatttcgccgctggcaatggcgcggaaggccgtgccgatggcgtccatgcccgaggcgcacaggcggttgagggtcacgccgggaatgctctctggcaggcccgccagcaacagcgccatacgcgcaacgttgcggttgtcttcgccggcctggttggcgcaaccgaggaacacttcgtcgacggccgaccagtccaccgacgggttgcgctcgatcagtgccttgatcggcaaggccgccaagtcatcggcgcgcaccgtggacaagccaccgccaaaccggccgatgggcgtgcggatggcatcacagataaatacctcgcgcatcaggcttctcctggcgcttggccatgggcggccgcggtgcgggcttcaaggtcacgcagggctgtcagttcgatctcagtcggttcgtcagtcgtttccacatggtcggcaaaccgaatcgcccaaccagtggctgcgaccacttgctcacgggttacgccagggtgcagcgcggtgaccacaaactcatggctgcccgcttccggttccatgatgcacaggtcggtaataatccctacgggaccggcgcccggcaggcccaggcgtttacgtgaatcgccgccttcgccgtggccgaccgaggtgatgaagtcgagtttgtcgacaaacgaacgcgccgactgcttgaggatgatcagcacgctcttggccgaaccggcaatctccggcgcaccaccggcacccggcaggcgcactttgggctggtggtaatcgccgaccacggtggtgttgatattgccgaaacggtcgacctgggcggcgccgagaaaaccgacgtcgatgcgcccaccttgcagccagtagcgaaaaatctcaccagtcggcaccacggtgtcggcggtttcagccagctcgccgtcgccgatggacagtggcagcacggaaggcttggcgcctatcgggccggactcgtagatcagcaccacgtcgggcgacgaggtcaggcgcgccaggttggcggctttagagggcaagccgatgccgacaaagcacaccgagccgttcttgaggcggcgcgcggcggcgacggtcatcatttcattggtcgagtaagccattacttggcctcctgcgcgttggccagtttggcctggaattcactgaagtcggcagtgccgtggatgtattcgtcgatccaggcggtaaaagtcccacggtcgcgggcgatcgggtcccacgcctgatagaagcggttgtcacgttcgttgtaaccgtgagcgtaggacggatgcgcgccacccggtacatgacacaccgcggtcagggcccaggtcggcaacacgcagctgttcatcggtgcattcaggtcgtcgacgatttcttcgacggtgacgatgcaacgcttggcggccaacgccgcttccttttgcacaccgagaatgccccagagcaacacgttgcccttgcgatcggccttttgcgcgtggatcacgctgacgtccgggcgtaccgacggcacggccgccagtacttcgccggtgaacgggcaagtcacggttttgatcagcgggttgaccttgggcaaatcggaaccagcgtaggcacgcagtaccgcgaacggcaggcccgatgcaccggcgacgtaggcattcgccaggtcggcgtggctgtgttcttcgatctccagcggctgcggccattgtttctcgaccgcatcgcgcaggcgatgcaaggagcccacacccgggttgccgccccaggagaaaatcaacttgcgggcgcagccggcaccgatcaactggtcgtagatcaggtcaggcgtcatacgcaccagcgtcaggtctttcttgccctgacggatgatttcatgacccgctgccgtagggatcagatgggtgaagccttccagtgcgacggtgtcgccatcgttcacgaattgcttcaccgcgtcacgcagcgcaagaatttcagccatggggttcgggctcccggtgttgatcgaaaaaggcgctgaggtggcgccgaagtgcttgaagattaagccggggcattgggccgaacaatccgataatcgacggagtgttcgattatcgaacgaattgttgcctagctaatcgtttgtgcaaagcagccagttcagctgccaaccgtcaatgtgggagctggcttgcctgcgatgcagacaactcggtccagcaggcaaattgagttgatgcaatcgcaggcaagccagctcccacatggcctcgtggctgctacaaaatcgtgtcagacctcaggtcgcgtccgcatggctgaccatgcccttgatcagcacggcagccgtggccaatgccgctggaatcaccagcgcggtgagtacctgctcgaagttccagcccagccccagcaacgtcgcgcccatccacgcgccgagaatcgcgccgaagcggccgatgccgagcatccacgacataccggtcgcgcggccttgggtcgggtaaaagcgtgcggctaatgagggcattgccgattgcgcgccgttgacgcacatgccggcgaccagcaccagggtcgccagcaaggtgatgttgcccaggctctgccccaccgcgtaggcaaacaccccggccagcaggtaaaaagtaccgatgaccttgtgagggttgaaccggtccatcgcccagcccacgccgactgcactcaatacgccaccaaactggaacaatgcgccgataaacgcggcctgttccatgctggcgccactgtcacgcatcaaggtcggcagccaactggtcagcaggtaaacaatcaccaggcccatgaagtaagtgagccacagcaacaaggtgccggcgctgtaagtgccggagaagatcaccgcaaacacattgcgcgccttgacggttttttgttcgggtacgctgaagctggtggcctgggcgacgagattgggctcgatgggcgacaaggtcttgcgcactttgtcagtgccgcgattgcgcaccacgaggtagcgtgccgattccggcagccacaccaacagcaccaccgccaggatcaacggcaggatgccgccgatcatcagcaggctgtgccagccgaacgccggaatcagcttggccgagataaacccgccaccggccatgcccaggttgaacccgcagaacatgctggtcaccaacagcgacttgtgacgctcaggggtgtattcggaaagcaacgtggtggcgttcggcattcccgcccccaggcccagcccggtgaggaaacgcaacaccagcaactggtcgacgttggtgctgtaggccgacgccaggctgaacgcgccaaacaccagcaccgcactcaccagcaccactttgcgcccgaagcggtcggccagcgggccggagcccaacgcgccaaacaccatgccgatcaacgcagcactcatcacggggccgaggctggcgcggtcgatgccccaatcctgggacagcgcgggcgcaataaagcccatggcggcggtgtcgaggccgtcgaggaatacgataaggaaacacaggatcaccacacgccactgataacgtgacagtggctgggcgttgataaaggactgcacgtccaggttagtaccgacagagggctggttcattattgttatttccacaccgatgggcgggcgaacggcctggggccgtcattattattggggcgcgctagagcgctgccgcacagtaataagcctggggaaacaccgtcaattgatcaggccgggttctgtgcggtgaccgaacacttaggcaaatagctgggcactcaactcacgactggcgctgagcatgctcggcaggaaacgctgttccaactcactgcggctgacgcgtccggcatgggtgctgacattcaacgcagccagcacctggccggacgcgtcgtacaccggcaccgcaatggagcgcaggccctgctccagttcctggtcaacgatgcaccacccttgctgacgcacttgttgcaggcattcgaacaaggcttcgggggtcgtcagggtgcggctggttttggtttgcaggtcggcgtggtcgaggtagtcccgcagcgaggcatcatccaacgccgcgagcaggatgcggcccatggacgtgcaatacgccggcaggcgcccgcccaccgacaggtccaccgaaatcaggcgttgggtggtggcggaacgggcgatatagaggatgtcgtcgccttccagggtcgccatgttgcaggcttcgtgcagttgctcgctcatgcggtccaggtacggctgcgcggagaccgccaggggtgtagaggataaataggcatggcccagtgtcaggactttgggcagcagcgagtaagtgcgtccgtcggtggtggcgtagccgagcttgatcaacgtatgcaggcaacggcgcacggcagcgcgcgggatttcggtgcggtggctgatttgggcgatggtcaggtggcgtttgcgctcctgaaacgcctgcaccaccgccaagccacgggccagcgaggtcatgaaatccggatcaccggtaaacgcctggatgcgcttggccggagaagccacgatcggcggcgccactgacgcgaaggagttgcgcaattgatcgttcatttcagggtcctttctcttatttttcaaccgctgggagggttggccgctattacaagccgcgctggccttgatgtacaaggctggggccgcatcattgggcgattatcggacgatcattcgataatcgcaatttgcccggcacgccgagcaccgatactgcacgagggatccatacagttgacgcactcatacgtgacatttagttgagtgcagactttatgacgccagcttttcacaattactgacgcgagcatgtaacaaaaccctcacacgacgttgacgctttttaacttcatggtgatagtgttattcaaatgcgccgctataatgcagcttgtgcagaggtcagcccggtatcgatatcgggattggagctcgccaggcgttgcgcaatgtgcatcaccggtcacaagtaaccgcttaaaagatatgccctttggtcctctttcaaacttgaacggctgcgttgttcaatttgaaataacccgaggacgactttcaggcctaacgctgcacagtcaataactcaactcaattaggtaacactgtgacgaaagacgaactgcgcgcggaacttgagcgccaggagcaacgttacaaggacgtttacggcggggaagtcaccacctacgccgcccagcctgagcccgagcgcaagccgtggcgcaagcgagccagcttgctggatcaggcatttgcccaggaaatccaaaagattgaacaggaactcaaaaccgaagagccataagctcttcgatttgagcgccaaggttttgccaccaccgctggctcattgccagcggtgggcgacctgattttcatcaggcccctacagccttgagcgaaatttcgtacaaatgtttcaaacgtgacatttcggtcaaaaaaaaccgcctttcgggccacgcgctttataaatcaaagacttgccaaagccccgaaaaccctgggatgcgcccctttgctcggagttttttcagtgaagattgcgaccgatgagcagctagtgcatcgattactgaggttttctggcataatcgcgcccccttacgaccgggtcagaaaaccttcatgatcgatttattcagcggactggatgcttgggttctagtgagcctgttgctcgccctggcctttgtcctcgccttcgagttcatcaatggctttcatgacaccgctaacgcggtggccacagtcatctataccaaagccatgccgccgcacctggccgtgttcttctccggggtgttcaacttcctcggcgtgttgctcggcggtgtgggtgttgcctacgccatcgtgcatttgctgccggtggagttgctgatcaatgtgaacaccggccatggtttggcaatggtcttctcattactggcagcggcgattacctggaacctgggcacctggtacttcggtatcccggcctccagttcccacacgttgatcggctcgatcctcggtgtcggcctggcgaacgccctgatcaacgatattcccctggctgacggtgtgaactggcagaaagcgatcgatatcggcgcgtccctggtgttctcgccgatggccggtttcctggtcgcagccttggtgctgatcggcctgaaatggtggcgcccactgtcgaaaatgcacaagacgccagaccagcgccgcaagctcgacgacaagaaacacccgccgttctggaaccgcctggtgctggtgatttccgccatggccgtgagcttcgtgcacggctccaacgatggccagaaaggtatcggcctgatcatgctggtgctgatcggcatcgtgccggcgcaattcgtactcgacctgggcagcaccacctatcagatcgagcgcacccgtgacgccaccgtgcacttgagccagttctaccagcgtaacaacgccaccctcggcgagttcctggcactgggcaaaagtgtgaaggatgacctgccgggcaagttccagtgcaacccgcagcagaccgagccgaccatcagcgcgctgatggacaccttgaaaggtgtctcggactaccactcgctgacctccgaacaccgtattgaagtgcgccgctacctgctgtgcctggacgacaccgcgaagaaagtcggcaagctgccgggcctggatgcgcgtgagaagtccgacctggacaagctgcgtaaagacctgacggccaccaccgagtacgcgccgttctgggtgatcctcgcggtcgcgctggccctgggcctgggcaccatggtcggttggaagcgtgtagtgctgaccatcggtgagaagatcggcaagcagggcatgacctatgcccagggcatgtcggcgcagatcaccacggcgagcatgattggcctggcgaacatcttcagcctgccggtttccaccacccatgtgctgtcgtccggtgttgccgggaccatggttgccaacaaaagcggcctgcaaggtggcaccgtgaagaccattctgatggcttgggtgttgaccttgccggcaaccgtgggcctgtcggccgggttgttctggctggcgtccaaggcgctgggcagctgataagctgctgttgaaaaaaaggcgtgatcccgataaggatcacgcctttttttatctccgcagatcgttcccacgctctgcgtgggaatgcatcgagtgacgctcagcgtcacaactacaggtgcgggacgcagagcgtcctcggcggcattcccacgcggagcgtgggaacgatcacattaaatagcagacaaaaaaagggcgaccgaagtcgcccaaaatgccttgcgtgctcatgtaacccggaagaacttacggttctttacgcttattagcgtccttccagataaaaatcccgaatcctacaaaaaacagcaccatgaggctgacagtcagcaccccggcaaacaccacattatcgaaaaacatgaccggcctcctgctcgtgccctgttgcgatagggctaagttaatggagaaggcggattggaaaattgacggggatcaatgtcgcccgcaacggggcgtaaagaagggcaataactgacctgcatcaaaagatgcaggttgtttcaacgctttttcggctttttctttggctttttcttaacgttgcccagtggcatcgcttgttcaaatgcctgacgaacttcattcaggcgtttgtcattcaggtcatgcacacgcttggcacgttcggcattcaggtcgatcagtttgtcgtcatcactcatggcttggcttacgtcgtggcgggaatagctcaataatgcggcctcgtccgtccgacggcaaatcagcgggcgacaaaatgcaggtcatcgcccaaaatcggcactttccaccctacccagcaggagccttcaggtggcattgcacaaggaccttccaccgctgctggccctgcgcgccttcgaggctgttgcgcggcatttgagttttatcaaggcggcaaatgagttgtcggtgacccagagtgcactgagccaccaggtgcaaaagctcgaactgcatttgggtaaaccgctgtttatccgacgcacccgtgcgatcgatctgaccgccgacggccaacgctactacgacgaaattcgccccgccctcgacgccatcgccgccgccacccgcgcgcaaaagactgcgcccagttccaccgtgctgcgcgtcggcctgctcgcctccttcgccaccctgtggctggctccgcgcctggcggggtttcttaaccgttacccgcatatccaggtggagttgctgccgtcgattcaattggccaacgtcgccgccgccgaggtcgacctggcgatccgttatggcaagggcgactggcccgatgtacacgccacacggctgatgcctgaagtgatctcgccggtgtgcagcccggccttcaaggccagtcacgtgcacaacggcgcgctgttgatggccacctcgcaccggccttttgagtggaccgattggtccgcgcattatcaagtcgaccttgagcgccacccccgcgtgatgttgcacgactacaacatcgtggtcgaagccgccgtggccggccagggcatcgccatgggtcggcaccgtttgattgagcgcaagttgcaggatggcagcctggtgcaagcctttgactggccgccctatcacagcgaaatcggctactggctgatcgcgccccaaggccccgccagtgaggcggccgaatgcttcagccagtggttgaaggaaacctgcagcgacgcgtgagttatttcgatacgtcgagtgagttctatccgtttgtcgcccatcgtcgcagccaacatgctgaaaccttctttactcaagaggtttcaccatgagcgactctatccgccaacgcgtacacgcccttggcctgacactgccaacgcccagccagccggcggccaattacatcaatcatgtgatcagccagaaccagttgttcgtttccgggcaaattcccatggtcgacggtaagcctgcctacatcggccggttgggcgagtccctcagcgatgcagaaggtgcccaggcggcagagctggcggcgctgggcctgttggggcagctgagcgatgcggtcggtgatgacctgtcgcgcgtggtgcgcattctgcgcctgggcgtgttcattgccagcagcggcgacttccagcgccagagcgtggtcgccaacggcgcgtcaaacctggtggtcaacgccctgggtgacaagggccggcacgtgcgcactgccgtcggtgtgtccagcctgccggccggcgtggccgtggaggtagacgcgattttcgagctgcagccgtgagcccgctcgacgtccagcacctgcgcgatggcacgcccggctgtcagtcgggcatcgtgcacttcaaccacgccggtgcctcgctgcccagccaggccaccctcgacgcgatcatcgaccaactgcaacgcgaagctcgcgacggcccgatggaagccggtgaacatggcgccatcctggtggaaaaagcccggcgtgcagccgcgcaattgttgaatgcgccgaccgcctcgattgcctttgccagtagcggctccaccgcctggagcatggcgtttcaggcgctgggcccgtggcagccgggcgagcgtattctggtcggccgccatgaatggggtggcaacctggcgagcatgcaactggcggtgcaggccggtgctcgaattgaagtgatcccgtgcgatgcaaccggcgcggtctgcccgaaggcgctggagtcgatgatcgatgccaacgtcaagttgatcgacctgacctggctgccggccaacggcggcctgatcaacccggcccaggccatcggcgaagtggccagacggcacaacatcgcctacttcatcgacgctggccaggccgtcggccagttgccggtggacgtgcaagcgctgcactgcgatgtgctcaagtcggccggtcgtaaacacttgcgcgggccacgcggcacggcgttgctgtatgtgcgaccggattttctccagcagctcaaccccgctcagcgcgatgtgttctcggcgccctggaccgccgacgggtacgacctgcgcgatgacgctcggcgctttgagaccagcgaagcgtcctacgccttgctcgtcggcttgggcaatgcgttgcaggaggtgaatcgactgggcgtggaacagacgtgggaaagggttgtgcagctcagcgggagaatccgtgaagcattgcgtcagattccgggcgtttccttgcatgacctgggcacgagccactcaggcttgatcgccttcaacctcgccggctgggatgcgttcgaactcaaacggcgcctggggttgaaacgcatcaacatcggcgccaatggcgtggcctacaccccgttggatatgcaggcgcgggatcttacgagcattgcgcgcatttccgtcagcccgctcaacaccgaagacgacatcgaacagctgatcgccgcgctgcgcgaattgcgcgactaaacctcgacgtccacccacaggccctggcgcggcgcatcttcgatcagcggcaccaccggcacggtgttgtcggcgttgagcacatcgccggggatcgccaggtgagcgtcggggtcttcgtcggcttcgcggcggcgtttctgctgctcctgctggcggcgctgttcttcacgcagcagcaaggtcgactgctcggcatcgccctttttcaggtcgatggtgctttcgctggagcccgcctggactggcaccacgggcgggatatccggcttctggcgcaccgggtcaagttgtgacgtgaccggcacaacgctgacgggcagcatgggtggcagcataattttattctcctgatcaacaggctgtcggcgggtggcagggcgacttgagcgcaagcacgccaagctgtgacccagtcgacactcgcaagtgcctgccacccgtcgatccagcttccgaagcctgctgctaacagtgtagtttttgtcagaatcctttggctcagaggcttgttccgttaagatagtcggctttttcacggcgggagtcaggcagcatggcgcagcagtatcaaccggggcaacgctggattagtgacagcgaagcagagctggggttaggcaccgttctggcacaggacgggcgcttgttgaccgtgctctatccggccactggcgacactcgtcagtatgcgctacggaatgcgcccctcactcgcgtgaggttttcgccgggtgacagcatcacccatttcgaaggctggaaaatgaccgtacaggaagtcgacgacgtcgatggcctgctggtctaccacggcctcaatgggcagaacgagcaggtcaccctgccggaaacccaactgtccaacttcatccagttccgcctggccagcgaccgcctgttcgccgggcagatcgacccgctggcctggttctcgctgcgctaccacacgctggaacacaccagccgccaattgcagtcttcgctgtggggcctgggtggcgtgcgtgcgcaacctattgctcaccaactgcacatcgcccgtgaagtggccgaccgtatcgcgccacgggttttgctggcggacgaagtgggcctgggcaagaccatcgaggccggcctggtgatccatcgccagctgctgtcgggccgcgccagccgcgtgctgatcctggtgccggaaaacctgcagcaccagtggctggtggaaatgcgtcgccgcttcaacctgcaagtcgcgctgttcgacgaagaacgttttatcgaaagcgatgccaccaacccgttcgaagacacccagcttgcgctggtggccctggaatggctggtggacgacgagaaagcccaggacgcgctgttcgccgccggctgggacctgttggtcgtcgacgaagcccatcacctggtctggcatgaagacaaagccagccccgagtattcgctggtcgagcagcttgccgaggtgattcccggcgtgctgctgctcaccgccaccccggaacaactgggccaggacagccacttcgcgcgcctgcgcctgctggacccgaaccgtttccacgacctgcacgccttccgcgccgagagcgagaactatcgcccggtggccgaagccgtgcaggagctgctggataaaggccgtctgtcgccaaccgcgcacaagaccattcagggttttctcggcgacgaaggtgaagcgctgctcaccgccgtcaacgatggcgacaccgaagccagcgcgcgcctggtgcgtgagctgctcgaccgccacggcaccggccgcgtgctgttccgcaacacccgcgctgcggtgcagggtttcccggagcgcaagctgcacgcctacccgctgccgaacccggacgaatacctcgaattgccgctgggcgaacacgccgagctgtacccggaagtcagcttccagtcgcagccggatgtcgaggaagaaaaccgctggtggcgcttcgacccgcgcgtcgagtggctgatcgaccagttgaagatgctcaagcgcaccaaagtgctggtgatctgcgcccacgccgaaaccgccatggacctggaagacgccctgcgcgtgcgttccggcatcccggccacggtgttccacgagggcatgaacatcctcgagcgtgaccgcgccgccgcctacttcgccgatgaagagtttggcgcccaggtgctgatctgctcggaaatcggcagtgaaggccgcaacttccagttttctcaccacttggtgctgttcgatctgccgtcccacccagacttgctggaacagcggatcgggcgtctggaccggatcggccagaaacatgtgatcgagctgcacgtgccgtacctggaaaccagcccgcaagagcgtctgttccagtggtatcacgaagcgctgaacgcattcctcaacacctgcccaaccggcaacgccttgcagcatcagttcggcccacgcctgctgccgttgctggaaaacgccgacgatggcgaatggcaagccctgatcgacgaagcccgtgccgagcgcgagcgtctggaacaggagctgcacaccggccgtgaccgcctgctggaactcaactccggcggcgcgggtgaaggcgatgcactggtggaagacattcttgagcaagacgaccagtttgccctgccgatctacatggaaaccctgttcgacgccttcggcatcgacagcgaagaccattcggaaaacgcgctgatcttgaagcccagcgaaaaaatgctcgacgccagcttcccgctgggcgacgacgaaggtgtgaccatcacctacgaccgcaaccaggcgctgtcgcgcgaagacatgcagttcatcacctgggaacacccgatggtgcagggcggcatggacctggtgctgtccggctcgatgggcaacaccgccgtggcgctgatcaagaacaaggcgctcaagccgggcaccgtgttgctggaactgctctacgtgagtgaagtggttgcgccgcgctccttgcaactgggccgctacttgccaccggccgccctgcgctgcctgctggatgcgaatggcaatgacctgtccggccgtgtgtcgtttgaaaccctgaatgaccagctggaaagcgtgccacgcgccagcgccaacaagttcgtgcaggcccagcgcgaccaactcacgccgcgcatcaatgccggcgaagagaagatcaccccgcgccacgccgagcgtgtggccgaggccaagcgccgtctggcggcggacaccgacgaagagctggcgcgcctgaccgcgttgcaagcggtcaacccgaccgtgcgcgacagcgagctggtggccctgcgtcagcaacgcgagcaaggcctggccatgctcgacaaggcggcgctgcgactggaagcgattcgggtgttggtggcgggttgataaccgccctgccctgttaagaagaaggcccgcacaatgcgggccttttttgttgatcgttcccacgctctgcgtgggaatgcagccccggacgctccgcgtcccaaagcatgacgcagagcgtcacatgatgcattcccacgcggagcgtgggaacgatcaggctacagcggcagcagccggcacctccaccgcccccaacccatccttcatcttcttggcatcacgcacaaagctgcgcgaggcctgaaacagaaacagcatggtcaagaacagcgccaccgggatcaggtacatggcgtcgtgcaaccccacggctttataggcttcagtcatctgcgccgcgccatcggcgtacatcgccgaatgggcaaagtgatccgacagcccgcccacgacaattggccccatgccaccaccgagcaaatacaacccggcaaagaacagcgccatcgccgtggcccgcaggcggggctcaaccacgtcttgaatcgccgtgtacacgcaggtgtagaagttataggcaaacagccagcccacactgaacagcgccacaaacacgccaatctcgatgcgcccggcgtgcaatgcccaggcggtggtgacggtggagatgatcaggctgcacgccgcaaacagcagccggccattggcgatacgttgatgaatcttgtcggcaatccagccgcccaaggtcagcccgacaagcccggtaatacccacgatcacgccggtggcaacggccgcttcctgcaacggcatgaggaagtagcgctgcagcatcggcaccaggaacgagttacacgcgtaggtggcgaagttgaagcacagcccggccagcaccagccacagaaaggtcggcaccgccagcacgcggcggatcgggcggtcgacgcgttcctgtgaaacctgcacggtttcggccgcgccgcgcttgggttccttgatatagaacatgaacaccgcgaggatcagccccggcacggcggcgataaagaacggcgcgcgccagctgtcgaacgacttgaccatcgcgccgatggtgaagaacgccagcagcagacccaatggcaaaccgagcatgaaaatgcccatggcgcgggcgcggcggtgcgccgggaacaggtcgccaatcagcgagttggccgccggcgcatagctggcttcgccaatgccaatgcccatgcgcaccagcaaaaaggtccagaagctgccgaccatgccgttgaccgccgtcagcccgctccaggcaaacaagccccagcccattagtttgctgcgcgaaccggtgtcggccagccgcccgagcggcaggccggcgatggcgtagacaatggtgaaggcggtgccgatgatgccgagctggaagtcgctcaggtgccattccatgcggattggctcgatgatgatcgcgggaatggtgcggtcgaagaaattgaacaggttggcgaggaacagcaggaacagaatgcgccaggcattcgccgcttgggtcgagttctgcatgggtccgtctcttttattgttatgagagctgcgatgcccgatgcatcctgcccggtgtctgcaacatagtcaggcagcggccggttgtctgtaatgattcgtaaagctgatagggcatgatttcacccggcttcacgggactttacctacgaaaatataagttcatgccccccttcccaacggcaacgccacggatagaatggcgagccttcctgtaatacccaatcctacttttcttatcgatgacgcccatgtccgaagccagtccgtgtctgagttgcggtgcctgctgttcacactttcgtgtgtctttcttctggggtgagtgcgcctcatcggggggcacggtgcccgatgatctggtcgtacagatcaaccccacgcgcgtggcgatgatcggcaccgaccagaaacctgcacgctgctgcagccttgagggtgaagtcggcaagggcacccgttgcaccatttatgaacaacggtcgagcccgtgccgcgagttcgacgcgtcctggagccagggcgaacagaacgtcgattgcgatacggcacgtgcggcctttggcctgccgccactgcaagcgcctttcgagttggagttgccgatcagcgcttagcatcaaacgctatggcaggcatgccaaaatcattgagagcaaagtgccattattcctggcaaatctcgcgaggcttctatactcgaggtcatgagccattgctgtaggcaatgacgtactgactttgacgggacatgctatggaatggctaggtatgcatttttttaccgaccttccggacagcgggcacttattactcaattgcagtcataacccctttctggtgttgttggcttacctggtcgcttgcgcggccgggttcggcacgttggacatggccgaacgcgtcgggcatgtcgaagaccccaccgcccgtcgccattggcgctggcttggtgccggttgcctggcaggcggcatctggtcgacccacttcatcagtatgttggcgttccaggcgcctatcgccattcattacgaattgctcatgacgttcgcctcgctggtgatcgcactgattgcctcgctgtttgccatgcaaaccctcagtcatgcccaactgcgctttcatcagtacctgctggcctctatctggatgggtctgggcattgcgttgatgcactacgtcggcatgtcggccatgcactcccaggcccagatgtacttcgactcggggctgttcatggcgtcggtcggtatcgcgattggcgccagcctggccgcgctgttgctgtcgtgctacctgcgcaacggtacgggcgtgttccatcaattgctcaaatacgccgccagcctggtgctgggcgccgggatcttgagcatgcacttcactggcatggccgccatgcaaatgctggtgccgaccggtgctgacctgtcgttgccgctggacaacaacccgattcaactcggcctgtcagtcgccgtgattaccttgctggtaatcggcagcagcgtcagcgcggccctggcggacaaaaagctgcagcacaaggaacgcgacctgcgccgggtcaacgccctgctcagcgaactcgaccaagcccgcgcctcgctgcaacaggtggcgcactttgacgcgctgaccagcctgctcaaccgtcgcggtttcaaccagatctttgcggagaaagtcgcagaaaaaaccgccagtcacggcatgatggcggtgatcttccttgatatcgaccatttcaaacgcatcaacgacagccttgggcatgacgccggcgaccagttgctcacggtgcttgccgggcatatcaaaggctcggtacgcagccacgaggatgtggtcgcgcggtttggcggcgatgagttctgcatcctgatcagcattcaccatcgcgacgaagcgcggcacttggcgcagcgcatcatgcagaagatgaaagaaccgatcgaactggctggccggcgcatggtgatgaccaccagcatcggcatcagcctgtttcccgaggacggcttgagttgcgaagaactgctgaaaacggccgacctggcgctgtaccaatccaaggataccgggcgcaacagcctcaactttttcagctccaatctgaaaacccgtgcgttcctcgaactgcaactggaagaggaattgcgcgcggccctgcgtggccgcaatcagttggtgctgttttaccagccgatcttcgacatgaagctcggcaaggtcactcggctggaagccctggtacgctggcagcacccgcaacacgggctgctggccccggaccggtttatcgggattgccgaaaacaatgggttgattgccgacctggaccactgggtgttgcgccaggcttgccacgatttgagcctgttgtccgaccgcggctacaccgagttgaccatggccgtgaactgctcggcgctgaacctggcccgtgacgagttggcggatgaaatcgaagccgccctgcgcttcgccgggattgccgccaaccgccttgagctggaggtgaccgaaaacgcgctgatgggcaatatcagcagcacgctggcactgttgcggcaaatccgcgccctgggcgtatcgctggccatcgatgatttcggcaccggttactcatcgttggcctacctcaagcgccttccgctcaataccttgaagatcgaccgttcatttatccaggacattcccaagtccaccgccgatatcgagatcgtccaggcgattatcggcatggcccacaccctgcatttgcaggttgttaccgagggcgtggaaacccaggcgcaatttgagctgctgcttaagcacgactgcgacttcattcagggctacttgctgagcccggcggtgcccttcagtgacatcgttggcgtgattcagggcattcatatgcgcaacccgctctatcccttcagcgtggaaggcaccaaggacgcccctgcgccgaaagacgccaacccaggccgcatcggccccccttctactgtcaggccaattcgctgacgccgaatatttggcatttagccatcatttgcctaaagaacgccgacgaacggccgattcatcagagtccggcccgtattcccctagcgtaactggggttaaacccgaccggcccggactcagacgcactgtaaagtcgcgaactctcattcagtgatggctccctgattttttggccatccgtccaggtacatggcgcccaatgacttccaaaaataactctgccaccgtggtatccgacgtgttgcccaccgttcctgcggaaaaaccctcaggctccaagtcattgagcaacgcccgcccgctggccacccagcagtacctgtacttcaccgaaaccaacacagaccgcatcctcgacaacctcgacggcctgcgcgacatggtgttccccagcctgccccagcaggaaggcgacggtgatgcgcgcagtgagcaagagtttccctcggtgtgcctgatcggcctgggccgctgcggttccaacattgccttggacgtggcggagctggtgtacaacgcgcgcaagttttacctgaacgagttcagcactgaagacaagtcgacagacaagggctaccgcccggcccaatggatccgcaacaacctgcgcctgggcggcggcaaggccaccaagccggtgttcctggtggagcccttggtgatgctgggcgatttggacaaggacatcgccgggcgcatccgcttctcgcgcaagggcgaaaaaagcgggttcctgcgcgactacagcaaaatgaagatcatggacctgtcggaagtgcatgccggcggcgccggtaacgcgccgatcctcggccagtacctggccaagatcatcctcaacaaagacacccagcgtttttccagccctgactggaagatgatccactcgtacctgatcgactcctgtggcatcaaggccaaccagtcgcgcctgtacttttcgatcttcagcgccggcggcggcacgggttcgggcatggcctcggaattcggcctggcccagcaacactcgtacatgaacaagacgttcgacaccaaaccggccgacgagcacgacagcaaaagcggccatgcctttgtgttcgagccgatcttcaccagcggcatttgcgtgctgccgaatatttccgatcaccgcagcgaaatgtccgaggcgttgcacatcaacgccgggcggctgttgtgcaaatacctgtcggaagaatgggatttctcatacaacttcgacaacgaagacagcagcgaggcgagcgtgaaaggccgcattcgcccgtggaacgcgatgatgttgatctccaacgacatcatgcgttacgccgaagagagcgatgacggcaatatccagaacattgacgtcaatgccatggaaaaacacgccaaccaatacatctcacagcagatcttcaacatcctcaccgcccaggcggtgaccactgactacgaccagaactacttccgccgcgccggcatcgacatcggcgaaaccatccgcctggatgccaacgacctgttcatgagcctggccgggccggtggcgattgcctatgccgagtccgtggtgccggaaacgccggcgccgtcgaacgacaagttcaaggtgtttgataaagagccacagcggctgaatatcgatgacctgtttttccgctcgattgatttgccgcacttcaacaaggtgacgcaggccatcgagggcatcagcctgttgccaattgagtccaagcgctacaaggcgtctttggagcagtacaagaactccgggtatgacgcggcggcgctgcatgacctgcacttcttcaagaactgctcgtcggtggtgtcgattgtgtcgttgcccaaggattacaagctgtcatacatggacttgaaccgtctcaagacccacctcaatagcctgtttcccaacacgacgctcaagcgctatgcgttggtgatcggcgcgtcggccaacttgtcgctgaccaccttgatcgccaagagcccgtgcttgtcggatgatttcctcacgttgatcgtggcgtttatcaaacgctgctttgcacgcaacccgtaccggttcgatgacacgctggataattcgattctggatttcatcctccatgaggattttgacgaagaccggattgatgaactgctcaatgagttcgagaacccggcgaagatcctggataccaactggtatgcgatcaaaccgatgtacgagaagaagtatcgcgagttgatcaacgacaaggagaagtttgtgtcgatcaacgatattcgcctgtcacgggattgtgtgaagaaggcgatcaagtatctgcgagagatttatcgtcatcggattggcaagaccaaggtgatttcgttgaataaccataccggcaagacggcttaaaccacgtcacggccatcgcaggcaagccagctcccacattcgaacggtggaccccgatcaaatgtgggagctggcttgcctgcgatagcggtctgtcagccacctgatcactaccatttcgccacacgctgaaacaattccccgagccttcagcgccgcgccaaactgttcccgtgacgcgtacgtcaccctcacctgtgacctttctctacggcaaggtgccatcacggcgccagcggttactccgctacacacttgcgccgaccaaaatcacgcaccattttcgtgcatgcgcttcttacgctgccctttcctggatcaggatccacggtgaaaccaccactgcccacaagctcggatcacgctcaaccaggtccaatgcccgcgttgcagacacctcgccaaggctccccgcagccagccatgcagcgactttgtcgcggttatcctcggccattccctcggccgcctcgatcaaatccaggccggcatcgacccacaatagggcacccttggcgaagaacggctcaagctccttccaggatatttcggcggtttcaccaagcagcttggcatagagggtgctaggttcttgcgtcatgggaattcacctgaagaaaaaatcggcgcaatcataacgtcgtgagccaggcagaaaaacccagttgcaaatgagtcaacgatcgaaagtgtcaggaaagccaaggattgcccgaaactctggcatcaccccgccgcaattctgtctttttctttcattaaagcgacacccccgggttttgcccccagcagccagcttttcaagcgatcaaccggcgctctacactgtaccggtacagttgccagagcactgccggggggatatccgagatatctgatccggttctgcagctcacaaggccgctagaactataaaaaatacaacagtaagagtggagcactatgaataaggctactaagcagatttccaaactgtttgccgctatggtcctggctggggttgccggccattcgttcgcagccgacaccatcaagatcggcatcgccgggcctaagacaggtccagtgacgcaatacggcgacatgcaattcatgggtgcccaacaagccatcaaagacatcaacgccaagggcggcgtagacggcaagatgcttgaggccaaggaatacgacgacgcttgcgatccgaaacaagcggttgccgttgccaacaaagtggtcaacgacggcgtcaagttcgtggtcggtcacctctgctccagctccactcaacccgcgtccgacatctatgaagatgaaggcgtgatcatgattaccccagccgctaccagccctgaaatcacgtcccgtggctacaagatggtcttccgtaccatcggcctggacagcgctcaagggcctgccgccggtaactacatcgccgaccacgtgaagccgaaagttgttgccgttattcacgacaaacagcaatacggtgaaggcatcgccactgccgttaaacagacccttgagaagaaaggcgtcaaagtcgctctgttcgaaggcatcaacgctggcgacaaagacttcggctcgctgatccagaagctcaagcaagccaacgtcgacttcgtttactacggcggctaccaccctgagctgggcctgatcctgcgccaagccaaggaaaaaggcgtgaacgccaagttcatgggcccagaaggtgtgggtaacgactccatctcgcaaattgcccagggcgcttccgaaggcctgttggtaaccctgcctaaatcgttcgatgcagaccctgccaacaaggcaatcgtggacgcgctcaaagctgacggcaaagacccgtccggcccgttcgtgttcccggcctactcggctgtggaagtgatcgccggcggtatcactgccgcgaaaagcgaagacaccgccaaagtggctgcagccatccacgcgggcaccttcaagacccctaccggcgacctgagctacgacgccaagggcgacctgaaggacttcaagttcgtggtctacgaatggcacttcggtaaaccaaaaaccgaagtgtcccctcagtaagccaggcgttactggtccaacaagcccactgtgaaagcagtgggctttgttttacgaggtttatgagcctgtcacccgcgatccgggcgctggctcacctgaaaatcttaaaaccgtcaccagcggttcgctggcaaacgctttgcgcaaatgtgctcacagaacacagcgcagggccggaacatgactccaccagtgaaatgcgtatcgggtttttaggagcgctgtaatgcctgagatctatcattttttccaaacgctggttaacggcatgaccgttggcagcacctatgccttgatagccattggctacacaatggtttacggcatcattggaatgattaacttcgcccatggcgaggtgtacatgattggttcctacgtggccttcatcgcccttgccgggctggccatgctgggtatccattccctgccgctgttgatgaccgctgcgttccttgcatcgatcgtcgtgaccagtgcctatggctacagtatcgagcgggttgcctaccgtcccttgcgtggcagcaaccgtttgatcccgctgatttccgccatcggcatgtcgattttcctgcagaacaccgtactgctgtcccaggactccaaggataagtccattcccaacctgatcccggggagcatctccttcggcccaggtggcgcacaagaagtgctgatttcgtacatgcagatcctggtcttcgtcgtcaccctggtggccatgctgggcctgaccctgttcatctcccgctctcgtctggggcgcgcctgccgggcctgcgccgaagacatcaagatggccaacctgctgggcatcaacaccaacaacatcatcgccctgaccttcgtcatcggtgctgcgctggcggccgttgcggcggtgctgctgagcatgcagtacggcgtgatcaaccccaacgccggtttcctggtgggcctcaaggccttcaccgcagcggtattgggcggtatcggcagtattccgggcgccatgctcggcgggctggtactgggtgtggccgaagccttcggcgccgacgtgttcggtgaccaatacaaggatgtggtggcgttcggcctgttggttctggtgctgttgttccgtccgaccggcattctgggccgtccggaggttgagaaagtatgagcagatatcttaaatcagcgtttttcagcgctttgctggtatgggccgtggcctttccggtactcggcctcaagctgagcattgtcggcatcaacctggaagtacatggcaccggtcccgtgaccctgaccatcatcgccttgtgctcggtgctgatgttcctgcgcgtgctgttcacccagcaagtaggcgccttgttgaaaggtaaccgtggcccgctggtttcgcccaaggtcagccaattcctgaccctgccgcgtacccagcgctacatcatcatcggcctgatcgtggccgcgttgatctggccgttctttggctctcgcggcgcggtcgacatcgccaccctgatcctcatctacgtgttgctgggcctgggcctgaacatcgtggtgggcctggccgggctgctcgacctgggttatgtgggcttctatgccgtgggtgcctacacctacgcactgctctcgcactacctgggctggagtttctgggtttgcctgccgctggccggcttgatggcggccacgttcggtttcctgctgggcttcccggtgctgcgcctgcgcggtgactatttggcgatcgtgaccctgggcttcggtgaaatcatccgtctgttcctgcgtaacctcaccgatatcaccggcgggcccaacggcatcagcagcatccccaagccgacgttcttcgggctatcgttcgaccgcaccgccgccgaaggcatgcagaccttccacgagtacttcgggatcgactacaacccggtgagcaaagtggtgttcctgtacctggtggcgctgttgctggcactggccgcgctgttcgtgatcaaccgcctgctgcgcatgccgatcggtcgtgcatgggaagcgttgcgcgaagatgagatcgcctgccgtgcgctgggcatgaacccgacagtcatcaaactttcggccttcaccctcggggcaaccttcgccggtttcgccggcagcttcttcgccgcgcgccaaggcctggtgaccccggagtcgttcacctttatcgagtcggcgatcatcctcgccatcgtggtactgggtggcatgggctcgcaactgggcgtgatcctggccgcaatcgtgatgatcctgttgccggaaatgatgcgtgagttcagcgaataccgcatgttgatgttcggcgccatgatggtgctgatgatgatttggcgtcctcaaggtctgctgccgatgcaacgcccacacatggagctgcgcaaatgagccgcgagatcctgaaagtcgaaaatttgagcatgcgcttcggcggtttgctggcggtcaacggcgtggccctgaccgtgaaagagaaacaggtggtggcgctgatcggcccgaacggcgccggcaagaccacggtgttcaactgcctcaccggtttctacaagccgagcggtggcagcatcctgctggacggccagccgatccagggcctggccggccacgaaatcgcccgcaagggcgtggtgcgcaccttccagaacgtgcggttgttcaaggacatgacggcggtcgagaacctgctgatcgcccagcaccgtcacctgaacaccaacttctttgcgggcttgttcaagactccgtcgttccgcaagagcgaacgcgaggccatggaatacgcggcgtactggctggacaaggtcaacctcaccgagtttgccaaccgccctgccggcaccctggcctatgggcagcaacgtcgcctggaaatcgcccgttgcatgatgacccgcccgcggatcctcatgctcgacgaaccggcggccggcctgaaccccaaggaaaccgaagacctcaaggcgctcatcagcgtgttgcgtgaggaaaacaacgccaccgtgctgttgatcgaacacgacatgaaactggtcatgagcatttccgaccatatcgtggtgatcaaccagggcacgccgctggccaacgggacgccggcgcagattcgcgacaatcctgaagtgatcaaagcctatttgggggaagcgtaaaatgctgcaattcgaaaacgtttccactttctacggcaagatccaggccctgcacagcgtcaacgtggaagtgcgccaaggtgaaatcgtcacgctgatcggcgccaacggtgccggtaaatcgaccttgctgatgaccctgtgcggttcgcctcaggcccacagcggcagcatccgctacatgggtgaagagctggtaggccagcagtcctcgcacatcatgcgcaaaagcattgcggtggtgccggaaggccgtcgcgtgttctcgcgcctgaccgtcgaggaaaacctggccatgggcgggttcttcaccgacaagggcgactaccaggagcagatggacaaggtgctgcagctgttcccgcggctcaaggagcgcttcagccaacgtggcggcaccatgtccggcggcgaacagcaaatgctcgccatcggccgcgcgctgatgagcaagcccaagctgctgctcctggacgaaccctccctgggcctggcaccgatcatcatccagcagatcttcgacatcatcgaacaactgcgcaaggacggtgtgacggtgttcctggtggagcagaacgccaaccaggccttgaagattgctgaccgcgcctacgtgctggaaaacggccgggtagtgatgcagggcacgggcgagcagttgctgacggatccgaaggtacgggaggcttacctcgggggctaatacccggttgctgtaggaacttgatctaaaaaatgtgggagctggcgtgtgtgggagctggcttgcctgcgattgcatcactgcggtgtgtctgacacacaacggtgactgcatcgcgggcaagcccggctcccacacatgccagctcccacatttgctttgtggcgtccttaaattttgcatttgttgaaattattttcgtcgcgcttgtaacgaaattcaccctgctgcctctagtggagtaagcaggcaatcaagctcgctacctcaacccaccgctggagatacaccatgaccactaaactgtccgccgcttccctgatcctggccctcggttctgctctgagcctgtccgcaatgtccaacatggcccacgccgacgaggccaaaatggacaaatgctacggcgtcgctgaagccggcaagaacgattgcgccgcaggcgccggcactacctgcgccggcacctcgaaagtcaaagaccaggccaatgcctggaaactggtcccagccggcacttgcggcaaaaccccaagcctcacctcgccgaccggtttcggccaggaagctgccttcaccgccaagtcctgatccctgcgccgcctgagtactgatgatgacgcttttacctcaacacacggtctcaccggctcaggtgcccggcctcccctacagggccgggctggggctgaagaacgagcacttcatcgaagtgctcgagacctcgcccgacatcggtttttttgaagtgcacgccgaaaactacatggtggccggcggccctttccatcactacctgggtttgatccgcgagcagtacccgctgtcgctgcacggcgtgggcctgtccatcggcggcgaaggcccgttgaaccgtgagcacctggcacggttggccacgctgatcgaccgctatcagccccactccttttccgaacacctggcctggtccagccacggcccggtgtttctcaatgacttgctgcccctggcctacgatgccgccaccctgaaccgggtgtgcgaacacatcgatcaggtgcaaagcaccctcaagcggccgatgctgctggagaacccttcgacgtatctgcagttccaacgctccaccctggacgaaacggacttcatcagcgagatcatccgccgtaccggttgtggcctgctgttggacgtcaacaacgtctacgtatcgtgcatcaaccaccaacgcgacccactttcctacatcgacgcactgcctttgcgcgcagtcggtgagattcatctggccggttttgccgaagacaccgacaacctgggtgaccgcctgttgattgatgaccacggcgcacccatcgataacgccgtgtggcagttgtacgaacaggtcctcacgcgcaccggcccggtagccacgctgatcgagcgcgataaccaggtgccggccttcaatgtattgcaagccgaagcccaacacgccgactggcacctgtcgcaggtgaacgtatgagccatcatgccgcgtttgccaatgccttggtcgaccctggccaggcgtgccccgaaggccttttcagcagcaacggcgccgacccggccagccgctttgcggtgtaccgcaacaacgtccacagctcattggtcaacgcactggcgacggcttacccagtgacgctgcagttagtcggcgatgagttctttcgtgccatggctggcttgtttattcaggcgtgcccgcccaccagcccgctgatcagcgaatacggcagcgcattctcagcgttcatccaggacttcgaacccgccgccagcgtgccttacctggccgatgtcgccaggctcgagcgcctgcgggtgcgcgcctaccacgcggcagataccgagccgctggagcagcacagcattctgcaagcgctgcaaggccagaccgaccttggaaaattgcgcctgcaactgcatccgtccgtagccaccttgaactccacctacgcggtcgtggctgtttgggctgcacaccagaccgagggcggcgtggccaccttgaatccctggcacacccaaagcgcgctggtgttgcgccaaggcctggctgtgaaggtgttcgccatcgacagtggttcggccgcgttcatccacagcctgcaccacggcacagcgttggaaatcgcggtgcagcacgccctcgaagtgtccgccgaatttgacctgaaccaatgcctgaccctgctgatcagccacgacgccatcactcatttgcattcagaacaaaaggtatcgccatgaacacctccccttcgtgcctggttaaacgggccatcgcactgttcgagaaaatcccctacagcctgatcgcctttctcgcgcggttttccatcgcggcagtgttctggaagtccgggcaaaccaaagttgaaggctttgccatcgatatcatcaacggcacattccaactcggcgaacccaaacttgccgcctcgacgctgccgttgtttcgcagtgaataccacgtgcccttgctgtcaccggaagtggccgcgcacatggcggcttttgccgagcactttttcccggtgctgatcctggtaggttttgccacgcggttctcggccctggccctgatcggcatgaccctgaccattcaattgttcgtctacccggaagcctacccgacccacggcacctggatcgccttgttgctgctgttggtcgccaaaggcccgggctgcctgtccatcgaccatctgatcgcgcggcgttatcgctgaagacggtccagggcttcgccgctgcgcttgaaccagtccaccaggtaatcggctaacacctgagtacggcgcggcaagccgccctggtaagggtgaaccaagtacatcggcatgcttcgcgtctgataatcacgcaggagccagcgcaatcggccatcagccaattccgcaggtaaaacgtaggacggcaggcgggcgatgccggcgcctaccagcgcggcttttttcaacaggttgtagtggttggaagcaaacgtgccgctgacccgcacacgcagcagttcatgctgctggtgatacagccattcttcacggccgctgtagtggctgttgagcaagcaggtatgcgtggccagctccgccggggtcagcggttcaccgtgctgttccaggtaagcggggctggcgcaggtcatctcgtgccaggccagcagtggcttggccaccaggcgctcattttcgatagcccccaagcgcacgcccaaatcaaaaccatcgcgcgccaggtctcggtagctgttattcaattccagctcgatctgcacctgcggatactgcttggaaaactccagcagcaagccgtcgaagaaggtttcccccagcgacaccggaaccgtcatacgcaccggcccggccaaatcgtccttgagtcgcgccaatgcctgacgggcgcgctccacctgtaccaccagtgcctgagcctggggcaacaacgccgcaccggctgcggtcaggctgagcttgcgggtggtgcgatgcagcaacaccacggaaaactgcgcttccagttggctgatgcgcttggacagctggcctttgctgcaccccagctgttcggcggctacggtgaaactgccggcttcgatcagtacggcaaacgccgccaagtcatccatctcgctcatggattgtttccatttgaaaaccaaaggttgcctattagcgcgtttatccaccagaaaagccacactagactgaaccttcacttacccctggaggaacagcacgatgaaaatcctattgattggtgccagcggcacggtcggctcggcagtcaaggcagaactcgcccaacgtcacgaggtgatcagcatcggtcgcaccagcggcgacttccaggtggatatcagcgacagcgcctcgatccgcaagctgttcgaacagaccggcaagttcgacgccctggtctgcgcagcgggcagcgtgaacttcgtggcgttgggcgacatgagcgaaagcgatttcgaactgggcctgcgcgacaagctgatgggccaggtcaacctgctgctgatcggccgtgagtacgccaacgacggcgcctcgttcacctttaccagcggcatcctcaaccgcgacccgatccgcaccggcgcctcggcggcattggtcaatggcgcgcttgacgccttcgtcaaagccgcggcgatcgaattgccacgcggcttgcgcgtcaactccgtcagcccgaccgtgctgctggaagccatgggcagctacgccccgtacttccgtggcttcaaaccggctgctggcgccgacgtggcattggcctacgcgaaaagcgtcgagggcttgcagaccggccagacctacatcgtcggttgagaggcaattgcctcacgcgagaactgagacatccattcaatcaccaggacgcgggggaccaaaagcctgaactccccgcccagctcgctgtgaaccattgaagtacttagcgggtaaccgtctacgtagagtgtcaggtatttgttgatggtaagcagcgtgatggattttgtccttgccctggcttcaggactcaacgtgacgtttacctcaacgtaggccgggtcagggttctcggcccgtttcaacgacacccagatgtctgtgaagtcagtgactgacgaaaagacgagccgggcaggctcgtctgaacaggccgcacttgcccagagcagaacagcgcacaggctccatttgatattcattgaaacaccctctccaaaaacgtcgacactcttacgattccccaacactcactgtaggaaatatctcaattagcaacgcgtcatttcccagcgtgttccgaacacagcgttcaaaccgggtcctgcacttgtgatgcggcgtcagcctgcgtaacgtggcggcacttgtttggagacccgataaatgcgcgccgtccgtacccttgctctgtttgccctgttgcccctgttcaccgcttgtcagatgttcgaaagcgagccggccaaaccctctaccgcagggttgacccggatgcagggtgagttgaccgccgtcggcggcaagctgctgttccagccttgcggcgacaaacgcaactacgtggtcaacgacgccggtggcaccagcatactgcaggaagccgcctccctggctggccagcaaggcgcgctgtttgccgacctgcgcggcaagttctccggggtcgccagcggcacccagggttcggtggacctgcaacagctctatcgcatggagcgttcgacctcagcctgcaacgacccggacttcaagcgcatggtcctgcgggccaacggccataaacccgcctgggcaatgaacgtcaccgccaagggcatggtgctggagcgcgaaggccagccgccacttgccgtgccgtttgtggaagagcagctgggtgacgggcgtttcaacctgatgaccgaagccaataaccagcacatcgaactgtgggtagccccgcagcgctgcatcgactcggtcagcggcagcctgcagcacatgaccgccgagttgcgcgtcaacggccaggtacagcgtggttgcgcggcatttggcggctcacgcgacgactgattcagccctgcgctgttttaacctgacggaaaaccgccattggggcttataatcgccggtttgcaaaacagccggcctttttgtccgccgcctaccggatcccgtcatgttacgaatcaccgaactcaagctgcccatcgaccatcccgaagaagacctgcgccctgccatcgtgcagcgcctgggcatcgccagtgatgacctgctcgatttcaccctgttcaagcgcagctacgacgcccgcaaaaaatcgtcggagctgtgcttcatctacaccatcgacctgaacgtgaagggcgaagccgccctgctgctcaagttcgccgatgatcgcaacatcaacccggcgccggacgtcagctacaaggtagtgggccaggcgccacaaggcctggtcgagcgcccgatcgtggtgggttttggcccctgcgggattttcgccgggctgttgctcgcgcagatgggcttcaagccgatcatccttgaacgtggcaaggaagtgcgccagcgcaccaaggatacctggggcctgtggcgcaaaagcgtgctcaaccccgagtccaacgtgcagttcggtgaaggcggcgccgggactttctccgacggcaagctgtacagccagatcaaggacccgaaattccacggccgcaaagtcctgcacgaattcgtcaaggccggtgcgccggaagaaatcctctacgtcagcaagccgcacatcggcaccttccgcctgaccggcgtggtcgaaaacatgcgccagcagatcatcgccctgggcggtgaagtgcgtttcgaacagcgcgtcaccgatgtgctgatcgaagacgggcaactgaacggcgtggtcatcgacggcggcgaacagatcctctccaagcacgtgatcctggcgctgggccacagcgcccgcgacaccttccgcatgctgcacggccgtggcgtgtacatggaggccaagccgttctcggtgggtttccgtatcgaacacccgcagtcgctgatcgatgccgcgcgcctgggcaaatacgccgggcacccgaaactcggcgcggccgactacaaactggtgcaccacgccaagaacggccgctcggtctacagcttctgcatgtgcccgggcggcacggtggtggcggcgacttccgagccgaaccgcgttgtcaccaacggcatgagccagtactcgcgtaacgaacgcaatgccaactccggcatcgtggtcggcatcacgcctgaagtggattacccaggcggcccgctggcgggtatcgagttgcaggaacgcctggagtcccacgcctacatcctcggcggcagcaactacgaggcgccggcccaactggtgggtgatttcatcgccggcaagccgtccacggccatcggcagtgtggaaccgtcctacaaaccaggcgtgtcgctgggtgacctggccttggcattgccggacttcgccatcgaagcgattcgtgaagcgctgccggcgttcgagaagcagatcaagggctactcgctgcacgatgcggtgctcaccggcatcgagacgcgcacctcgtcgccgctgcggattacccgcaacgagtcgatgcagagcttgaacgtgaaaggcctgttcccggccggtgaaggcgctggttatgccggtgggattctgtcggcgggtgtggacgggattcggattgccgaggcgttggcgcgggatatgttgggcatcgaggcgtaatcactcacttacagccgacccaatcaaatgtgggagctggcttgcctgcgatggcggtgattcagtcgataaattcggcgactgacactgcgctatcgctggaaagccagctcccacattggtttttgggttgtgtcagatattggcgctcaagaccgtttccggtagtggctcgccccgctccacactggccgccaccgcggcgatcaacccgtccaactgatagccctgccccgctaaccacgcctgatcatagtaagtgctggcataccgctcgcccccatcacacaaaatcgccacgatcgaccccgactcgcccgccgcgttcatctgctgcgcggccaccaaggcgccaatcaggttggtcccgctggacccgccaacccgccgccccagtcgttcggccaggtaatgcatggccgccagtgacagcgcgtccggcaccttgaccatcgcatcgatcaccttgggcaaaaacgacgcctcaacccgaggccggccgattccttcgatccgcgagccgcaatccaggcgcaggctggcgtcgccggtctggtagtaatcgaagaacaccgaacgctcggcgtcggcacacaacacgcgggtgcaatgctggcgataacgcacatagcggcccaaggttgccgtggtgccgccagtgccggggctggaaatcagccagctcggctcggggtaatgctcaaaacgcatctgctggaagatcgactcggcaatgttgttgttcgctcgccagtcagtcgcacgttcggcgtaggtaaattggtccatgaagtgaccgccactttccttcgccagccgttcggattcggtgtagatctgcgtcggatccttcaccagatggctcctgccaccgtagaaagcgatctggtcgatcttcgcctgggacgtcgtggccggcatcaccgcaataaacggcaggccgagcaaacgcgcaaagtacgcctccgaaaccgctgtggaaccgctggacgcctcgatcaccggggcgcccggtttgagccagccgttacacaaggcatacaggaacagtgaacgggcaaggcgatgcttgaggctgcctgtcgggtggctggactcatccttgaagtacaactcgatacccggcaaccccggcaatgccaaagggatgaggtgcgtgtcggcgctgcgctgaaagtccgcttcaatgatacgaatggcttcgcgggcccaggtacggtggtcgctcatgaggtgcgtctctgaagatttcagccccgattttagggggtttcctacactgcacacagatacagtgacgtctcaattagacacacaattgctaggctcaagcgcgacgccaactctgccagccgcttataacaaataagaatataacttttgttttaacaactaacggtacgggttagggtagccacctattgaaccttgattggagagcatcccttgcctctgcgtagcactttcacccgtttcttccagctggaagccgccagcggtctgttgttgatcgccgctgccgccctggcgctgatcatcaacaactcaccgttgtcgcacctgtacaacgcatttctcgacgtaccggtggtggcacagatcggcgcgctgaaaatcgccaagcccgccctgctgtggatcaacgacggcctgatggccctgttcttcctgttgatcggcctggaggtgaaacgcgagctgctcgatggccacctgtccaagccctcgcaagtggtgttaccgggcgccgcagcgattggcggcatggtggtgccggcgctgatctactgggcgatcaacaaggactaccctgccgcgctttcgggctgggcgatccccatggccaccgatattgccttcgcactcggcgttctggccctgctgggcaagcgcgtgccggtgtcgctgaaactgttcctgatgaccttggcgatcatcgatgacctcggtgcgatcatcgtcatcgccgtgttctattcagccgatttgtcaggtgccgcactcgcgggtgcaggcgcctgtttggttgccttgatcgcgatgaaccgcctgggcgtgatcaagctggggccgtacttgatcatcggcctgatcctgtgggtgtgcgtgctcaagagtggcgtgcacgccacgctggccggcgtgacactggccttctgcatcccgatgcgcaccaagaatgccgagccgtcgccgctgatgacgctggaacacgccctgcacccgtgggtggcctacgccatcctgccgctgttcgcgtttgccaatgcgggcgtgtccctgaccggcgtgagcctggaaagcttcacccaccatgtgcccatgggcatcgccgccggcctgctgatcggcaagaccgtcggcgtgttcggcctcacctggcttgcgatcaagaccggccttgccgcgctgcccagcggcgcgaactggggccaggtgtttggtgtggcgatcctgtgcggcatcggcttcaccatgagcctgtttgtcggctcgctggcgtttgtgccgggcgccagtgagttcgccggcgaggatcggatggggatcctcaccgggtcgatcctggcggcgtgtattggttatgcggtgacggcgatggccagtcgcaagaaagcctgaacgcgctgacagccccacaaaaccccccaactggtcgcctggttgggggttttcttttgctgaagatgacacttaccgcaatcgcctaaagactttctgccagccgccgactagtgagtgtggcgagccatctgttcccgccaggaacacccgcccgacactgctccccaacgcgtttccagcccgagcgaaaatcccatgttcctgagaaatataagaatcgcagccagagccttcatcggcttcgccgctattgcgtcgctgagtgtgtttctcgggctgttcgccctgaagcagattggtgaagtccagtcccaggcggccgacattcagaataactggatgcagcgcgtcaggatcctggccctggccaatgcttcgctggaccgttttcgtttgggcgagatggcgcacatcctgtcgtccagcgatgccgacatgcagacctacgaagacaaatccgcaggccgcctgaaaagtgtcaaggaacagctggctcaatatgctgcgctgctgcgcacgccagaggaaaaatcgcgtctcgatgtgttcaaccagagcctcgaagggtatgcgaagaaccacaccgaaatgctcaaacgctcgcgctcaggcgacaaggccggcgcccgcgactttctcaacagtattcgagaaagctatgagcagatgaccaagaacttcgatcagctgatagatctggccaacaaaggcgccgagcaagccggccagacctccgacgccgcttaccaacatgccgtgggcggtatcaccatcgttattctgctggtgagcggtggcacggtgctggtggcctggctgctgacccgcagcattaccggtcccatcattgaagcggtgcaggtggccgaaaccattgcccggggcgacctcactcagcccatcaacccgacgggcaacgacgaggccacgcgcctgctgcgggcgcaagaaaccatgcgtaacaacctggtacagaccctgcggcaaattaccggctcatccagccaattggccgcggcggctgaacaactgaatgcggtaaccgccgagggtagccgggacttgcaacagcaacacgccgagattgaacaagccgccaccgccgtcactgaaatgaccactgcgattgaagaagtcgcacggaacgcggcatcgacctccgacctttcccaagagtcgcgcagcatcgccttgaaaggccagcagcgcatggtcgaggcgttgaattcgatccaggcgctgacccgtggggttgaagtcagctcgggtcaagtcggcggccttgccgagcaggccaaagggatcggcaaagtactcgatgtgatccgtaccattgccgagcaaaccaacctgttggcactgaacgccgccatcgaagctgcacgcgccggtgaagccgggcgaggttttgcggtggtcgctgacgaggtgcgtgcactggcccatcgcactgctcaatcaacgcaagaaatcgagcagatgatcggcagcatccagaccaacaccgccagcaccgtcaacaccatgctcgacagcagttccatgacccagcaaaccctgggcctggccgagctggcgcaacaggcattggcggacatcctggcggccaacgatgagatcaacggccgcaacctggtgatcaccacagcggcagctgaacaagccgacgttgcccgggcggttgatcggaacttgctgaacatccagcagttgtccattcagtcggcggaaggctcgacccaaacgactgcggcttcgcaatcgctggccagcctggcgcatgagttgaacacgatggtgaagcactttcaggtttgaggtgaggctttaaaacttcacaacgccgggctgagcgaagtcactgtggcgagggggcaagctccctcgccacagacaaacttcgacatactcggccctccatgagttgggccttacctccagcctacgccttactaaggcgggtttttatcgcctgctgttttggaaaaaaacctcaaaaaaaccccaaccggtcacccggttggggttttgtgtttctacgaccgttgcttaacgcgtaacgcggctggtgccgttaacggtcatgatgcggacgcggtcgccgatgcggaagatttcgttctcttcaaccgcctggacgtaggcgcgcatgctgccgtcgtcttcgcgaacggtgatttccacgccctgggtacgggtcaggccttcttcggtggccgaacccagcaggccgccagctacggcgccgatcacagcggtgacgatactgccacggccgccgccgatggcgctgccgccaacaccgccgataactgcgccggcagcgccgccgattggggtcttggtgccttcgattttcaccggacgcagggattcaatggtgcccatgcgaacggtctgtacacggcgcgcctcgtcacgggagtacgagtcgccggtcagactcgaggcgcagccacccaacagcaacgacagggtggtaaagcaggcaactagtaaaacggacttacgcatagcatcaactccaaaggacaggtgttcattagacgccgcagcttggcgcctgtcacggcaagcacgtcagaaaattcctttcattcagccttagtacagactagcagcaccagaaaactcgacgaacggtagctgaattcttgttccaaagaatgtcacggacccgttgattgtagtcgtccagcagcgcacgccgaagcctcttgggtagagacttcggtgtgactggcaacattcaggagaagtgacgaaaggtgaaaatcagggcgccaggcgctcacgcgtccactcgccgttttgcaggcgatagttcaggcggtcatgcaggcggctggcgcggccttgccagaactccatgcgctcaggcagcaagcgataaccgccccaatgctcagggcagtcgggttgggtatcgctgaaacgctgctcagtggccttgagcaagtcctgcagctcttcgcggtcacgaatgacctgactctgcggtgatgcccaagccccaaggcggctgcccaaaggacggacctgataataagcgtccgactcctctggcgtgaccttgaccacccgcccttcgatgcgcacctggcgctccagggtcggccagaagaaggtcatggctgcaaaaggccgtgccgcgagctgttcacccttggcactctgataattggtgaagaaggtaaagccctgagtatccaagcctttgagcagcaggatgcgacagtgcggacgaccgtcctggtcgaccgtggccaaggtcatggcattggcctccaccgggagctgctcggtcttcaccgcgtcggcaaaccactggtggaacaacgcaaacggctcgcccggggcctgggcctcgctcaaaccgtcccgtgtgtagtcacggcgcatatcggccagtgcctgggtcatgcggctttatccttctggttcagcagatcagtttttcgcctggtcgtttgcagcggctgcgtcagccttaggtgcggcttttttcgcggccggtttggcggcggcttttttcgcaacaggcttggcagcggctttcttggccggggcctttttcgcaggtactgcctttttcgcagccggagccggcacgggggcgggtgctgtttgcacggcgaccatttcagcaaccggtggcttgcccgagttgtacttgctcagcagggccaacatcgttgtacgctgagtgaacatgatttccatgcgacggttcagcgcacgcccctgattgctgtcgttggcggcacgcggcataaggtcgcccatgccacgcatcatcaggcgatcctgcttcaagccactgaggctgaaaatcgacgcgatggactgcgcacgctcacgcgtcaacgcctggctcgcaggttcggcaccattggtgtcgacgtggccgagtaccagtacggcggttttcgggtcgccttcaaccgccttggcaacgcgggtgaacgggcccagggtcactggcagcagcatccctggacgttttgggttgtaggagccatcaaccggtgcgatgacgaccagtacgttctcgcgacgctccagctgcaggttgctgtccttgatggcggcgcgcaggcgcggctcatagtcatccagccaggcttgggtgattttcgggtcgggcatcggcacgttggtcacgtcaaccttggccaatggctttggcttgctttcgaacggccaccaccatttggtctcggtgtcggtcttggccacagcaggcgcagcgtcaggtgtggaagcaggggttgccgccttgaggtcggctttcaggtcagccttggcatccgccgccttttcgtcggcggtcttggaggagaacggccaccagttgaagccggtgtcagccttggcgaccggggccggtgcggcggcggcagcagcaggagcaggagcagcagcagttaccggcgcggcgggcttggcgccagcggcaggttttgcatctggcttggcgtcggtttgagtcactgcgtccttggtagcagccttatcagacccaaattgccaccaatgcccaccctcagcatcattttgtggagtttgtgcgcagccagtaatagtgaggcacagcgccagtgccaaggacttgttcgataacatgagatatccacaaaatgagaaaaaaccggagggcctggttgacccgttaaacagacgcttacagaacattaaagttacaaaatttcgttcagcgccttcttatagttgcatttgtaacaaaaaaacgtgaaacagcaagctctttacagacaaccggccaatattccgaccaacttctgtgcacgcgggtccataagtacgtaaggccccagtgtattagtcacgaaaccgaatgctacatcatgttccgggtcggcaaaccccaccgaaccaccggcgccagggtgaccaaacgcacgtgggccaaggccgaacgtggcattgggcaattgcggttgatccaacatgcagcccaagccgaagcgggtttgggtcaataaggttttatccgggccgatactgtgttcgcgggtcaattgttcgagcatgtcgctttccagcaaactaccgtccaacaatccgctataaaaacccgccaggctgcgcgcattaccgtgaccatttgccgccggctgctgcatgcgccgccattcgggcttattagtgctggtcagaatagacggtgggttggcaaatgcacgtgtagtcatggccgcaggttcacgcatcattacttgcaataagcgttgagcggcttcgtcgcccatattgcctttgctgcgcgctatatgtgcaacacgataaaactcttcatctgccagccccacgtgaaagtccaggcccaacggccgcgcaacccgtgcgacgatcgactcacccggcccgcgcccatcggcgcggcgcagcaattcaccgaccagccagccgtaagtgatggcctcgtagccatgcccttggcccggcgtccaccacggtgcctcggctgccagggtgtcgaccatcaattgccagtcgtacagggcttcagtcggcagcatctcgcggattgccggcagcccggcctggtggcagagcagttggcgcagagtgatggcttctttaccggctgccgcgaactcgggccagtagtcagccacgggcgcatcgagttgcaacttgccctcggccaccaattgcagggccgtgacggcggtgaaggtcttggtgcaggagaacaggttgacgatggtgtcgctgtgccaggcctcggcgccgtccttgtccgcagtgccggcccacaggtcgacgacggtttcgccgccgatctggatacacagcccggcaccacgctcctgcgggtcatcgaacagcgcggcaaacgcttcgcgtaccgcttcgaactgaagctcgtaatgaccctgaatctgcacctgatccgccttgaacaacactgtaggaagtggccgacattgttccagtcattaggggttttgtgaacccgtcaacgatgaatcaatggccatttccagagtgcccaccggcgtgtccggcgccctggcctgcgcctttgccttcatgcccgcccttgccggcttcgttctcgcgaaccacgctggccgccttggccttttccgcctctttacccaactggtcgactgtcgccaggttgcttttacgcacgctgtcgacaaagccctggaacggcacgtcggtaatgccgacaaggccgaagtgaccgttctcaccgtccagcaaacggccggttaccggctggtccaggtactggaaccagtgcacgccgacaatcgacggctcagccatggcctgcttgaggaagttgccgtaagccacgccacggtcgtcttccttggccaactgcgtcacgccgccccagaacgggccacggtcggcggagccgaaattgaactcggtaatcagcaccggcttatccagcgcgcgcagggcggcgaagtcataaccgtcctggggcttgagggtgtacatgttgaagctcagcacatcgcaatactgcgcgcaggaggccacggcttccggggtgctcacggcataacgaccgcccagcaacagctggttgggcgcgtgccacttcaaggagtcggaaatggtcttgaaataggcatcggcgaaggtcttctggaagtatttgaagtcagcttcgatttccgggtgctcggggcttggcatcggtggctcgaagcctgggtcttccatcagctcccagcccgccaagtgaatgccccaggccttcgacaggccttcttcgttgcggtacttgtcgcgcagttgcttgagaaacgcgcgcttggccggtacgtcggtggtcatgcgcagcgtgccgtaggccaaggcgtaacgggattttgcatcgtcacccgggccggcccaggccagctcgttgtcggcaaagaagccgatcagccacgggtcatcgcggtgatcgcgggcagcaatcgccacggcgcgctcggtggccatggcgaaacgcgggtcgaacgggtcaggcatgccgccccaccagtcggtgccggtgctgatgctggcgtagtcgccgacaatcgacagcggcaaggtgtacggcacgcggtcggcgctggcgaggctctcgtcgctccagttgcccacggtgttgaaaccccaggcctggaggcggtcgagggtgtgggtgacccagcgtttctggtcgaaaccttcggtgccatacgtgcgctgcaggttggcgccatagaagtcgtaccaacgccccacattaaagccccggccctgatcggcgccgttgccgcctcggttgtcgctgctgccgtagtacttgtcgaacggctcgcccgccttgggcaacgcggcgaacatccactcgcggccggccacataggtctggttgttatccggcgcaaccgtgttaacccccaaggaatagaacggatggccttccggcgtcaccaagtaccagcggccgtcgcgcttctcggtacggaaaaagccgctggcttcgaacgccgggcctttgttccagccgccatattggtccagggaagctttgttgcgctcagccaaccagcctttgagctgctgttgctccttggcggcggcggctttgagttggtcgtcgctgctgactttttccggccagcgcgcgcgggtggactggccataggcatccaccagttcgctgtaggccgctttcagcaccggctcgctgtcctgcacgccaaaccgctccagcaggatgctttgggcggcattcggcttgagcatcgacagcgtcacagacgccacctggctgcggtcgatttccccggcgctgccggccagcaatacgcgctggccatccacggtgatcggcatcggcgggccggccttcatgccctggctcagcggcgagttggcttgcaacggaatcaccagggtctgggccggaccggccggcaggtcgatgcggctgaccagggttttgccgtcggtgctctgcactttgacgtagagggtcaacgcccagtccatggcgcactggatacgcaggctcatggcgccggactgcgaccagtcccacacgccggtctgcgggctgagcaccaggctcggttcggctgccgggttgaacgtgatgcggcgcagcacctcaccttcaggggtttgttcggcgttgtattgcggcaggctggcgtcctgggtcgccaccttgaccacatcggcaggccggacgaagttgaacagcgtttgttgcccggcaggcgcggccatcaagggtgcggcgaacaacaaggcaaaaagagcgggcagcgtgcgaatcatacgaacaaggttctcccaaacggccggtgactggcctgatgacgtaatgcgttggcagtgagatagaccacgaagtgggcgaattcgcccacggtggcttaagaaatttcgcgcctgaaaggcggcaaagcattcaggatagctttgccatagcgctgcgtgaccaaacggcggtcgagcaaggtgatggtgccccggtcttcttcggtgcgcagcaagcgaccgcaggcctggaccagcttcaaggaagcatccggcaccgagatttccatgaacgggttaccgccacgggcttcgatccactcggccaaagccgcctcgaccggatcgtccggcaccgagaacgggatcttggcgatcaccacgtgttcgcagtaggcacccggcaagtccacgccttcggcaaaacttgccaggccgaacaacacgctggaatcgccgccatcgacgcgcgccttgtgcttgttgagggtttcctgcttggacaggttgccctggataaacacctgcttgcgccaatcgcggtcgaggccgtcgaacacgtcctgcatctgtttgcgcgaagagaacaacaccagggtgccgcgcgagccttcgaccagctccggcaggtcgcggatgatcgctgcggtgtgcgccgctgcgtcgcgcgggtcagccttgaggtccggcacgcgcagtacgccggcgtcggcgtgatggaacgggctcggcaccaccgccgtaacggcttttttcggcaagccggcacgcatgcggaaacggtcgaaagtgcccagggccgtcagcgtcgccgaggtcaccaggcagccgtaggccacgttccacaggttgcggcgcagcatttcggcggccaggatcgggctggcgttgacctcgatatcaaacagcgcaccgctttccgacagggtcagccagcgcgccatcggcgggttgtcttccgggtcttcgacggtgaaggccgtccacagctcccagttaccctgggaacgcgacaacaggctgccgaacagcggataccattcctcggcctggttgctggcgatgccgatattgacctcaccgtccatgccttccttgagcaggtcggtgaggcgggtgaacaggtcggtcaggcgtgaaaagcctttcttcagctcaatgcccatttcacgcatgtgttcggggatcagcccgccgacaaagcggtgacgcggccgctcacggccttccacgtcttcgccgggcttgaagtcggcgacctgttcgcaggcgctgaacatgaactgctgctgggtcttgatctcacgcgccagctccggcacctgttcgatcagcttgcccagatcgccgggcagcgggtgctgggccagcaatttggtgaggttcttggcggtggtttccagccagtcggcggtggagcgcaggcgcgtgtagtgggcgaaatggccgatggccttgtccggcaagtggtggccttcgtcgaacacataaagcgtgtcacgcgggtccggcaacacagcgccgccgcccagggccaggtcggccaggaccatgtcgtggttggtgacgatcacgtcgaccttgcccatgccttcgcgggctttgtaaaaagcgcactggccgaagttggggcaatggcggttggtgcattggctgtggtcggtggtcaggcgcgcccaatcggaatcttccagcgcggtaggccagctgtcgcggtcgccgtcccatttattgccggcgagcttctcgatcatgctggtaaacagcttttggctgacttcatcgacttcgatcttgaagccttcttcttcgaacagcgaagcggtggcggtttgcgcatggccttcctgcaacagcacgtcgagcttggacaggcacatgtagcggccacggcccttggccagggcgaaagtaaagttcaggccgctgttgcgcatcaggtcaggcaggtctttgtagacaatctgctcttgcagggcgacggtggcggtggcgatcaccaggcgcttgccggcagccttggcggtcgggatcgcggccaggctgtaggccacggtcttgccggtgccggtgccggcctcgacagccacgaccgccgggtcgccactgcgccgaccttcgtcgtcggtgtcgatatcgccgaggactttggccacttcggcgatcatcaggcgttggccgtagcgcggtttcaagctcttggcttcgagaaaacgcgaataggcgccctggatcgtggttttgagttcagtgctgatcatggatagtcgggcgcaaaaaacgctggataaattttcagtggttcggatcggccgctatcataccccgctaattaatcccgcgcagaacggagtaccacaatgaccgcgtttagcctcgcttacaccctgcatgtattggccgccctggtttgggtcggcggtatgtttttcgcctggatgatcctgcgccccgccgccatggcggcacttgagggccctgcccggctcaagttgtgggcgaatgtgtttcaacgttttttcgtatgggtgtgggtcgccgtggcggttttgccgatcagcggcatcggcctgctgcaattgcgcttcagcggttttgaaaccgcgccgcgttatgtgcaggtgatgatgggcttgtatctggtgatgacggcgctgtttatccgtatccaggcgctgaagttcccgcaattgcgtgcggcggtggcggccgaagattggccggccggtgcggctgcgctggggcagatccgcaaactggtggggattaatttgattgtggggttggtggtggtggcgatcgcttcggctcggccgatgttctgaggcggtcgattactgtgggaagcaggcttgtagtggcgagcgggcttgccccgcgttgggctgcgcagcagccccaataaagccaccgcgtttttacaggtattacgcgctgcctgggtttggggctgcttcgcagcccaacgcggggcaagcccgctcgccacaatgttgcgttaaagccgctgaatagtcacagaacccgcaggcccagccggcccgggctgcccttccagccctgggcggcccttctcgccgccatcggcgcgatacaccacacagcccttggactgcccgcctttacccggcttaccggccgtgccggccaaaccgcccgccccgccatccacccagaccttgatctgctcagccgggaagctctgcggcagctcgacccgcacagtcgcgcccgctgcgcctggcaggccatcaccgccgttatcgccattcgcgccgcgccccgccgaaccccaggtgcagcctgggtcaacgccgttggcgccatccagcccggcatagccttgggcaccggcgccgccacgcgcgtccaccgacagttcgtcggcagtcagcgcgttgatgcgcagcaccaggtcacgcccggctttggccggcctttcgtgggtgccgggggcaccgcgcgaggtgatctggctgccatgttccagctgcgcgttgcgcacctgcaattgcagcgcggtattaccgggggcgatagcgatgcgcgcctcacgccccaagtgcaattcgtccaccgtgacttggctgatggtcgcgggcaccaacaacgtgccgtagtccgccacatccaggcgctccagctgcaacacgctggtactgctgggcaggcgcatcagcgagttggtttcaacactgacggtctgagccagggcaatggggctgaccaacagggccaacagaaaaaccttacgcatgattggcctccttgtttacttcatcaatagcagcaggcgccgacaggccccgcacatggaacatgcccaccagcaaaatctgcaagcgatcacgccaggggtgggcacggtatttcaagctgctgttgaacaacagcaactccaacagatgggtgagaaacaacagactgccggccaggctgaccaacagatggaacggattagccagcggccggaacagattgaccaccaccacaacccagaacagcaacgtcagaaacttccccagcccccaaaacaccttcatcccgcatgcccctgcctattattctttgggcgcacagtaacgacttctacaggcgatttgccagtgaaggatgaaaaaacttgataaaggggcgttttgtcggcggtttcggcgaggatcgtcagcaatgcccctgtggctcccacaggggcaagggctgtcagcggttgattttgatttccacgcggcggttcaaggcgcggccgtcagcggttttgttatcggccaccggctggctttcgcccgcgccgaccaccgacacaaagctactgcgcggtacgcccgcactcaccaggtaatcggtcaccgagtgtgcgcggcgttccgacagcttctggttgtaggcgtctttgccgacgctgtcggtatgcccgctgacccgcaattgcgcgccaggggcttcttttttcaagcgcgtggcgatggtgtcgagtttggttttgtccgctgccgtcaggttggccgagtcgaactggaagtgcacatcgcggatcacgatggtttcttccttgacgaccacaacttcctcaaccacggccgcgaccggcgccggtgggcaaccgttggcatccacttgcacgcctttaggcgtgcctgggcacttgtcgcggctgtccggcacgccatcgccgtcttcatcgccatcgccgtgcacccagcaataggcgccggccatgccgccgaccaacagcgcgccataacctgcgtacgccgaactttgagtggcgccaatcgcagcgcccgtcacaccaccgacggctgcgcaggtgggccagtcggttttttgcaaacctgcgcaacctgtcaatactccggttagcagaaccaaaggtagagctgtccgcatgatgctcatctgatttctcctgaggggatcggcgggggccgacaggtggagtaaagacggctcttttcatctgcgccactgggccgcacccccgtatttattgaggttggcagcatatgcaggacttttcgccgccacccgctctaggcccgcacgctcagccgcgctagtctctacggtcctgatgtgaggatctctgatgaccgctggtatttcttcccgtacgccccagcaagcactggctgctttgctcgatctgcaccagcccaaacgcctgttgctgttgggtgccagccagtttccggcgctggaggcctttcaagccgagcacccggacaccgtggtcgctaccgcacagcctgggccgttgcccgcagagctggcggcgcagcgttttgacctggcgctggtggtcgactgcctggagcacctgtcaaaaccgcaaggcctgaccttgctcggcggcatccgcaacctcaatgccagccgcattgcggtgctggtggacctgggcgcctgcggctggaaggacaccgactttttctccctggcccttcaggccggcgagcgtttccagcgtgatgagcaggttctgacgctgtttacctatgatctgcttgactataaacaggtgccggactggctcaacgcccgcttctgggccaacccggaaaacttcggaaagtattggtggtaaccatgagtacatccatttgcccctgcggcagtggcaacctgctggatgcttgctgcggccattatcacgccggtcacccggcgccctgcgccaccgcgttgatgcgctcgcgctacagcgcctatgtgctgggcctggtcgactacctggtcgccaccacgctgcccgcgcaacaggcggggctggaccgcgccgccatcggcgcctggagcgcccaaagcacctggctcggccttgaggtggaaagctccgaagtcttcggcggccagccggagcatgcgtttgtgacctttactgcgcgctggcacgacagcaccggcgaacacagccaccgcgagcagtcgtctttcgtacagaacaaggggcgctggtacttcatcgacccgacggtagaggtgaaggtcggacgcaatgatgtatgtttgtgcggcagcgagcaaaaattcaagaagtgctgttccagctacctctaaccaccacaggactgacgccatgctccggatttacagcttgatgctggcgttgacccttggcctgaccggctgcgcctcatggttcgaggacgatgcgcccccgccccatgtctccctggtaaaagtcgaagtggtgcgcgccaagttgctggagcagaaattcaaactgttctttcgcgtggacaaccgcgacgacgccgacctcactgtgcgcggcctgatctacaaggtaacgctggacgattttgtgctgaccgaaggcgagtccaacgagtggctgaccataccgccgcgcagccatgggtttttcaaggtgacggtgcgcaccaacctgtggccgcagattcgcgatgtggtgcagatgctgaaaaacccgagcaaacctgtgccctatcgcctggagggcgagctgaaaaccggattattcatcggtaatgacgtgcaggtggcccacaatggcgagataatgcccggcgattttattccggagcgacatcgatgactcagcaaccccatgtccatggtcctgactgcaaccacgatcacgatcaccatgatcacgaccacggtcatgtccacggcccgaactgcggccacgctcaccaggagccggtgcgcaacgccctgaaggacgttggccgcaacgatccttgcccatgcggcagcgagaagaaattcaagaagtgccacggggcttgatgccctgatgccctgatgcagtcagtgtgggagctggcttgcctgcgatagcggtctgacagctaaaaatgtgtcaccttgcccaccgcaatcgcaggcaagccagctcccacatttgttttgtatttcaattcaggattttctctgaaacagcagctccacctccaatcccccgccttcccgattcttcaaactcaaccgcccctcatgcgcccgtgcaatcgtgtgcgcaatgctcagccccagcccatacccgcccgtttcggcattgcgtgagccttcaacccggtaaaacggttccatcacctgctccagctgcccctgaggaatcccggggccacggtcgctgatgacgactttcaagctgtcggcctgatcctcgacccgcaccaccacttcgctgccatagcgcaccgcattttccagcaggttctgcacgcagcgcttgaggctgcgcgcgtaccccggcaacggttggcgggcgcggcccacgatggtcacgctttcgcccacgtcctcaaggtctgcctgcaggctttgcagcaaggcattgatgtcgatgttctgccgcgtctcgttgatttcgccgctgctgacaaagtccagggtgctggacaccatgtgctccatttcttccaggtcgctgcgaaagcgctccttggtgcgcgtgtcttcgagcatctcggtgcgcaggcgcaagcgtgtgatcggcgagcgcaagtcgtgggaaatcgctgcgagaaaccgcgtgcgctcggcgatgttggcgatcagccgctgctgcatcgcattaaacgcctgggcggcgcggcgcacctctgtcgggccgtccaccgataacggcgggcgctggatatcccggcccaacgcttcggcggccttagccagggcattcaacgggcggatggccaggcgcaccgccaccagggcgatcagcaccagcaccaacacccgcagcaaatagatgcgcatcacgtaatcgaacaacagatccagcggcgaggtgctggtccagccctgctcttcactggcatcgaccaacaaccagcgcccatcgggcaggcgcaggtcgatcaggaattgccccaccaccggtttggagctgagcaaggtcgagagcccggcggtttgcccttcgccatcgaccaaagacaggcgcagcagaatcagggtttgcgcgtagccggttttctccgacaacaccttcttgatcaggcgctcggtcggccggtcgctgtcggtgaggctgctgggcgtgctgctggcctggtcgctcaaggtcagctgaaagtgcggcgtattaagcagtttgatcaactggtcggcctgctgcgggtcgttgtgcaccaggcgcaccacgtccgccaggcgcgtggcgatcaaccgcgcggggatttccagcacctggccatggcgccggtcgtaccagatgctgctggtcaacgcctgcgccgcgagcatgccgctgaccagaatcagcaccagccgcccgaacagcgaacgcggcagcagtctcacgactccagcaccacgtcatcggcggtgagcatgtaaccctcgttgcgcacggtcttgatcagcccggccggcagttgcgagcgcaagcggctgacgcacacgtcgatggagcggtcgaacggcgtgctgtccttgtcgaacacatggttgagcaaaaaatcgcggctcaacggccggttcgggtgctgtaacagcaggcgcaatacgcggtaatccgaattgcccaggctgaccaccacgccttccggcgtgagcaattgccgcgcccgtgtgtcgagttgccagccggcaaaacgaatactcggcgcctcgtccagccgcgcacggtcagggaagctctgcacccggcgcagcaccactttgatccgcaccagcaactcacgcgggtcgaacggtttgggcaggtagtcatcagcgccgatttccaggccgacaatacggtcgatcaacgagcccttggccgtgagcatcaccaccggcgtgttggagctgacgcgcagttcacggcacaggctcaggccatcttcgccgggcagcatcaggtcaagcacgatcaggtcgatcacattcagcgccaggcggcggcgcatttccttgccgtcggcggcggtggacacctgaaaaccagcgtcactcaagtagtcacagagcagttggcggatttgcgggtcgtcatcgacgattaacaggtggtcaagctttgccatgggcattcgatccgaaaactcaaaacgcaggagatagccgaaagttcatccagcggtgtacgcaaatgtaatggaatgttgtgggaaaccataatcacgcatcagcgatacaaagccggggcatggccggcggaatcgctctttagactaccgaacctaaatgagagtaattgtaatttagactcggaagtagcccatgtcattgccaacacctcaccgccatacgctgcactcaaccctggcgccgatgttcggttttcttgctgccggcagcgttgcaccgacggcctgggccgatacgcccgccgccacagccaacgattcggtggtgagcctgccgcaaatcaaggtcgacggcgaagaagccacatcgagcttcaaggtcgatcgggtaacctcggcaaaaatcagccaaccgctgctcgacgccccgcaaagcgtgaccatcgtgccgcagcaggtgctcaaggagcagaacgcgcaaaccctgcaggaagtattgcgcaacgtgccgggcatcaccttcatgtccggcgagggcaacctgggctggggcgatctgttttcgattcgtggtttttcttccgagcaaagcctgaccgtcgacggcgtgcgtgacgccggcatgtccacgcgcaccgacaccttcaacctgcaacaggctgaagtgttcaaaggcaccggttccatcgaatccggggtttcggcggtgggcggcagcgtcaacctggtcagtaaagaagcgcacctgggcgacgccaacaaagtctctgccggaataggcaccgacagctatcgacgcctcaccgccgacatcaacaaacagctgaccgacaccaccgccgtgcgcatcaacctgatgaagcactacaaccaggtggccgaccgcgacgacgtggactacgaccgctggggcatcgccacctcgttcggctttggcctgggcaccgacacgcggttcttcgtcgacaccttctaccagaaagacaccaacaccccggacggcggcgtgccgatccagcgtggcaccgacggccaccgtatgccgggtgtgaaacgttccaactggtacggcgattccagcctgtatacgcaggaaaacgaaaccacctcgctgaccgcacgcttcgaacatgatttcgactggaacgacgccaacctgcgcaaccagacccgctgggaacgcagcgacaacttcgccgtactgtcaccggcgcgcttcttcgccgccgacgccaacggtaaaaaaacctgcagcggcgcccgctgtgcgaccttgggctacaccggcgtaggcccgatcagccaagtgcccggcagcacggtgaatgcctacaccgactatgtgaacaacagcaacaccggctacggcatcctgcgcggcagtgatttcggcctgtccaagcgctacaccatcctcgataaccagaccgacttcagcttcacattcaacactggcagcctgcaacacgcggtggtcagcggcctcgagttttatcacgagacctacggcggcctgaaacgcaacgccgaagtgccggccggcgacatgttgttcaacatgaacgaccccagccacagcttcgccagcacttacgtgaccaaaggcgaaggcgacccgcgctcggtgattgacaacgccggcctttacttaggcgacaccgtcaccctcaacgagcagtggcaagtgctcggctcgttgcgctacgacaactggcgcgcgcaaaccacacagcgcggccaggccagcatcagcagcaccgacggcgccgtcagcggccgcgtcggcgcggtgtacaagccgttgccgaacggcagcatctacgtgtcctacagcgaagcggcacaaccgtcggcgctgggcgcgtccaccaacaaccagatctacggcgcggccagtaccagcaactacagcccggccaaatcgaaaacctatgagatgggcaccaagtgggacattgcccacgacatgctcaatgtgaccgcggcgatcttccgcaccgaactggacaacgcctgggagtaccaggacggcgagtccgcaccggtgcgcgccctgcccgccaagcgcgtggacggcgtcgaactcggcctgcaaggcaatatcaccccgcgctggaccgcctacaccggtttctcggcgctcaaaagcacgcagaccaagggcatcaacaaaggcgcggaagccaagaacgttcccgacctgaccgccaacctgtggaccacctacgccgtcaccgacgccctcagcctgagctacggcgaacaatacgtgggccgtcgccgctacagcgacaataaatacgtcggcggtttgaacaacaacagcagctacgccaacgggccgtccggggttaacgcgatctacgtgcgcgaccacgaaaaagcccccggttactggctgagtaacgtggcggcgcaatacaaggtcaacaaggacaccacggtcaacctcaacctgaacaacgtgttcaacacgttctattacagccaggtcggcgcgtccctcgatggcttccagctctacggcatcccaggcgccgggcgcaccctgacggccagtgtcgattatgaattctgattttcccgcaccaggagtcctgctcatgttcaaaccccgtaacgcgctcaagcttggcgtgctgttcgccgcgctcgccttcggccacgccgaaaccgccgccgctcacgaagtcaccgacgtgctgggccgcaaggtcgaagtcaaggacgacgtcaaacgcgtcgtgctgggtgaaggccggctgatttcggcgtttgccctgctcgacaaggacgcgccgttccagcgcatcgtcggctggcagaacgatttgaagctgctggaccagcacacctacagcgcttacgtggcgaaatttcccacggtgaaagacatcccgttgatcgggcaggcgtcggagcaaagcgtcagcgccgaggaaattctgtcgctgaaacccgacctggcggtgttcagcatctccggccacggcccaaccgaacacagcgcggtggctgatgtgctggccaaggccggcatcccggtgctgttcgtcgatttccgtatcaacccggtgcaaggcacccacaccagcatgaacgcgctgggccaggcgctggggcgtgaagcccaggctaaagccttcctggatttctatgaccagcacatcaaggtcatcaccgacgccgtcgccaccctgcctgccggcccgcgcccgagcgtgttcctcgaactgctggctggtgcctggcaagcgccggggcacaccaccggtaaaagcggcatgggtgaagtgatcaagctggtcggcgggcgcaatatcgccgccgatgtggtgccgggtgcgctgggggatatcagcgtcgagtacgcgttgaaagccgacccggatgtgtacgtggccaccggcaaccacacgccgggcttgatcctgggcgctggcgtgagcactgacgaggcgcgtgaggcgtttgatcgcgtgttggcgcgccccgagtttgccaatcttcgtgcaatccacgagggcaattcccacgggctttggcatgacttctacaactcgccgtacaacctgctggcgattgaagcgctggccaagtgggtgcacccggaactgttcgccaagctcgacccgcaggcgaccatggcgcagatcaaccagcagttcctgggtatgccgttgcagggtgcttattggattgacagtaaaaccaagtaaacacggttcaaaatgtgggagcgggcttgctcgcgaaggcggcgtaccagtcgacacatgcatcgtctgacacaccgctttcgcgagcaagcccgctcccacatttggattttcgtcattttcaaaagtgtgtgagccaaatgaccactcaaaccctcgacctcgccagcgccacccacggttaccgccgtttgctggctcgccgcgcctggctgctggcgctgctgggctcggcgctggtgtgcgcgatgctggtggacctggccagcggcccgtcgggcatgggcctgctggcgttgctcgacggcatcctgcacccgtcgcacctgagcgccaccgaccaggtgatcatctggaacgtgcgcctgccctatgcattgatggcggtgctggtcggctgcgcgctgtcgctggccggggccgaaatgcaggcgattttgaataacccgctggccagcccgtttaccctcggcgtgtcgtcggcggcggcactgggggcatccctggtgatcgtatttccggtgaccacgttgtgggtgtcggccaacaccgcgatttcgatctcggcatttatcttcgcagcagcctcggtatttttgctgcaagccatgtcgcgcctgcgcggtgccggggtggaaagcctggtgttgttcggcatcgcgctggtgttcagttgcaacgcggtggtggcattgctgcaactggtcgccaccgaagacgttttgcaacaactggtgttctggaccttgggcagcgtgacccgggccaactgggacaaactcggcatcctcgccctggtggtcgcggtggttatgccgttctccttcgccgccgcgccgcgcctgaccttgctgcgcatgggcgaagatcgcgcgcaaagttttggcgtggacgtgaagcgcctgcgctttttttcgctgctgcgcatcagtttgttgtcagccaccgccgtcgcatttgtaggcaccatcgggtttatcggcctggtcggtccgcatatcgcgcgaattctggtgggcgaagaccaacgcttcctgctgcccgccagcgccttgaccggcgccttgctgctggcgctgtcttcgattgccagcaaattgatcatgcccggcgtgatcgtgccggtcggcatcgtcaccgcgctggtgggcgtgccgattttcgtggtgctggtgttcaaacgcgggagacagttatgagtacgggcttatcggtacacaacgccaacgtcagttacgggcgccggcacatcgtgcatgacctgagtttgcccaccctgccccacggcagcctgacggcactgatcggcccgaatggcgcgggcaaatccaccctgctgcgcgctgtggccgggctcgaaaagatgcaaggcgttgtaaggctgggcgacctcgacctgtcggccatgtccgtgtccgagcgtgcgcgccgcgtcacttacatgccgcaaaacctgccgccaggcctcagcctcagcgtgatggaaagcgtgatcgccgcgctgcgcgtggccaatgtggaaggcattccgctgtccggcgaagcctgcttgcgcgaagcctttgaagcgttgcagcgcatcggtatcgcgcacctggccgatcaactgttgagcaccttgtcgggcggccagcgccaattggtcagcctcgcccaactcatcgcgcgccgcccccaggtgatgttgctcgacgaacccaccagcgccctcgacctcaattaccagttgaaggtcatggactgcgtacgcgggctggtgcgcgaacacagcctgatcgccgtggtggtgctgcacgacatcaacctcgccgcgcgctttgccgaccacattgccgtgctgcgccagggccgtttgtatgccagtggcaaggcggatgaggtgctcgactcggcgttgtttgctgaagtgtatggcgtgcaggtgcgcattgagcggtgctcgcaacagtcgttgcaagtgttggtggatggggcggtgtgaaaggcgtctaaggttagacgtaaatgtttgattgaattattgcccttcgatcatcacctataggtacaggcattcgctcatttggagagcttcatgatcgacctgtactactggactacccccaacggtcacaaagtatcgctgttcctggaagaagccggcctgccctataaggtgcacccgatcaacatcggccagggcgagcagttcaagccggacttcctgaagatcgctcccaacaaccgcatcccggccatcgtcgatcacgacccgaccgacggtggtgcgccaatttcactgtttgaatccggcgccatcctgctgtacctcgcggaaaaaaccggccagttcattcccaaagacctgcgcggccgccaggaagcgctgcagtggctgttctggcaaatgggcggactggggccgatggcgggtcagaatcatcacttcagccagttcgcgccggagaaaatcccctacgcgatcaaacgctacgtggatgaaaccgcgcgcctgtacggcgtgctggaccggcgcctggcggaccgcgccttcgtggcgggcgaggactacagcattgccgacatggcgatctacccgtggattgtttcccacaagtggcagagccagcgcctggaggatttcccccacgtgcagcgctggttcaacagcatcaaggaacggccggcgacggttcgggcctacgagctggtacagaaagtgaatccgcccaaagcctgagtcccaggcaatgatcgttcccacgctccgcgtgggaatgccgcctggacgctctgcgtccgctcataaagcgtgacgcagagcgtcacaaaatgcattcccacgcagagcgtgggaacgatcctgcttgcgtcgtttcgccgcgctcactaacgtagcgcctttaatgacgctaccccccgcaggagctttgccatggcctcgccagccctctcacattttcttccccggttcggcgttgccgcggcagtggccagtgcattaagcctggccggttgccagctccagagcacccaggacaccttgcctcccgttgccggcgtgcagccgctcaaaggcctggcacagaatgtttcggtacgccgcaatgcccagggcatgccgctgatcgaaagcaatacgttccatgacgcgctgttcagcctcggctatgtgcatgccagcgaccgcatcacgcagatggtcacgttgcgcctgctggcccagggccgtctggcggaaatgtccggcccgcaagtgctcgacgtcgaccgtttcatgcgcgccgtcgacctgaaaaaaagcgccggcgagctgtataacgcttcgtcgccgcgcctcaagcgcttctttgaagtgtacgcccgcggcgtcaacgcctacctgttccgctaccgcgacaagctgccgccagacctggcccagaccggctacaagcccgagtactggaagccggaagattcggcgctgttgttctgcctgctgaatttcagcgagtcgagcaacctgcaggaagaactctcgtcgctggtgctggcgcagaaagtcggcgtcgacaaactcgcctggcttaccccaagcgcgccggatgagccgattccgcaggctgaaaccgacaagctcaaaggcgttaacctgggccagatcaccggccttgccgggctggaagccgttggccagcaactcaacagcctcaatgcactggcggtgacgacctcgagcaactgggccatcggcccgcaacgcagccgcagtggcaaaagcctgctggccagcgaccttgcggcccagccacaagcgccgtcgccgtggaattacgtgcagattcgtgcgccgaaatatcaagcggtcggcgcctcgattgccggcctgccaacgctgctgtctggtttcaacggcaaagtggcgtggagcatgagtgccgtcaaaggcgacacccaggacctgttcctggagaaggtcaagcgccaaggcaacgccttgtactacgagaacaacggcaaatggctgccggccatcgtgcgcaacgaaaccttcttcgccaaaggccagcggccgctgcgcgaagtggtgtacgaaacccgccacggcgccctgctcaacagcagccaggcgctgaccaccgggttcggcctggcgttgcaaaccgccgacttcaaggacgacaagagcctggacgcgttcttcgacctgtcccgcgcgcaaaacgccggcaaggcctcggacgccacccgggaaatccgcgccatcgcactgaacatgatcttcgccgacgccagcaacatcggctggcaagtcaccggccgcttccccaaccgccgcgaaggcgaaggcctgctgccctcgccgggctgggatgcgcggtttgactgggacggttacgccgacgcgatgctgcacccgtacgatcaagacccggcccaaggctggatcggcaccgccaaccagcgcaccgcgccgcgcggctatggcatgcagttgtccaattcctgggatgcgccggagcgcagcgagcgcctggcgcaactggccaatgccagcaagcatgacagccgcagcatgatcgccatgcaatacgaccaaaccaccaccttcgccgccaagctcaagaccatgttccaggcgccgggcatggcccagccgctgaaacaggcgatcgatgcactgccggcggctgacgcgaccaaggcccgcgaggcgctgaatcgcctgatggcctttgatggtcgcctggcgccaacctccgccgacgcagcgatctacgagttgttcctgcaggaaagcaccaagcagatcttcctcgacgaactcggcccggaaaccagcgccagctggaaagcctttatcagcaacaccaacctgtcgtattccgccaatgccgaccacttgctgggccgcgaagacagcccgttctgggacgacgtgcgcaccgcgcagaaagaagacaaaccggcgatcctcgcccgcagcctcgccgctgcgatcacggctggcgacagccaactgggcggcgatcacaaggcctggcagtggggcaaactgcacagcaccacctggaaaaacaccagcggccaagtgattcgcggcccgctggccagtggcggcgaccacaacaccctgaacccggcgccgtacagctggggccaggatttcaacaccacccaggtgccggcgttgcgcatgatcgtcgacttcggccaagtggaaccgatgaccggccagggcggcatcggccagtccggcaacccggccagcccgacctatgcgaatggcatcgacccgtcgctcaaggcgcaatacctgagcttcccgatgcaaccgcagaacttcgacaaggcgtatgggaagacgcggttgaccctcacgcccggcaagtaacccggtttctcactgaagaaaccggatcaaaaatgtgggagcgggcttgtgtgggagctggcttgcctgcgatgaggccgtgtcagtcactgatcaagtggctgatgcaccgccatcgcaggcaagccagccctacattgggaacgatcccatatccaatcgaacttcttttattccccccgcctcctaactgataagcccactgccccggcacgcccatggaccttgtcatcgcccggcccgaaggcctctactgccccgccggagatttctatatcgacccgtggcgcccggtagagcgttcggtcatcacccacgcccacggcgaccacgcccgcaccggcaaccagcattacctggccgccgcccctggcgaaggcattctgcgttcgcgcctgggtcaggacatcaacctgcaaaccctggcgtacggcgaacaacttgtgcaccacggcgtgactctgagttttcacccggccgggcatgtgctgggctcggcccaggtgcgtttggaataccagggcgaagtctgggtcgcgtccggcgactacaaagtcgagcccgatggcacctgcgcgcccttcgaaccggtgcgttgccacacctttatcaccgaatccacctttggcctgccgatttaccgctggcagccccaggcgcaaatcttcgcgggcatcaatgactggtggcaggccaatatcgccgccggcaaggccagcgtgttgttctgttattcgttcggcaaggcccagcgcatcctgcatggcattgacgccagcatcggcccgatcctcagccacggcgccgttgagccgctgaaccgcgtgtaccgcgaggccggggtctacattcccgaaaccctctacgccggcgactttaaaaagaccgacccgttgctgcgccaagccctgatcatcgcgccaccgtctgctggtggcagcacctggatacgccgcttcggtgagtacagcgacgcctttgccagcggctggatgcgcctgcgcggcacacggcggcggcgtggtgtggaccgaggctttgtgctctcggaccacgccgattggccggggctgttgtgggccatcgagcaaaccggtgccgagcgggtgatggtcacccacggttctgtcggcgtgttggtgcgccacctgcgggaaaaaggcctggatgcccagggattcaccaccgaatacggtgacgacgaagaagaggccacggcatgaaagccttcgccgagctgtacgccaacctcgacgccaccacctccagcaacgccaagctcgccgcgctgcaagcctactttcgccaggccccagcagaagatgcggcatgggcggtgtatttcctctccggtgggcggccgcggcaactggtgccgacgcgcttgctgcgcgacatggccaccgaagcgtcgggcatcgaaccctggctgttcgaagagagttaccagtcggtgggtgacctggccgaaaccatttccctgctgttgccggaatcttcctacacctcagaagacggcctggcggtgtggctggaggacaaactcctgcccttgcgcggtctgccgccgctggaactggccgaacgcctgcccgcgttatgggcgcaactggatcagccgagcttgatggtgtgcatcaaattgatcaccggcagctttcgcgtgggcgtgtccaaattactggtgacccgcgccctcgccgccatggctgagctggacagcaaacgtgtggcgcagcgcttggtgggttacaccgacttgtcgaaccgtcctacggctgagggctacctcaagctgatcgccgccgaatcgtccgacgaacatgcgcaacgcggcgggcagccttacccgttttttctcgcccacgggttggcgcaaccggtggagcaattcgacaccctgctcggttcgcccgccgactggcaggtggaatggaagtgggacggcatccgcgcgcaactggtcaagcgtgaaggccggctgtggatctggtcgcgtggcgaagagctggtgaccgagcgctttcctgaactgcacagcctggtcagcggcttaccggatggcacggtgatcgacggcgaaatcgtggtgtggaaggactcggtgcaacctttcgccctgttgcagcagcggatcggccgcaagaccctgagcaaaaaagtcctcgaggacgcgccggtcgctgtcctcgcctacgacctgctggaataccagggcgacgactggcgcaaccacacccaggccgagcgccgcgcccagcttgagcaggttattgcgcagtgcaaccaggcggtactgttgccatcgcccttgctgacgggcttaagttgggccgacctggccgagcaacgcgaagactctcgccgccttggcgtggagggcatgatgctcaaggccagggacggcctgtacggcgtgggccgcaccaaggacatgggcgtgtggtggaagtggaaagtcgacccgttcagtgtcgatgcggtgttgatctacgcccaacgtggccatggccgccgcgccagcctgtatagcgactacacctttgcggtgtgggacggcccgccgggcacggagcgcacgttagtgccgtttgccaaggcttattcggggctgacggacgaagaaatgcgcaaggttgacgccatcgtgcgcaaaaccacggtggagaagttcgggccggtcagcagtgttacgccgagcatggtatttgagttggggtttgaggggattgccctgtcgaagcggcataagagcgggattgcggtgcggtttccgaggatgttgcggtggcggcaggataaggcggtggatgaggccgataacctcggaacgctgcaagacttactgacctgaccctttttcacaaacaccacaaatcactgtgggagccgggcttgcccgcgatggcggtgggtcagttagataggttgggcctgaagcaccgccatcgcaggcaagccagctcccacattttgattcaggtcaaaccccaaaatggtgcactgaaaaatcaatgcccattttcgggcatctcctacactgacatctccctagtcccaccttttaaaacaatcattcggaactacattcggaactatggtgcagaaattgctacttgtgatccgtctgacaccgttcagtaacagtcctaaacgcgccacaagcgcttatcttggtttccagggattacataatgaaaaaagcattgctgaccctttctgcactggctctgtgcatggctgctggtgttgctacagccaaggaatacaaggaattgcgttttggtgtcgatccttcctacgcgccgttcgaatccaaggccgccgacggcagcctggtgggcttcgatatcgacctgggcaatgcgatctgcgccgagctgaaggtcaagtgcaagtgggtcgaaagtgacttcgacggcatgattccaggcctcaacgccaacaagttcgacggcgtgatttcctcgatgaccgtgaccgaagcccgtgaaaaggcgatcgacttctccaacgagctgttctccggcccgacttccctggtgttcaaaaaaggcgcgaacttctccacgcctgagtccctcaagggcaagagcgtcggctacgagcaaggcactatccaggaagcctacgccaaggccgtgctggacaaggccggtgtgaccaccaaggcctacgccaaccaggaccaggtgtacgctgacctgacttccggccgtctcgacgcgtcggtgcaggacatgctgcaggccgaactgggctttttgaagtcgccggcaggcgctgactacgaagtcagcaaggccatcgacgacccattgctgccgtcgaaaactgcggtcggtatcaaaaaaggtaacaaagacctcaaggccttgctcgataaaggtatcaaagcgttacacgatgatggcacctacgccaccattcagaagaaacacttcggcgatctgaacctgtacagcggtaaataacaccctggcgcccacctgtttcaggtgggcgcttttttatcgccataggtcctgaattcatgtttgaagatcttttgcaaaccctggggctgagtgccttcagtttgaaggggttcggcccgctgttgctgcaaggtacgtggatgaccgtgaaactgtcggtcgcctccctggccgtcagcgtcctgctgggcctgctcggcgccagcgcgaaactgtccagcgtcagcctgatccgcatccccgcccagctctacaccaccttgattcgcggcgtgcccgacctggtgctgatgttgctgattttctacagcctgcaaatctggctgaccggttttaccgactttatggaatgggactacatcgagatcgacccattcagcgccggggttatcaccctgggctttatctacggtgcctatttcaccgagacctttcgtggcgcgatcctcgcggtgccgcgcggccagctggaagcggcgaccgcctacgggctcacgcgcgggcagcgctttcgcttcgtgaccttcccgcagatgatgcgctttgccctgccaggcatcggcaacaactggatggtgatgctcaaggccacggcgctggtgtcgatcatcggcctggcggacctggtcaaggctgcgcaagacgccggcaagagcacctaccagctgttttacttcctggttatcgccgcatttatctatttgctgatcaccagcgcgtccaacgtcgttctgcgctggcttgagcgccgctactccgctgggtcccgggaggccgtgcgatgatcgaacttctgcagcaatactggcggcccttcctttatagcgacggccagcacatcaccgggctggcgatgactatgtggctgctcagcgcagcgctggtgattggcttcgtggtctcgatcccgttgtccatcgcccgggtgtcgcgcaagcgctacattcgctggccggtgcagttctacacctacctgtttcgtggcacgccgctgtatatccagttgctgatttgctacaccgggatctacagcattgcggccgtgcgggcgcagccggtactggatgcgttctttcgcgacgcgatgaactgcaccatcctcgcgttcgccctgaacacctgcgcctacaccaccgagatcttcgccggggcgattcgcagcatggcccacggcgaagtcgaagcggccaaggcctacggcttaagcggctggaaactctatgcctacgtcatcatgccgtccgccctgcgccgctcgttgccgtactacagcaacgaagtgatcctgatgctgcactcgaccacggtcgcgtttaccgcgacggtgccggatattctcaaggtcgcccgggacgccaactcggccacctacatgacctttcaatccttcggcatcgccgcgttgatctacctgaccgtaacctttgccctggtcggtctgtttcgcttggccgagcgtcgctggctggccttcctcgggccgagtcactaaggagtcgtgatgcgtcatcaggtacatgatctgatcgcgccggtgccaggcacggcgcggcagatccacagtttccacttcggcccggaacaggccgaaggcaaaatctacatccagtcatcgctgcatgccgatgaactgccgggcatgctggtggcctggcacctcaaggtgcgcctggctgaactggcggctgccggcaggctgcgcagcgaaatcgtattggtgccgatcgccaacccggtgggcctggaacaggtgttgatggacattccgctgggccgctacgagctggaaagcgggcagaacttcaatcgcctgtttgtcgacctcagcgaagacgtcggcaatcaggttgaaggttttttgggcgatgaccccaagcacaacgtcgagctgattcgcgacgccttgaccctggccctcgccgcccaaaccgccgacacccagctgcaatcccagcgcctggtattgcaacgcctggcctgcgatgccgacatggtgctcgacctgcattgcgacttcgaagccgtggcgcacctgtacaccacgcccgaggcctggccgcaggtggaaccgttggcgcgctatatcggctcggaagccaacttgctcgccaccgattcgggtgggcaatccttcgatgagtgcttcacgctggtgtggtggcagttgcagcaacgcttcggcgagcgcttcccgattcccatgggcagcttctcggtgaccgtcgagttgcgcggccaaggcgacgtcaatcatggcctggccagcctcgactgccaggcgatcatcgactacctgacacacttcggcgcgattgccggcgacgcggcgccactgcccgagctgccctacccggccaccccactggcgggcgtggaaccggtgaccacgccggtcggcggcctgctggtgttcagcgtgctgccgggtgaatacctggaagccgggcaactgatcgccgaaatcatcgaccccattactgaccgcgtaacgcctgtgcactgccaaaaggccggcctgctttacgcccgttcgctgcggcgcatggccactgccgggatggtgatcagccatgtcgccggcaccgaggcctatcgcagcggctacctactttcgccttgaggatgcacgccccatgtacaaattgacggttgaaggcctgcataaaagctatggcgacaataaagtgctcaaaggtgtttcgctcaaggccaagaccggtgacgtgatcagcctgatcggcgccagcggttccggcaaaagtacttttttgcgctgcatcaactttctggaaacccccaacgacggcgcgatgaccctcgacggccagccgatccgcatggtcagcgaccgccacggcatgcgcgtggccgacgacgccgaactgcaacgcctgcgcacgcggctggcgatggtgtttcagcacttcaacctgtggagccacatgagcgtgctggaaaacatcaccatggccccacgccgggtgctgggttgcagcaagaaggacgccgaagaccgcgcccgtcgctacctggataaagtgggcttgccggcgcgcgtggccgatcaatacccggcgtttctctccggcggccagcagcaacgcgtggccatcgcccgcgccctggcgatggagccggaggtaatgctgttcgacgagccgacctcggccctcgacccggagttggtcggtgaagtgttgaaggtgatccaggggctggccgaggaaggccgcaccatgattatggtcacccacgagatgagctttgcgcgcaaggtgtcgagccaggtgctgttcctgcacaggggcctggtggaagagcaaggcacgcctgaggacgtgctgggcaatccgaagagcgagcgcctgcagcagttcttgagcggtaatttgaagtaaacctttgcgacgcctggagggtctttgaaagagagcctccagagcgtcagccgccgtatggcaaaaccccacgatttcgcaaaacactggtttgccgccaagggctggaagccgttcgcctttcagaaagcggtgtgggcggcagtcaagcaaggccactcgggtttactgcatgccagcacgggcgcgggtaaaacctatgcgctgtggtttgccgccctcaatcgtttcgccatcactcgcccgcctgccacgggtaaacgcaaaccacctgctgaaccgctgacagtgctgtggatcacgcccatgcgcgcacttgcggccgacactgcacgcgccctagaagcgccgcttgcggcgttgcaggttccctggagcgtcggcctgcgcaccggcgacaccagcagcagcgaacgcgcgcgccagacccgccgccagccgaccgcgctggtcactacgccggaaagcctgacattgatgctggcgcgggctgacagcgagacgagcctggcgcacgtgcgcatggtgatcgtggatgagtggcatgagctgattggcaataagcgtggcgtgcagctgcaactggcactggcgcgcttgcggcgctggcacccggaactgatggtgtgggggatttcggcgacgctgggtaatcaggctcacgcgctggaagtgttggtcccacaaggcggcgggatcaatgtgcaggggcaaacggcgaaagcgttgcaggtcgataccttgttgccgcctaccaccgagcgttttccctgggccgggcatattggtttgaagatgttgccgcaggtcgtcgccgaagtggactccagcagcagttgcctggtgtttaccaatacgcgcgcgcagtcggaaatctggtatcaggcgttgctggacgcgcgcccggattgggccggcgtgatcgccttgcaccacggctcgctgtcccgcgaaacccgcgactgggtggagcgcgccttgaaagacggccagctcaaggcggtggtgtgcacctccagcctggatttgggcgtggacttcctgccggtggagcgcgtgctgcaaatcggctcggccaaaggcgtggcacgcctgatgcagcgcgccgggcgctccggccatgcgccggggcggccgtcgcgggtgacgctggtgccgacccatagcctggagctggtggaagccgccgccgcccaggatgcgattgcgcagcggcgcattgaagctcgcgaatcgccttacaagccgctggatgtgctcgtacaacatctggtgagcatggcccttggcggcgggtttacgcccgacgcgctactcacggaagtacgcggtgcgtgggcttatcgcgacctcacggaagctgattgggcctgggcgctggggtttgtgcgccatggcgggctgtcgctgaccgcctaccccgattaccgccgtgtggagcccgatgagcaaggcatctggcgcgtgccggatgcgcgcctggcgcggcgccatcgcatgagcgtcggcaccatcgtcagcgatgcgagtatccagctgaaattctggagcaagggcggcggcggcaagaacctgggcagtgtcgaagaaggttttattgcgcggctcaagcccggcgacggtttcctgtttgccgggcgtttgctggaattggtgcgggtggaaaacatgaccgcttatgtgcgccgcagcacggctaaaaaagccgctgtgccgcgctggaatggcgggcgcatgccactttccaatgagctggcacaggctgtggtcgagcgttttgatgcggcagcacacggccacttcgacggcccggaaatgcgcgcagtgcagcctttgctgcaaactcagttgcgctggtcaggcctgccgacgcgcacgcatttgctggccgaagcgctgaagtcgcgggagggatggcacctgtttctttacccgttcgccgggcgccaggtgcatctggggctggcaagtttgctggcgtggcgcgtcagccaattgcaacctgtgaccttttcgattgcagtgaatgattacgggctggagctgttgagtgccacgccggtggagtggcctctgttgctgaacgaagcgctgttgagtccggccaacttgctgttggacgtggcgcagagcctgaatgcaggtgaactggccttgcgccgctttcgcgaaatcgcacgcatcgccgggctggtgtttgccggttatcccggcgcccccaaaagcacacgccaggtgcaggcttccagcggtttgttttttgaagtgttcaagcaatacgacccagagaaccttttgctgacacaggccggggaagaagtcctgcgtgacgagttggatattcgtcggttggaagcgacattgctccacctgtcggcgctgaaactggacttgcatgtgattgagcgaccgacgccgctggccttcccgctgctggttgagcggatgcgcgagagcatgagttcggagaagctctcggagcgcattgcgcggatggtcaaggacctggaaaaagtcgcggataacgggaaacgttgatggtgtgctcggtgacacttgagggagaagaactatggctgctggcggaaaaggctgtgtactggcccgcgcgccggtgcctgctgattgccgatgcgcattttggcaaggcttcggcctatcgcagcctggggcaaccggtgccacagggcaccaccactgaaaacctgcagcgtgtggaccgcatgttatcggctctgccgtgcgcgcaggtgatctttctcggcgacttcctgcatggccccggctctcacgccagcggcacgctgaacgccttaagggcttggcgtgagcgcaatcgcgagttggccctgacgttgattcgtggcaaccacgataagcgcgcgggcgacccacctgccgacctggggattgaggttgtcgccgagccgttgctgatgggcccgtttgcgctgcaacacgagccggacgcacacgccagtcaccatgtgctggcagggcatgtgcatccggtgtatcgcttgcgcggcaagggccggcagagtttgcgcctgccctgctttcagctcgggctgcgggtcagcctgctacccgcatttggcgcctttaccggtggctatgcggtggagcagaaggatgatcagcggatctacgtgatcggcgatgaggacgtctggccagtccagtaaagggccggccacacgtgctgacacacaaccgtcaagcgacaggtgcgggtggcggctcatcgggaattgtgggcacaccaggctcggtgggctgggggaaatcttcgtcaggttggccagggatgccgcctgcatacgcagggtcggccatcagggaccaggccaaaacaccaatctggttgggttcaagccgggcgagttcggcgctgattcgcgggtcgatcttcataaagtactcctcaagcgtggctcggcgcgttttgcacgcaccgaggcagtacacccaatagagtcacttcccgcagactaattcccttaacgtgtaagacctttcgatcaagcgcgtgggagtgtgacgccgcgctggccctgatacttgcccgcgcggtccttgtaggacacttcacaagcctcgtcggactgcaggaacagcatctgtgccacgccttcattggcgtagatcttcgccggcaatgtagtggtgttggagaactccagggtcacgtggccttcccattccggctcaagcggcgtcacgttgacgataatgccgcaacgcgcgtaggtgcttttacccaggcaaatggtcagtacgtcgcggggaatgcggaaaaattccacggtgcgcgccagggcgaaagagtttggcgggatgatgcacacgtcgctcttgacgtcgacgaagctcttttcgtcgaagtttttcgggtcgacaatcgccgaattgatattggtgaacaccttgaactcatcggcgcaacgcacgtcgtagccgtagctggacacaccgtacgaaatcacacgctcatcgccttcaccacgaatctggcgttcaacgaacggttcgatcatgccgtgttcttgcgccatgcggcgaatccacttgtccgatttgatgctcatggcgggtgtcctgaatagcgaggtggaaaaattctgttgggcatcttaccggggccggccgtggggttcaaagggcgcggggcttttcttgacgaatgcattggctgctataagccgcagccagcggggccgggactcctagtgcagccggcagtgactgtaaataccaccgccagtcacgaaattagagaaaccttcggaaataccattggcacgttccgcaaaaagggttaaggtggcgccactgtgctgcttgtgtcactgagaatctctacacgatatgttgaatttcgatccaaccatctccaagaatttttcctgctctttgcactcagtctcggccagggcttttcctgagtcgcagttaactttgtccaaggagatacaccatgtctaatcgccaaactggtaccgttaagtggttcaacgatgaaaaaggcttcggcttcatcactccacaatccggtgacgacctgttcgttcacttcaaagctatccaatccgacggcttcaaaagcctgaaagaaggccaacaggtttctttcatcgctacccgcggtcagaaaggcatgcaagctgaagaagttcaagttatctaacttgtactgacttagtcgaaaaaaccccgcccttaaaagcggggtttttttatgcctgatcgttcccatgctctgcgtgggaatgccttttgtgacgctctgcgtcacgccgggggacgctgagcatccctggctgcattcccacgcggagcgtgggaacgatcagacaaaaaatgtggaagccatttttatgtgggagctggcttgcctgcgatcctgacgcctcggtgtatcagttacaccagggtgatgctatcgcaggcaagccagctcccacacaaaccagctcccacatgatcgttcccatgctctgcgtgggaatgccttttgtgacgctctgcgtcacgctgggggacgctgagcgtccctggctgcactcccacgcggagcgtgggaacgatcagacaaaaaatgtggaagccgtttttatgtgggagctggcttgcctgcgatcctgacgcctcggtgtatcagttacaccagggtgatgctatcgcaggcaagccagctcccacacaaaccagctcccacatgatcgttcccatgctctgcgtgggaatgccttttgtgacgctctgcgtcacgctgggggacgctgagcgtccatggctgcattcacgcgggccgcgggaacgatcagcgcacagcaaaacgcccggtgcactcccatgcaccgggcgttttcatagctgcgtataagccgttactggaacaacgactcgctcgacaagccattcttctcaaggatctcacgcaagcgcttgaggccctctacctggatctgccgcacccgctcacgggtcaggccgatctccaggcctacatcctccagcgtgctgctctcatggccgcgcaggccgaagcggcgaatcaccacttcacgctgcttgtccgtaagctcagacagccactggtcaatgctttgggaaagatcatcgtcctgcaacagctcacaaggatccgtcggacgatcatccgtcagggtgtccagcagggttttatccgaatccggacccagcgagacatcgaccgaagacacgcgctcgttcaagccgagcatgcgttttacctcccctaccggtttctccagcaggttggcgatttcttcaggcgagggttcatgatcgagtttttgggtcagctcacgcgccgcccgcaggtagacgttgagctccttgaccacatggatcggcaaccggatcgtgcgggtctgattcatgatcgcccgttcgatggtctggcgaatccaccaggtggcataggttgagaagcgaaagccgcgctcagggtcgaacttctccactgcccggatcaagcccaggttgccctcctcgatcaggtccaacagcgacaggccacgattgacgtagcggcgggcgattttcaccaccagtcgcaggttgctttcaatcatgcgcttgcgcccagccggatcgcccttttgcgacaaacgcgcaaaatggacttcttcttcgggagtgagcagaggggaaaagccgatttcattgaggtacagctgcgtggcgtcgagcgcccgcgtgtagtcaatgtacttgtgttgctttaacgcggtggagttcttggatttggtgcgaactgaaggtgcaacagacccctcatcattcgacatcgattccttttcggtgagaatctccatttcaaggagaacctcatcgtcgatgtcaaactccggcgcttctttactgagagccattgttatagtcctttggtgagttcgacctcaagctcaagcgacgcctttatccttggcaacgctggagcctgttccttctacgtgagggaacaggctgtgcaacacatcaacgacggggtaggaattgcagcggatctacaggcttcccctgacggcgaatctcaaagtgcagtttcacccggtctgtacccgttgaccccatttcggcaattgtctgtccgactttgacctgctgcccctcccgaaccaacaacctgcggttatgaccgtaggcactgacgtaggtatcgctgtgtttgatgatgaccagctcgccgtagccccgtaaaccactcccggcgtacaccactgtcccatcagacgcagctaaaacaggctgtcccaaatccccggcgatatcaatgcctttattcaaactaccgtttgaagagaattttccaattaacactccgtttgaaggccatccccaaccggtcggcgcaggccctgcaggcggcagcggcgcgggtgccggcttgcttgcaaccgtaggcgtggcgctacctgcaggccgagtgatgatcgtggttctgctcgaggaggaaggcgaagatccggaatttgtcacaactgccgtaggcgtagaaccggtgcgcccatcgaaacgaatggtttgccccggatgtatcgtgtacggcacaggaatattgttacgagctgcgagcgccttgtaatcccagccgtagcggaaggcgatcgagaacatcgtgtccccctttcgcactacatattgcccggtggtgaccgtcggtttttgcggcacggcgctggctttatttcggtcgacaacccgcgcgccactggagggggagctggagcaacccgccaataaggaactcaagacaaggccaagcaccagtcgctgaaagcttgttttactcatacgctgcgcaagacctgtgagactcacccgccgctccctttgtggtggctgaatatgaacgcctgtatcaggcctgaaatatgacgcaagtataactgggcattggacttttaccggcacacgactgaaacgaaaaattcatcatgtttaaggccggcttctattcatgttgactcaataagccccgctgtaagacacatccccaccaacagaattcactgtttgcgaacaaatgatcaggccagcgggccattaagcaagggtacgaagcgtacggcgcccagcacatgccgcgaaaagccttcgtcctcacggataatgagcatcaattgttgcacttcgccggagcccaccgggataaccagccgcccgccaggcgccagttgatcgagcaacgcttgtggcacgtcggtcgcaacggccgtgacgatgatcccgttatacggcgccagcgctggccagccttcccaaccatcgccccaacggaacaccacgttgcgcaggttcaattccaccaggcgctctttggcacggtcttgcagaaccttgatgcgctccaccgagaacacccgctccaccagttgcgacagcacggcggtctgataacccgacccggtgccgatttccagcaccttgtccaaaggccccgccgccagcagcagctcactcatgcgcgcgaccatataaggctgcgagatggtctggttatggccgatgggcaatgcggtgtcttcataggcgcggtgcgccagtgcttcatcgacgaacaggtggcgtggtgtgcgccggatgacttccaatacctgggcattggataggccttcttcgtacagacgctgaatcaaacgctcgcgggtacgctgggaggtcatcccgatgccacggcgcagcaggtcgtcttgttcacgcgccatcaacgcagcccctcaagccagccatcgagactactgaaggcatcactgaaggtgcgatcaagctgcaacggggtaatcgaaacataaccttgcatcaccgcatgaaagtcagtgcctgggccgccatcttcggcgtcgcccgccgccgcgatccagtaaccttccttgccacgcgggtcgaccaccttcaagggcgccgccgcacgggcacgatgacccaggcgcgtcagctggatgccgcgaatatggtcgaggggcaagttgggaatgttcacgttgagcacggtacgcggcggcaagtccagggaaccatgggcctctaccagcttgcgcgcgaaatacgccgccgtcgccaggttatccagttgccgcgaggcaaacgaaaaagcgaacgaggtacgccccaggaaacggccttcaagggccgccgccaccgtgccggaatacaacacgtcatcgcccaggttggcgccgaggttgatgcccgacaccaccagatccggctcctggtccaacaagctgttgatcgccaggtgcacgcaatcggtgggcgtgccgttcacgctgataaagccattggccagaatctgcgggtgcaaaggacggtcgagcgtcagcgaactgctggcgccgctcttgtcctggtccggggcaaccaccacgcactcggcataatcttccagcgcagcataaagcgcggcaaggccaggtgcagtggcaccgtcatcgtttgatatcagaatacgcatgggctgtccgtctgccccaccggcaccagatcaacaagctcgcgcaccaaaacagtggcgaagcatccggccggcaggacgaattccaattgcagaatgtccagcgagggataatgccacgtcaacccgccaatgggcagtcgcagaatgcgccgttcctggctcatgccggcattcaccagccaatcgcgcaggtcggcttcgctggcggcgatggcttgttccagcgcatgggttgcaccggtagcgggcgaatcgccttcgccccactgcggcccggttgggtgcaggtccagtatggccaggcgcgggtcgctgcattcagcctccccggcggggaagaaactgcggctgtcggtgaacgccaacaggtcgccgacctgggcgcgctgccaggaaccgtctgccacgcgcgccgccaggactttgttgaacagaaagctacgcgcggtggacagcagtcgcgaacgcacattgcgctgctccggcaaggccttgcgcgcggcccattcacgcgcgtccaccacgttgccaccgttatggccgaaacgctgcgcgccgaagtaattggggatgccatgctggtcaatcagttgcaaacgcgcgtcgatggcagcggtgtcgccggccaattgggtcaggcgcaaggtaaaaccattggctgagtgcgcgccgcgctgcagcttacgcttgtgacgggccattttgaggatcttgagggtgtcgttttccgcaccgctcatgtccgggtcggccttgcccggcagctgtatgctgaaccactggcgggtcaacgcctggcggtccttgagcccggcataactgacggtgcgcagcggcacgccggcggccttggcgatacgccgcgcagcttcttcggtattcaggccacgtttctctacccacaaccacaggtgctcgccgtcgccggtcagcgggatatccagcacttcgtcgacctggaaatcttcagccgtcgctttcaggaccgcgctgcccaaggcctcgccataggcccgtgggcccaacagttgcaggtcattcatgcgcgcagcaacaaggcaacggagtgcaccgcgatgccctcttcccggccggtaaaaccgagcttttcggtggtggtggctttcacgttgacttgatccagttcaatttgcagatccgcggcaatcagtgcacgcatcgattcgatgtgcggggccattttcggcgcctgggcgacgatggtgttgtcgacgttgccgaccttccagcctttggcgtggatcaggccaaccacatggcgcagcaacacacggctgtccgcgcccttgaacgtagggtcggtgtccggaaagtgtttgccgatatcgcccaacgccgccgcgccgagcaacgcatcgctcaaggcatgcaacacaacgtcgccgtcggaatgagccagcaacccatggtggtgtgcaatgcgcacgccgcccaaggtgatgaaatcgccttcggcgaaacggtgcacatcgtagccgtggccaatacgcataaaaaaacgccccgatttaattcagggcgtgattctacctacttttgcctcacattaaccgagcaaagcacgaccatgatgtcgcaaatgatcttcgatgaagctggcgataaagaagtagctgtggtcgtagccaggttgcaggcgcagttccagcggatggttggcggccttggctgcttgctgcagggcttcgggcttgagctgcacggcgagaaaatcatcgcggtcgccttgatccaccagcagtggcagcttttgcgaggcttcactgatcagcacgcaggcatcccattcgcgccacttcgagcgctcttcgcccaggtagcgggaaaaggctttctggccccacgggcaatccatcgggttgttgatcggcgaaaaggctgacaccgactggtaacgccccgggttgcgcaaggcacacaccaacgcaccgtggccgcccatggagtgaccgctgatgccgcgtttatccgatgccgggaaatgcgcttcaaccaacgcaggcaattcctgcaccacgtagtcgtgcatccgatagtgcttggcccagggttcctgcgtggcgttcaagtagaagccggcacccaggccgaaatcccaagcgttgtccgggtcgcccggcacacccgggccacgcgggctggtgtccggcgcgacgataatcaaccccagctcggcggccacgcgctgcgcgccggccttctgcatgaagttttcatcggtgcaggtcaggccggacagccagtacaccaccggcagcttgccgccctgctccgcttgcggcggcaagtagacggcaaaggtcatgtcgcaatcgagcacatcggaatgatgcttgtagcgtttatgccagccgccgaagctcttctggcaggacaggttttccagactcatggctgacctcagaagtggatgacggtacgaatgctcttgccttcgtgcatcaggtcaaacgctttgttgatgtcttccaggcccatggtgtgggtgatgaacgtgtccagcgggatctcgccggtctgggccatttccacgtagcttggcaattcggtgcggccacgcacgccaccgaacgccgaaccgcgccagacgcgcccggtgaccagctggaatgggcgagtcgcgatttcctggccggcaccggcaacaccgatgatcaccgactcgccccaacccttgtggcagcactcgagcgcggcgcgcatcaattgcacattgccgatgcactcgaacgagaagtccacgccgccgtcggtcaagtcgacgatcacgtcctggattgggcggtcgtagtctttcgggttgatgcagtcagtagcgcccagttgtttggcgatttcgaacttggccgggttgatgtcgatggcaatgatgcgcccggccttggccttgaccgcaccgatgacggccgacaggccaatgccgccgaggccaaagatggccacggtgtcgcccggcttgaccttggcagtgttgatcaccgcaccaatgcccgtggtgacaccacaacccagcaggcagactttttccagcggcgcttctttaggaatcttggccaccgaaatttccggcagcacggtgtattcggagaaggtcgaggtgcccatgtagtggaaaatcggctggcctttgtaggagaaacgcgtggtgccgtcgggcatcaagcctttgccctgggtggaacggatggcctggcacaggttggtcttgcccgacaggcagaatttgcacttgccgcattccggggtgtacagcgggatcacgtggtcgccgacggccaccgacgtaacgccctcgccaatcgcctcaacgacggcaccgccttcatggccaaggatcgacgggaagatgccttccgggtcggcgcccgacaaggtgtaggcgtcggtatggcacacgccggacgcgaccacgcgcaacagcacttcgccggccttgggcatggcgacatccacttcaacgatctcaaggggctttttcgcttcgaaggctacggcggcgcgggacttgatcatccgggtttctccatggaattaaaaactgaggcggtgagtgtaaaacatggcccagtgattaataatccagcccaaagcaaaactttattgctgtacagggataatcaagatgctggagaaccgctgggaaggcattgatgagtttgtcgcggtggccgaatgcagccaattcacggcggctgccgaacgcctgggcgtgtcgtcgtcgcacatcagccgccaggtcgcacgcctggaggagcggctgcaaacgcgattgctgtatcgcagcacccgcaaagtgaccttgaccgaggccggccagaccttcctgcagcactgccagcgtttacaggatggtcgcgaagaagccttgcgcgccgtgggcgacctcaccagtgaacccaagggcatgttgcgcatgacctgcgcggtggcgtacggcgagcgatttattgtgccgctggtcacgcggttcatggggctctacccgcaactgcgcgtcgatatcgagctgaccaatcgccagctggacctggtgcatgaaggcctcgacctggcgatccgcctcggtcgcctgcaagactcgcgcatggttgccagtcgtttggcgccacggcgcatgtatttgtgtgcgtcaccttcctatctggcgaggtatggtcggccacatagtttgtcggagttgagtcggcataactgcctgatcggcagctcggatatctggcaactcgcccaggacgggcgcgaattctcacaacgcgtgcagggcaactggcgctgcaacagtgggcaagcggtgctggacgccgcattgcaaggcgtcgggttgtgccagttgccggactattacgtgctggagcatctgcacagtggcgccctggtgccgttgctcgaagcccatcaaccgccgaatacagcggtgtgggcgttgtatccgcagcaacggcatttgtcgccgaaggtcaggaagctggtggattttttgaaggaggggttggctgagcggccggagtacagcgcgtaatttggggcgactgttcgggccttatcgcgggcaagcccgactcccacagggaattgcatttcaactgtgggagctggcttgcctgcgatgaagtcgacgcggtgtcactgactatctgcggtttgcccaccgcaacctgagccactccaggtcttcggggcgagtaaccttgatattgtccgcgcgcccttcgatcaggcgtggcgcctgaccggaccattccatcgccgaggcttcgtcggtgatcactgcgtctgcgaccaggctgtcggccaaggcacggtgcaaggcgccgaggcggaacatctgcggtgtgtaggcttgccaaatcaggctgcggtcgacggtttcgaccacacggccgtgcttgtcgacgcgcttgagggtgtcgcgcgcgggcaccgcgagcaagccgccgaccggatcatccgcgagttccgccaacagcttgtcgaggtcgtcacggctcaggttagggcgcgcggcatcgtgcaccagcacccaatcgttatcatcggcgcccagggcattgaggtgcagcagcgcattgagtaccgagcccgagcgctccgaaccaccgtccgcacgttgaatacgcgggtcagcggcacatgccagcgtcggccagtaaggatcgtcaaccgccagactgaccaccaagcctttgagcgttggatgatcgagaaaacagccaaggctgtgttcgagaatagtgcgcccgcccagttgcagatattgcttgggacggtccgcggccatacgggcaccaacgcccgcggcaggaatcacggcccagaaggccggtaaactgttactcattgggccaactggtagagggtttcaccctccttgaccatgcccaactcatgacgcgcccgctcttcaacggtctcggtgccttttttcagctcaagcacctcggcatcgaggacgcggttgcgctccagcaggatttcgttttcggcgtgctgatcggcaatttgctgggtcagttctttcacctgcgcaaagctgccattaccgacccataggcggtactgcaggccagccagcaataagagcaagacgaggaacaaccaattgggactgcgcatcgaaatccgggtatccagtaaaaaaagacagccatgcaaaacttttgaagcaactgatagcacgaagcctggatgaaccaggcttgtgcttgatagccatcagattagcggcgaaattcacgctgtcgtgatttttccgacgtaatccgctgactttttaccacgctttaccatcaaggagcgatcagccgcgaaactcgctgcgaccgttgtacttggctttacccgccagctgctcttcgatacgcagcaattggttgtacttggaaacgcggtcggaacggcacagggaaccggtcttgatctggcccgccgacgtgcccacggccaggtcggcaatggtcgagtcttcggtttcgccggagcggtgcgagatcacggcggtgtagcccgcagccttggccatctggatggcttccagggtttcggtcagggtgccgatctggttgaacttgatcaggatagagttggcgatctttttgtcgatgccttctttcaggatcttggtgttggtcacgaacaggtcgtcgcccaccagttggattttctcgccgatcttgtcggtgaggactttccagcccgcccagtcagactcgtccaggccgtcttcgatcgagatgatcgggtagcgctcggtcaggcctttgaggtagtcggcaaaaccttcggaggtgaacacgtggccttcaccggacaggttgtacttgccgtcttcgtagaactcgcttgcggcgcagtccagggccagggtcacgtcggtgcccagcttgtagccagcgttggccacggcttcggagatcactttgagtgcatcttcgttggacgccaggttgggtgcgaaaccaccttcgtcacccacggcagtgctcaggccacgggctttcagcacagccttgaggtgatggaaaatctcggtgcccatgcgcaggccttcggagaaggtcttggcgccaaccggctgaaccatgaattcctggatgtcgacgttgttatcagcgtgctcgccaccgttgatgatgttcatcatcggcaccggcatcgagtaaacacccggcgtgccgttcaggttggcgatgtgtgcgtacagcggcaggtcctggtcctgggcggcagccttggcagcagccagggacacggcgaggatggcgttggcgcccaggctgcctttgttttcggtgccgtcaagcttgatcatcgcgtggtccagggctttctggtccagcgggtccttgcccagcaacaggtcacggatcgggccattgatgttggcgaccgctttcagtacacctttgcccaggtaacggctcttgtcgccatcacgcagttccagcgcttcgcgcgaaccggtagaagcaccggacggcgcgcaggcgctgccgatgatgccgttatcgagaagcacgtcggcttcgacggtggggttgccacgggagtcgagaacttcacgacctttgatgtcgacgatttttgccattgttgtaaacactccaaagttgacgaaaacgacgcagctgaaggaaatcttttgaccgaccgcaagggtggaacaacgaggcaggcttgcaggcgacaaggctcaggcccgcaggcctgagcgtaaagcgagggaaagtctaccggagaaatggcgcttacgcggtctctaccgtcggaaaactcttgaccagttcgtccaactgcttgagctgggccaggaacggctccagcttgtccaggcgcagggcgcatgggccgtcgcatttggcattgtccgggtccgggtgagcttccaggaacaggccagccagcgactggctgatgccggccttggccaggtccagcacctgggcacgccgcccaccggcggaatcggcgcgaccaccgggcatttgcagcgcgtgggtcacgtcgaagaacaccgggtattcgaactgtttcatgatgccgaaaccgagcatgtccaccacgaggttgttgtagccgaagctcgaaccgcgctcgcagagaatcagctggtcgttacccgcttccacgcatttgttcaggatgtgtttcatttcctggggcgcgaggaactgggctttcttgatattgatcacagcgccggtcttggccatcgcgacgaccagatcggtctggcgcgacaggaaggccggcagctggatgatgtcgcacacctcggcgaccacggcagcctgttcaggctcgtggacgtcggtgatgatcggcacgccgaaggcttgcttgatgtcctggaagatccgcatgccttcttcaaggcccgggccgcgataggaggtcacggacgaacggttggccttgtcgaagctggccttgaacacgtaagggataccgagtttctcggtaaccttgacgtactcttcacagacctgcatcgccatgtcacggctttccagcacgttcatgccgccgaacagcaccatgggcttgtcgttggcaatctcgatgtcgcctacgcgaatgatcttctgggccatcaggtttacgccttcttctgatgttgcgtcagtgctgctttaacgaaaccgctgaacaacggatgaccgtcgcgcggcgtcgaggtgaactcagggtggaactggcaggccacgaaccacggatgatccggcgcctcgaccacttcaaccagcttgccatcaccggagcgaccggagattttcaggccggcttctttgatctgcggcagcaggttgttgttcacttcgtagcggtgacggtgacgctcgacgatcacgtccttgccgtagcaatcgtgaaccagcgagcccggctccagcaggcaatcttgcgcgccaaggcgcatggtgccgcccaggtcggagctttcggtacgggtttcaacggcgccggtggcatcttcccactcggtgatcaggcccacgaccgggtggccgctggtgtgatcgaactcggtggagttggcgtctttccagcccagcacgttacgggcgaactcgataacggccacttgcatgcccaggcagatacccaggtacggcactttgttttcgcgagcgtactgaacggcagtgatcttgccttccacgccacgcaggccgaaaccgcccggcacgaggatcgcgtcaacaccttcgagcagcgcagtgccctggttctcgatgtcttcggaatcgatgtagcgcaggttgaccttggtacggttgctgataccggcgtggctcatcgcttcgatcagcgacttgtacgcgtccagcagttccatgtacttgccgaccatggcgatggtgacttcgtgctcagggttgagcttggcgtcgaccaccgcttcccactcggacaagtccgcgccgttgcactgcaggccgaaacgctcgaccacaaaatcgtccaggccttgggagtgcaggatgcccgggatcttgtagatggtgtcggcgtcttccagggcaatcaccgcacgttcttcaacgttggtgaactgcgcgatcttgcgacgcgaggaaatgtcgatcgggtgatcggagcggcacaccagcacgtccggctgcaggccgatggaacgcagttccttgaccgagtgctgggtaggcttggttttggtttcgccggcggtggcgatgtacggcaccagtgtcaggtgcatcagcatcgcgcgcttggcgccgacttcgaaacgcagctggcggatggcttcgaggaacggttgggattcgatgtcacccacggtgccaccgatctcgaccatcgccacgtcggcatcgcctgcacccttgatgatgcggcgcttgatttcgtcggtgatgtgcgggatcacctggatggttgcacccaggtagtcaccacggcgctctttgcgcagcacgtgctcgtagacacggccggtggtgaagttgttgttctgggtcatggtcgtgcggatgaaccgctcgtagtggcccaggtccaggtcggtctcggcgccgtcgtgtgtgacgaacacttcaccgtgctggaacgggctcatggtgcccgggtcaacgttgatgtacgggtccagcttgagcatggtgaccttaagtccccgcgcctccaggatggccgccaatgaagcggaggcaatgcctttccccaatgaagaaacaacaccgcccgtgacgaatatgtagcgcgtcatgaaaaaccctagaagtctgcgttaaagcggtccgagccgccggggaaagcgaaggaaggccgaagcccccgatcacctgcattaatcacagtgcacctttcaaaaaaaccgccgcgttgtgacagaccagcaatgaaacaccggtacgttgatcgctacacattttttggaatcgcccagcaaagactgcttggtaatcggcaactgctgcgattcagtcgaatccacagaagttgtatcaagaagggagcgtagtctaccggaaaggctctatcagctcaaaccttgatcgcagatctgtggcatccaatgtaattgccagtcgccagacgcacttgcccatagccccgcaagggttgggactgccagcaattgctcgccctgatagaggagcggcaatctgccacggatgaagccgggcactgcacgttcgttaagcagacgcttcaggtcacgtcggcctcgacctggcacttcgacgatttcgccgccctggcggtaacggaccgacaacaggccttcgggggcaccgccaataaacttgagctggccattgccgggtaactctagtgggttttgcggatcgggccagctcaccatagcgtcggaaaattccgaccatgtggtaggcagccaccagaggcgctcaccgcaacgatgcagttggccgtcagccaggcgccacaacggttgtgcgtcacccttggcatcacgcagggaataccagcccgcccagtggtcgctgtcgggtaaacgggtcagcggtgtcagccaatgacgcagggcattgcgctggcgggcgtcggaaagttcgcgtaatggcgcaagggccagcgacggcaaggccagccagggaaacggcgaaggttggtcggcggcgcgcaggtccatgattgctaattcgtcgagcaagccctgggcttcgctcaggtgctcggcagtacgcgccaggctgtcgaccgcttggggccaacgctgcgtcagcgcagggaaaacacggtgacgcaggtaatttcgcgagaagcgtggatcagcattggaaggatcttcgatccaggccaactgatgctcacgggcgtaggcttccaattcagcgcgcgaggcttccagcagcggccgcaccaagtggccatccgccaaagggcgatgcgcgggcatggctgccaacccacgcacaccagccccacgcagcaggcgaaacaacaaggtttcagcctgatcgtcgcgatgctgcccggtgagcaacacctcccctgccccggtgacctcggtaaacgcctgataacgcgcctcacgcgctgcgcgctcaaggcttgcgccgagttggacttgcacgcgcatcacccgcaggggcacgcccaggctgtcacatactgtttggcaatgattgggccaggcgtcagcggcagcttgcaggccatggtggacgtgaatggcgctgagtggaggaagggtttcggtgtttgccagggtggccaggaggtgaagcaggacggtggagtcaagcccacccgagaatgcgatatgccaggccggggcgttgcgccacggggccaaggtttgcaggagtttggcgggtagagttggtttcataacacagtaccgccatcaacctggaatgcgataacccagcatacacaaagcaaatgtgggagcgggcttgtgtgggagccgggcttgcccgcgatgcaggcaactcgggttatctgttacaccgagttgatgctatcgcaggcaagccagctcccacacaagccagctcccacatttgagactgcgtcgactttagaggccgtagctcatcaggcgctcgtaacgacgggccaacagcgcctcgttatcgaacttcttgagcatcgccagttgcgaacccagctcagcacggatagtcgcagcagcggcaaccgggtcgcgatgcgcgccgcccagtggctcggcgatcactttgtcgacaatacccaggcctttgaggcgatcagcggtgatgcccatggcttcggcagcatccggcgctttttcggcggttttccacaggatcgacgcacaaccttccggcgagatcaccgcgtaggtcgaatattgcagcatgttcagttggtcgcagacgccgatggccagtgcaccaccggaaccaccttcaccaatcacggtggcgatgatcggggttttcaggcgggccatcacgcgcaggttccaggcgattgcttcgctctggttacgctcttcggcgtcgatacctgggtaggcacccggggtgtcgatgaaggtcaggatcggcatcttgaagcgctcggccatttccatcaggcggcacgccttgcgatagccttcagggcgcggcataccgaagttgcggcgcactttttcgcgcacttcacggcctttctggtgaccgatgaccattaccggctgatcgtccaggcgagcgataccgcccacgatggccgcgtcgtcggagaagtggcggtcgccgtgcagctcgtcgaactcggtaaagatgtgctgaatgtagtccagggtgtacggacggcgcgggtggcgagccaggcgcgcgatctgccagctggtcagcttgccgaagatgtcctcggtgagcgtgctgctcttgtcttgcaggcgagcgatctcatcgccgatattcagcgaattgtcattgccgaccaggcgcaattcttcaatcttggcttgcaggtcagcgatcggctgttcgaaatcaagaaaattcgggttcataagcgtccgtcttgggtcgacggccaaggagtgcctggccagccggttgtctattcgcgccctaccttaagggagaggcgcgtttaggtcgagattaaatgttcagtcgagatcagacatatctgaccgtcaacggtattggaggaagacgttgtctcgcccgaactggtcacgcaatgcttgaatcaagccatcagcgggatcaattcgccacgtctcgccgaactgcaacatcgccttggcgtcattgccggtgtactccatggtcaccgggcacgcgcctcggtggcgtttgagcaggtcacccaaccagcgtagctgatcgcctttgagggcttcggtcttgaccttcaagcgcaggctttcggcaaggttggtgcgtgcatcttccatgctcatcacccgcttgatccgcaggcgcaggccgccggagaagtcatcgttgctgacctccccttccaccaccaccatcgcatccgtctgcaacaacgactgcgcggaatggaaggcgtcggcaaacagcgacgcttcaatgcggcccgagcggtcgtcgagggtaataaagcccatcttgtcgccctttttatttttcatcactcgcagggcgatgatcataccggcgacggtctgggtatcgcgcgccggtttcaggtcgatgatgcgctgacgggcgaaacggcggatttcgccttcgtattcgtcaatcgggtgaccggtgaggtacaggcccaaggtgtctttctcacctttgaggcgttccttgagggtcagctccttggccttgcgatggttggcgtacacatccgcgtcttcttcgacgaacagcccgccaaacaggtcggcatggccgctgtcatgggtgcgtgcggtctgttcggccgctttgatcgcctcttccatggcggtcagcagcactgcacggttgcggtcgatatttgcctggtaagccttcggctcatcatggaaatacgggccgagacggtcgagtgcgccgctgcggatcaaaccatcaagggtacgtttgttgatgcgcttgaggtcaacccgtgcgcagaagtcgaacaggtctttgaacggcccgtcctgacgcgcttcggtgatggcctccaccgggccttcgcccacgcctttgatggcgcccaggccataaatgatgcgaccttcgtcgttcaccgtgaacttgaactccgaggcgttcacgtccggcgcgtcgaggcgcagcttcatggtgcgcacttcctcgatcaaggtcacgaccttgtcggtgttgtgcatatccgccgagagtaccgcggccatgaacggcgccgggtagtgggctttcagccaggcggtctggtacgacaccaggccgtaggcggcggagtgggatttgttgaaaccataaccggcgaatttttccaccaggtcgaaaatgttaccggccaggtcagcgtcgatattgttggtggcgcaaccttcaatgaaaccgccgcgctgcttggccatctcctcgggctttttcttacccatggcgcgacgcagcatgtccgcaccgccaagggtgtaaccggccatgacctgggcaatctgcatcacctgttcttgatacaggatgatgccgtaagtcggcgccaatactggcttgaggccttcgtactggtagtcggagtgcgggtacgccagttcagcgcgcccgtgcttacggttgatgaagtcatccaccatgcccgattgcagcgggcccggacggaacagcgccaccagtgcgatcaagtcttccaggcagtcgggcttgagctttttgatcagctccttcatgccgcgcgactcaagctggaacaccgccgtggtttcggctttttgcagcaaggtgtacgtcggtttgtcgtccagcgggataaaggcgatatccagcggttcttcgttgaccttggcgcggtcgcggttaatcgtcttcagcgcccagtcgatgatcgtcagggtccgcaggccgaggaagtcgaacttcaccaggccggccgcctccacgtcgtccttgtcgaactgggtaaccaggccgtcaccttcttcatcgcaatagatcggcgagaagtcggtgagtttggtcggcgcaataaccacaccaccggcgtgtttaccgacgttacgcaccacgccttcgagcttgcgcgccatgtcccagatttcggcggcttcttcatcgaccttgatgaagtcgcgcaggatttcttcctgttcgtaggccttttccaaggtcatgccgacttcaaacgggatcatcttcgacagacggtccgccaagccgtaggacttgccctgcacccgggccacgtcacggattacagccttggccgccatggaaccgaaggtgatgatctggctgaccgcgttgcggccgtatttttcggccacgtactcgatcacgcggtcgcggccatccatgcagaagtcgacgtcgaagtcgggcatggatacccgttccgggttcaggaaccgttcgaacagcaggtcatattccagcgggtcgaggtcggtaatcttttgtacataagccaccagcgaaccggcacccgacccccggccaggccctaccggtacgccgttgcttttggcccactggataaagtccattacgatcaggaagtaaccggggaagcccatctggatgatgatatccagctcgaaattcagccggtcgacatagacctggcgcttggcgtcgtagtcttcggtgatgtccttgggcagcagcacgctgaggcgttcttccagcccatcgaacgacactttgcggaaatactcgtcaatggtcatgccatcgggaatcgggaagttgggcaggaagtgcttgcccagcttcacttcgatattgcaacgcttggcgatctcgacggagttttccagggcctcgggcaggtcgctgaacagctcggccatttcctcggcgcttttgaggtactgctcttcgctgtagttcttcgagcgacgcgggtcatccagcgcccggccttcgccgatgcacacgcgagtttcgtgagcctcgaaatcttccttcttgataaaacgcacatcgttggtcgccaccagcggcgcgcccagcttttcggccagggccacagcggcgtgcagatgctcttcatcgttggggcggttggtgcgctgcacttccagatagaagcggtcagggaaaacgtccatccactcgcgggccaacacctcggcttcgtgcgggttaccgccgagcagcgcgataccgatctcgccctctttggccgccgagagcatgatcacgccttcgctcgcctcggccacccactcacgctcgatgatgatcgagccgttgcgctggccgtcgataaagccacgggaaatcagttcggtgaggttgcggtaaccgacgccgttcatcgccaacaggctgatgcggctcagggggttatccgggtctttgttggacagccacaggtcggcgccgcagatcggcttgatgccggcgcccatggcgtttttgtagaacttgaccagggaacacatgttgttctgatcggtcaccgctaccgcaggcatgttcatgcccaccagggttttgaccagcggtttgatccgtaccaggccgtcgaccagggaatattcagtgtgcaggcgcaggtgaacgaatgaagccggcatagtgatcctgtctagaaacttagaaacaacaaggcccgggattgtaccgggccttgagcaaaacatcagcctcgcgactaaacctcgctgaggctctcacgcacctcgtaagcctgacgcaccggggcaaacgagcggcggtggatcggtgtggggccaaggcgagccagggcttccagatgaacgggcgtcggataacctttgtgaccgccaatgccgtagccggggtagatcaattcgaacgcggccatttcacggtcacggctgaccttggccaggatcgaggcagcggcgatagccggaaccttgctatcgcctttgaccaccgcttctgacggcatcgccagtttcgggcaacggttgccgtcgatcatcgccattttgggcgtgatgtgcaggccttccacggcgcgctgcatggccagcatggtcgcgtggaggatgttcaacttatcgatttcttcaacttcagcccgagcgatgtgccagctcagggctttttcacagatctcgtcatagagcttttcacgacgggcttcggtgagttttttcgaatcgttgagaccgaggatcgggcgattcgggtcgagaatcaccgctgccgtcacgactgcgccacacaacgggccgcgccctacttcgtcaacgcccgccaccagttcgtgggcctgggcaacgaggctgaaatccaggcccatttgcacgctcataaggcttcctgtttatggccgatcaaggtcagcaccgcatccgccgcctggttcgaggcatcacggcgcagggtgcggtgaatgtcgtcgaaaccacgggtctgctcttcgccgccgtcgatcaagggtagtagagtttgcgcgagcgcctcgggcgttgcatcgtcctgcaacaactccggcaccagcagacgctgagccagcaggttgggcaaggagatgtaagggcttttgaccatgcgcttgagaatccagaaggtcagcggcgccaggcgataagccacgaccattgggcgcttgtacagcaaggcttccagggtggcggtgcctgaggcgatcaacaccgcgtcacacgccgcgagggccaggtgtgactggccgtcgagcaaggtcaatggcaggtggcgaccttccagcagtgtttcgatttgtgcgcgacgctgcgggctcgcgcagggtaaaacaaaacggacacccggtttcagtgcttgcaagcgctcggcggcatcaaaaaacagcgcacccagacggccgacttcgccaccacgactgcccggcatcagtgcgaccagcggcccgtcgggcaggcccagctcggtacgcgcggaggcgcggtcggcctgcagcgggatggtatcagccagggtgtgcccgacaaaccgcaccggcacgcccttctcttcatagaacctggcttcgaagggcagcaaagtcagcatcaagtcgcaaccttcacggatcttcagcacgcgcttctgccgccacgcccacacagacgggctgacgtagtgcacggtcttgatcccggcctgacgtaacttgagttcgatattgagggtgaaatccggtgcgtcgatgccgataaagacgtcgggcttttcttcgatcagcgtctgaatcagcagcttgcggcgcgccagcagctcacgcaaacggcccagcacttcgaccaggcccatgactgacaggcgttccattgggaagtaggaagtgaggccttcagcctgcatgagcgggccacctacaccgataaactccactgcaggatgttgggccttgagcgcccgcatcaggccggcgccaagaatgtcgccggaggcctccccggcgaccagcgcgatacgcagattagccatgatcagcgagtgatgccgcgagtcgatgcctggatcgagtcacggaacaccgcgacttccgggaacaacgccgccggctgggtcagttcggtcagggcctggtcaaccgtaagcccctggcgataaaccaccttataggcacggcgcagggcgtgaatcgcatcttcgctgaagccgcgacggcgcatgccttcgaaattcatgctacgcgcttcggctgggttgccgaataccgtgacgaaggctggaacgtctttaccaatggctgtgcccatgccggaaaagctatgggcgccaatatggcaatactgatgcacgagggtgaagccggacaggatcgcccagtcatcaacatgcacgtggccagccaacgcggtgttgttgaccaggatgcaatggttgccgatcacactgtcatggccgatgtgtgcataggccatgatcaggttgtgatcgcccagggtggtctcggcacgatcctgcacggtgccgcggtgaatggtcacgccttcacggatgatgttgtgatcaccgatgaccaaacgcgtttcttcacccttgtacttcatgtccggggtgtcttcgcctaccgaggaaaactggtaaatacgattgtgcttgccaatgcgggtcggacctttaaggatcacgtgcggcccgatgacagtcccctcgccgatttcaacacctgcgccgatgatcgaccaagggccgacctcaacgtcggcggccagaacggccgacggatcgatgattgcgcgagggtcaatcaaactcatagtttgcgttccgcgcagatgatctcagcggagcacaccggcttgccgtccaccgaggcctggcattcgaacttccagatctggcgcttgcagctgatgaacttggcttccaggatcaactggtcgcccggggtgaccgggttgcggaaacgcagcttgtcggagcccacgaaatagtaaagcgtgccatcggcaggcttgaggtcgagcattttgaaaccaaggataccggcagcctgggccatcgcttcgatgatcaacacgcccggcatgattggatgcgcagggaagtgaccattgaagaacggttcgttgatgctgacattcttgtaggcacgaatgcgcttttcctcgacgttgaggtccactacacggtccaccagcaggaacgggtaacggtgaggcaggtattcgcgaatctcgttgatgtccatcatttcggggggaagcctgtaataaagattgggggcgggcggactaaacgcacgccccgctagcaaatcaaggaggcagtctagcggctgtgcacacttgatatggaaatggtatcagccttctgatgaagcattaccgccaggggtcacgtcctcgacacgcttttcgacctgtttgagacgtcgggccatttcatcgatcttgcgcaaacgtgccgcacttttgcgccattcagccgcaggctgcatggccgtaccggaagagtaggacccaggctcggtaatcgagtgggtcaccatggtcatgccggtaatgaagacgttgtcgcaaatctcgatatgccccaccagcccaacgccaccggcgagcatgcaatgcttgccgatcttggtgctgccggaaatccccacgcaggcggccatggcggtgtgatcgccaatctgcacgttgtgggcaatctgaatctggttgtcgagcttcacaccgttaccgatcacggtatcggccaacgccccgcgatccacagcggtgttgacaccgatttccacgtcatcgccgatcaatacgccgccgacctgggcaatcttgtgccagacgcctttggcgttggcaaagccaaaaccttcaccgccgatcacggcgcccgactgaatcaccacacgcttaccgatacgcacgtcgtggtacagggtgacgcggggtgccagccagccatcggcaccgatttcacagcgcgcaccgataaagcaatgggcgcccacggtgacgccggcgccaatgcgcgcgccactctcgatcacggcgaacgcaccaatgctggccgcagggtcaacctgagcatcatcggcaataaccgccgacggatgaataccggcagcggccttgggctttggatcgaatagatgcgaggcccgggcatacgccaggtaaggatcagccaccaccagcgcatccccggtaaacccttcggcatcggcggccttcagcaacacggctgcggcttggctgtcgaccaggtatttacggtattggggatttgcgaggaagctcaactgagctgggccagcctcctgcaaggtggctagcccagtgatttctttctccggggagccacgcaaggtggctcccaggaactcggccaactcgccgagcttgatagtcgcggtcatggcttacttcagctggttcatgcgctcgatcacctgacgggtgatgtcgtattgaggcttgacgtcaatcacggcgccacgctcgaacaccaggtcaaaggcacctttcttgatgacttcttccacagcgctgtcgagtttcggcttgagctgcttgagcatttcacggtcagcaacggctttggcttcgttcagctccttggactggaactgatagtcacgagccttttgcttgaattcaagctccagacgctcacgctcgccttgctgcattttgtcgccgccagctaccaggcggtcctggatacccttggcactgctttccagcgtcttgagcttggtcagctgcggaccgaatttcttctcggcgtccacggcgtatttcttggccgcgtcggattccagcagcgccatctgatagttcagaacggcgattttcatttcggcgaaggccggggtggttaccagcacagtggccagcagaaccaattgagtcaacttacgcacgatgtactcctacagaatccgttgtcgttatcttgggtcagacgcttagaacgtctggccgagggagaattggaaaatctgggtttcagcgttatccggtttcttgatcggcatggccagagcaaagctcaatgggccaagcgcggtcacccacgtcacaccaacacccacggagctggcgaggttgctcaggctgatgtcgttgcactcggtctgagacttcacaccgctcgggttagtgatctgttggcacttggagtcgaacacgttaccgacgtcccagaaaaccgaagtgcgcaacgaacgctgatccttgacgaatggcagcgggaacagaagctccgcaccaccttggatcaacacgttaccaccaaaggccagcgcgtcattgtccgaatcaggctgcgtaccctggttgccggtcacggctacaccacggcttggcgtaccacgtgggcccaatgtgctgtccttgaaaccacgaaccgagttgaaaccacctgcgtagtagttctcgtagaacggcagaccgttggttgaaccataaccgtcgccataacccagctcggtgtgcaggcgcatggtgtagttatcgctcagaggctggaacaactggccacggtagtcgagcttgaagaacgacaggtcgctgcccggcgtagtggcttccgcagtcaggctttgggaatggccacgggtcgccagcacacctttgttcagggtcgattcagaccagccgaccgacgccttgaagttcaggaactggtcaccctctttacgcacgaagtcgaaaatctcatccgtggtgtacacaccggtcttgattttgtcctgttgcgcagtaaaaccgaaggtcagacgcgacgtttcgctgatcgggtaaccgatgttgacaccggcaccaaggctgtcgatcgcataacttgcaacgtcaacgttgaggtctttgtagtcggtggtgcgatagaaggcgttgtagcccaggctcacaccgtcagcagtccagtaggggtcgacataaccgaagttatagcggctctggtattcgcttcgggtcaggccgatggaaaccttgttaccggtaccgaggaagttgttctgggtaatcgaaccacccaggatcaggccggcactctgtgcaaaaccgacgctggcggtgatcgagcccgaggcttgctcttcaacggcgtagttcacgtcaacctggtcatccacacccggtacggccggggtttcgacattgacttccttaaagaagcccaggcgctcaagacgggtcttggactggtcgatcaggtaagtcgatgcccagccaccttccatctgacgcatttcgcgacgcagcacttcgtccgcagacttggtgttgccacggaagttgatgcggttcacgtaggcacgcttgcctgggtcgaccacgaaagtgatgtccacagtgtggtcatcatcgtgcggcgtcggcacgccgttgacgttggcgaaggtgtagccttcgttacccaggcggcgggtgatcagctcggacgtggtggtcatcagcttgcgcgagaacacctggttcttctgcaccagcaacaacgccttgacctggtcttcaggtactttcaggtcgccactgagcttcacgtcacgaacggtgtacttctcgccttcgttgacgttgacagtaatgtagacgtgtttcttgtccggggtgatggacacctgggtcgaagcgatatccatgttgatatagccacggtccaggtagtaggaacgcagacgctccaggtcacccgacagcttctcacgcgcatacttgtcatcgttcttgaagaacgacagccagttggtggtcttgagttcgaacaggtcgatcaggtcgtcatcagcgaacttggtgttgcccaccacgttgatgtgctggatcgctgccacagtgccttcgttgatgttgaccttgaggcccacacggttacgaggctgggggatcacttcagtttccacggtcgcggagtagcgaccctgggcaacgtactggcgttgcagttcgttacgcacaccttcaagggtggcgcgctggaagatctcgccctcggcaaggccggattgcttgagccccttcatcaagtcgtcagtggagatcgctttgttaccttcgatctcgatactggcgacagaaggtcgctcgacgacagtgatgaccaggacattgccttcgcgacccagttggatatcttgaaagaacccggttttgaacagcgcacgagtggattccaccaggcgacgatcatccgcctgttccccgacgttcaacggcaaggcaccaaagacgctacccgcggaaacccgctggaggccgttgacacgaatatcggagatagtgaaggactcggcgtgaacttcggcgatcatcaatacggtgagaaccgcagttagcagcagacgtttcatgaagtcctttcttattccaactggcaataaacaaactgccgcaaaatgcggcagattcgcaattcagcgaagcgttacagtcgtcccagatcgttgaccagagctaacaacatcactccgaccaccaaactgataccgatctgtatcccccaaccctgcacccgatccgacaaggggcgaccacgcacccactcgaccagataaaacaacagatgccccccatccaatactggaatgggcagcaaattcagaaccccaaggctaatactcagataagccaggaaattcaggaaatccgcgacacccgactgggcagaagcgcccgccactttagcaatggttatcggtccactcaagttttttaccgagagctcgccgaacaacattttcttgagcgattcgagggtcagcacactcatggtccaagtgcgctttgcaccctcgccaattgccgccaacggcccgaagctgacctcgcgcaccatcgatggcggccactcgacacctttcaccccggcaccgagataacccccggccgccttggcctccccgcgaaccgcgagggtcacagggacgtcgatttgagcaccatcgcgctcaactttcagcacaattttggtatcagggcgtacacgcaccaggtcgaccacttgctgccaatcgcccaacgcctgaccatcaagggccagcagacggtcgccggttttcagaccagcagcctgcgccggacctttcgggtcgagctcggcgagcaccggcggcaacgccggtcgccacggacgaatgcccagggacttgatcgggtcaggctcatcagcgcccttgagccaatggtcgagggccaattcacgcggcgtttcggtggtggcatcctgctcgcgcaccacgacattgatggtgccgctttcacccatgcggcgcaccaactgcaaattcacagcgccccaacccgtggttggctcgccatcaatagaaacaatttcctgcccggcgaccaggccagccttggccgccatgctatccgcctcaaccgcgccgatgaccggacgcacctgctggctgcccatcatggccaggacccagaagaacaccatcgccaagaggaagttggcgatcgggccggctgcaacaatagcgatacgctgacgaacggtcttacgattgaaggactggttcaactgatcagcaggcacttcgccttcacgctcatcaagcatcttcacgtagccacccaacgggatggccgcgatcacgaattcagtgccccgccgatcgtgccaacgcagcagcggcatgccaaaaccgacggaaaagcgcagtactttgacgccgcaacgacgggccacccaaaagtggccgaattcgtggaaggtcaccaacacacccagagcaaccagggtgccgacaatcatgtagagcgcactcatctaatttctccgcattccaatccagtgcctgtaggctcaaacctgcccacagactaacgcgcgttgcggttcaaccattgcttggccagggtgcgggcctttgcatcagcctcgaacactgcccctaaatcatccacagccacaacgggctcaaggctcaatacatcctcgatgatactcgcgatctgcggaaagcgaatacgcccgtcaagaaacgacgccacagccacttcattcgccgcgttgagcatggccggcgcgctgctgcccacctccgctgcttgccgggccaggcgcaggcacggaaagcgctgctcgtccggcgcctcgaaatccaggcgtgcaatcgcgaacaggtccaacggtgcgacaccggagtcgatccgctccggccaagccagggcattggcgatcggggtacgcatgtcgggattacccaactgcgccaacaccgaaccatccacatagtcgaccagggaatgaatcacactttgcgggtggatcaccacctcgacctgatccggccgggcatcgaacaaccagcacgcctcgatcaactcaaggcctttgttcatcatgctcgccgaatccacggagattttgcgccccatggaccaattcgggtgcgcacacgcctgatcaggcgacacatgctcaagctcatccagcggagtttgccggaagggcccaccggaagccgtaaggagaatccgccgcacgccaacctgggtcaggccacgggcaaaatcaccaggcatgcattggaaaatcgcgttgtgctcgctgtccaggggcaacagcacggcgccactcttgcgtaccgcctgcataaacagtgtgcccgacatgaccaatgcttctttgttggccagcaggatcttcttgcctgcatcgactgccgccagtgtcggccgcaagcctgccgccccgacaatagccgccacgacagtgtcgacttccgcatcggctgacacctggcacagcccctcctcgcctaccaatacctgagtagccaggccggcagcgcgcagatcgtcttgcaaaccacgcgccgccgccgcttcaggcacgacagcaaagcgcggcgtgtggcgtacacacaaggccagcaactcagccaaacgcgtgaagccggtcagcgcaaacacctgatagcgatcaggatgacgcgcgatcacatccagggtgctcagcccgaccgagccggtcgcacccagcaccgtcacctgctgcaggcggctcacgacgccgtcatccacagcagcacggcaaagatcggaatcgcagcggtaaggctgtcgatacgatccagcacgccaccatgacccggcaacaggttactactgtccttgatcccggcctggcgcttgaacatgctttcggtgagatcacccaccaccgagataaacacgaccaccgccgtacccaacaaggccaggaggatttctttcaccgaccagtcgcgcacaacaccgacaaccagcgtgatcaccaaggtcaacgccaagccaccgtagacgccttcccagctcttgcccggactgaccgccggcgccagcttgcgtttaccgaaggcccgcccggagaagtaggcaccgatatcagccccccacaccagcaccatcacggccatgatcaaccagttgcccatcggcgaattcttgatttctaccaacccttgccaggccggcagcagaatcaataaaccaatcaccagtttgctggccacactggaccactggccgctggtacgcggataggtcagcaccaggaaggtcgcgagcgcccaccacaacaccgccgcccccaacacccagggcaccacaatgctcgaaagcgtatgcatgaggaacagcagaagtgccacgacagcggcgtacaccacgcgcggcaactgctcggtgaaacctgccaggcgcgcccattcccaggcgcccaaggtcacgaccaggccgataaacagcgcaaaaccggaaccgtcgagcaggaaaaacccacacaaggcaatcggcagcaggatcagtgctgtgatgattcgttgtttaagcatttaaacccgggctccagcttcgatctgctcgctcgttttaccgaagcgacgctgacgggaagcgaaatcggccagcgcattacgcatggcatcgtgtttgaagtccggccagaacaggtcggagaagtacagctcggtgtaggccagctgccacaacaggaagttgctgatgcggtgctcaccaccggtacgaatgcacaggtccggcaacggcaggtcgccggttaccaggcaggtttgcaacagttcaggcgtgatgtcgtcgggcctcaggtgcccggcctgcacttcgcgggcaagccgctgtgcagcctgggcgatatcccactggccgccgtagttggctgcaatctgcaacacaaaacggttcgcgccggcagtaatagcctcggcttcgcgcatggccgcctgcagctccggatggaaccgcgagcgatcaccaatgatgcgcaggctgatgttgttgtcgttgaggcgcttggcctcacgacgcagcgccttgaagaacaggtccatcaaggcactgacttcttcggcgggccgttgccagttctcgctggagaaggcaaacagggtcaacacctcaaccttggcctcggcacacacttctattaccgcgcgcaccgcatcgacacccgctttatgcccggcaacacccggcataaagcgtttcttcgcccagcgattattcccatccatgatgatcgcgacatggcgcggcaccacggagggcacagtctgcttggtcttttccatgaaggcgtcctgaccccttatacggccatcaggtccttttctttctcttccgtggccttggtgatctgggcctcggcgtctttggtcagcttatcgatatcggcgacggcacgacgctcttcgtcttcgctgatttctttgtccttgaccaacttcttcaggtcacccaatgcgtcacgacggatgttacgcacggcaacacgtgcatcttccgctgcgctgcgcgcctgcttggtgaagcccttacgggtttcctcggtcagcgcaggcatggagatcagcaacaactcgcccaggttggtcgggttgaggttcaggccggcgctctggatggccttgtcgacagcggcaagcatgttgcgctcgaaagccacgacctgcagggtgcgcgagtctttaacggtgacgttggccacgccgctcagcggggtgtcggcgccgtagtaaggcaccatcacgctacccaggatgctcgggtgcgctttaccggtacgaatctggccgaatgcgtggctcagagactccagggatttttgcatacgctcttgagcgcctttcttgatgtcgttgatcattgttggccttcctcgatcagagtcccttccgcgccgccgtgtacgatattcagcagggcgccgggcttgttcatgttaaatacgcgcagcggcatcttgtggtcgcggcacaggcaaatagccgtcaggtccatcacgcccagcttgcgatccagcacttcatcgtaggtcagatgatcgaacttctcggcatgcgggtctttgaatgggtctgcggtgtagacgccgtccaccttggtggctttgagcactacgtcggcatcgatttcgatagcgcgcaggcaagcggccgagtccgtggtgaagaacgggttacccgtaccggcagcaaagatcacgacttccttggcgttcaggtgacgcatagctttgcgacggtcatagtgatcggtcacgccgaccatggaaatagccgacatcacgattgccgagatattggcacgctccagggcgtcacgcatggccaaggcattcatcacagtggccagcatgcccatgtggtcgccggtcactcggtccataccggcagcactcagtgctgcgccacggaacaagttaccgccgccgatcaccaggccgacctgaacaccgatacccaccagttggccgacttccagtgccatgcggtcgagtaccttgggatcaatcccgaactcttccgagcccatcagggcctcgccgctaagcttgagtagaatgcgtttatagcgagcctgataaccactgccctgctgagccattgcgaatctctcctgcggcgtattttttaaaaattcttggcgagccgtttacggcttgcgttcactctagctggacgctatcacagcgccatcggaacacggctttgtaagccagttccgaaaggaagccaaataaaaattggccttcccatttgaaaagaggctgcgcgcgtgagcgggcagcctctttcgggcgacagttaaaaactgtcttattgcttggcggcagccagctgggcagcaacttcttcagcgaagttgtcgaccggcttctcgatgccttcgcctactttgtagtaagtgaaggaaacgatttcagcaccggctttcttagccagttcgccaaccttgatttcagggttcttgacgaacgcctgctcaaccaggctcgcttcagccaggaacttgctgatacggcctttgatcatgttttcaacgatgttctctggcttgccggcgatcttgtcggcgttcaggctcaggaacacggctttttcgcgctcgattgcgtcagcagacacttccgatggcagcaggaactctgggttgctggccgctacgtgcatagcgatgtctttagccagctcaacgtcgccgcctttcagggcaaccacaacgccgattttgttgccgtgcaggtagccaccaaccacatcaccttcgatgcgagccaggcgacgaatgttgacgttttcgccaaccttgccgaccagtaccaggcgatcagcttcttgagcttcgatcaacggctcaacggtggtgagcttgtcgtcgaatgctttcttgacgctggcagcaacgaacgccttgaagtcgtcctgcagagccaggaagtcggtctgcgagttcacttccagcagaacggcggctttaccgtcttcaaccagagcgatagcgccttcggcagctacgttgccggctttcttggcagccttgatggcgccggaagcacgcatgtcgtcaatggctttttcgatgtcgccgccggccttggtcaaggcctttttgcaatccatcatgccttcgccggtgcgctcacgcagttctttaaccaacgctgcagtaatctctgccatttcaaaatcctcttggataggttttcaaccattccacccgatcaaacgggcgatcaattcttcccgaatcacctttgtaggccgctgcacgttacaggtgttgtagctgcgcttccgacaaatggttttcgaggtggcaaaaagggggccaagccccctttttgcttactgagtcaacgccagggcgtcaattactcagctgcagctaccggagcttcttcaacgaactgctcggtgccaccagcaacgtggttgcggccacggattacagcgtcagccatcgaacccatgtacagctggatagcgcggattgcgtcatcgttgcctgggatgatgtagtcaacgccttccgggctgctgttggtatcgactacgccgataaccgggatgcccagcttgttggcttcggtgatcgcgatgcgctcgtgatcaacgtcgataacgaacagtgcgtcaggcaggccgcccatgtccttgataccacccagggaacgatcgagcttttccaggtcgcgagtgcgcatcagcgcctctttcttggtcagcttggcgaaagtaccgtcttcggcttgcacttcaaggtcacgcagacgcttgatggaagcacggatggttttgaagttggtcagcatgccgcccaaccagcggtgatcgacgtacggcgaaccgcaacgtgctgcttcttcagcaacgatcttgccagcggaacgcttggtgccgacgaacagaatcttgtttttgccctgggccagacgctctacgaaagtcagagcttcgttgaacattggcagggttttttcaaggttgataatgtggatcttgttacgcgcgccgaaaatgtatttacccattttcgggttccagtaacgggtctggtgaccgaagtgcacaccggccttcagcatatcgcgcatgttgacttgggacatgatagttccttaataagtcgggtttggcctccacgtatcccaatgaccaaccagcggcattcgcctccggcacccaggtcatcgtgtcgacacgtgtgtggatttaagctctgcggggcatccccggaaagcggcgcattttataccacacgaaggacgaaaacggaacccgcaatcacatttgccgtgagcggcgtttacgtaaccctttgaatagagcctatatacccccaccttatagaaagaagcgatcatcagaggctcatgatttgacgccatcgtctgttagaatcgtgttttctgtggcttgtgcgaattctgtaacctttttgtcgcacgcccgtaaaccgtattgatttcagcgcgtcgcgctagagagagcctgtatgaccgttagtttgaaaaccgccgaagacatcgccggcatgcgcatcgccggcaaactggctgccgacgtgctggaaatgattgccgagcatgtcaagccaggcgtgaccaccgaaaccctgaaccagatctgccacgactatatagtcaacgtccagggcgccatccctgcgccgctgaactacaagggtttccccaagtcgatctgcacctcggtcaaccacgtggtctgccacgggattccgggcgacaagccgttgaaagacggcgacaccctgaacatcgacgtcaccgtgatcaaggaccgctatttcggcgacaccagccgcatgttccacgtgggcaccgtgccggtgtgggccgagcgcctgtcccaggtcacccaggaatgcatgtacaaggccatcgaaatcgtcaagcccggctgccgcctgggcgatatcggtgaagtgatccagaagcatgccgaaaagaacggcttctcggtggtgcgcgacttctgcggccacggcatcggcacagtgttccatgaagagccgcaaatcctgcattacggccgcgccggcaccggcatggaactcaaagcaggcatgacctttaccattgagccgatgatcaaccagggcaaggccgacaccaaggtgctgggcgacggttggaccgcgatcaccaaggatcgcaagctctcggcccagtgggaacacaccctgctggtgaccgaaaccggctacgagatcttcaccctgcgcgccgatgacaccatcccgcgcatttcggcttaaaggctgacttggttttcccacagcgtgttgtgactgactgacagatagaaaggaaagccgatcgatgccccaggtggatcccgaactcttcgaccgtggccagttccaggccgaactggcactgaaggcgagccccatcgccgccttcaagaaagctattcgccaggcgcgcgaagtgctcgatgcgcgctttcgcagcggccgggacattcgacggctgatcgaggaccgcgcctggttcgtcgacaacatcctgcaaaaggcctgggagcagttcagctggagtgaagacgccgatatcgccctggtggccgtcggcggctacggtcgcggcgaactgcacccctactccgacatcgacctgctgatcctgctggacagcgccgatcatgagatctttcgcgattccatcgagcgttttctgacgctgttgtgggacatcggcctggaagtcggccagagcgtgcgctcggtggacgaatgcgccgaagaagcccgcgccgacctcaccgtcatcaccaacctgatggaaagccgcaccattgctggccccgagcgcctgcgccagcgcatgctggaagtcaccagcaccgcgcatatgtggccgagcaaggagttcttcctggccaagcgtgccgagcagaaagctcgtcaccataagtacaacgataccgaatacaaccttgagccaaatgtaaaaggctcaccgggcgggctgcgcgatatccagaccatattgtgggtcgcgcgtcgtcaatacggcaccctcaacctgcgcgcactggccggtgaaggctttttggtcgagagcgaaaacgccctgctggcctcgtcccaggagttcctgtggaaagtgcgctacgccctgcacatgctcgccgggcgctccgaagaccgcctgctgttcgaccaccagcgctccatcgccacactgcttgggtttgaaggcgaagacgcgaagaccagcatcgaaagcttcatgcaacagtattaccgggtggtcatgagcattgcccagctcagcgacttgatcatccagcacttcgaagaggtgatcctggcccccgaagacgaagcgccgccgcaaccgatcaactcgcgctttcaactgcatgacggctatatcgaggcgcgcaacgacaacgtgtttcgccgcacgccgttcgccatgctggaaatcttcgtgctgatggcccagcagccggaaatcaaaggcgtacgcgccgacaccattcgcctgctgcgcgagaaccgtcacctgatcgacgatgattttcgcaatgacatccgcaacaccagcctgtttatcgagctgttcaagtgcaagatcggtatccaccgcaacctgcggcggatgaaccgttacggcatcctcgggcgctacctgccggagttcggttttatcgtcgggcagatgcagcacgacctgttccacatttacaccgtagacgcccacaccctgaacttgatcaagcacctgcgtaagttgcagtacacccaggtgtcagagaaattcccgctggccagtaagctgatggccaagctgcccaagcccgagttgatctatttggccggcctgtaccacgacatcggcaaaggccggcatggcgaccactcggaggtcggcgcggtcgacgccgaggcgttctgccagcgccatcaactgccgctgtgggacagccgcctgattgtctggctggtgcaaaatcacttggtgatgtcgaccaccgcccagcgcaaagacttgtccgacccgcaggtgatccacgacttcgcgggcatcgtcggcgatgaaattcgcctcgactatctctacgtgctgaccgtctccgacatcaatgccaccaacccgacgttgtggaactcgtggcgcgccagcctgttgcgccagctctacaccgagaccaagcgcgcgctgcgccgtggcctggaaaacccggtggaccgcgaagagcagatccgccgcacccaaagcgcggccctggatatcctcgtgcggggcggcaacgacccggacgacgtcgagcaattgtggtcgcaactgggtgacgattacttcctgcgccacaccgccggcgacgtcgcctggcacagtgacgcgatcctgcagcagccggccgacggcggcccgctggtactgatcaaggaaaccacccagcgcgaattcgagggcggtacgcagattttcatctacgcacccgaccagcacgacttcttcgccgtgaccgtggctgccatggaccagctcaacctgaacatccatgacgcccgcgtcatcacctccagcagccagttcaccctcgacacctacatcgtgctcgacaccgacggcgactcgatcggcgacaacccggtgcgcgtgaaaaagatccgcgaaggcctgaccgaagccctgcgcaacccggacgattacccgaccatcatccagcgccgggtgccgcgccagctcaagcactttgccttcgcgccccaggtgaccatctccaacgacgcccagcgcccggtgaccgtgctcgaactcagcgcgccggaccgcccaggcttgctggcgcgcattggcgggattttcctggagttcgacctgtcgttgcagaacgccaagattgcgaccctcggcgagcgcgtggaagacgtgttcttcatcaccgacgccgacaaccagccgctgtccgaccctgaactgtgccgacgcctgcaggacgcaatcgtccagcaactgagcgtgacccaggaaccgggtgtcgagctgacgcggctgacgatttgatttcttaactgtgtgaacgcgattcatgtgggagctggcttgcctgcgatgcgggcaccgcggtgtgtctggcgcaacgcagcgatgccatcgcaggcaagccagctcccacagggttcgcgcccattgcattagaggcttacatgaacaacgccctgaaccagctgcagccctacccgttcgagaaactgcgcgccctgctcggcagcgtcacgccgaacccggacaaacgcccgatcgcgctgtccatcggcgaacccaagcacaaatcgccgacgttcgtggccgaagcgctgagcaataacctcgaccagatggccgtgtacccgaccaccctgggcatcccggccttgcgcgaggccatcggcgcctggtgcgaacgccgcttcagcgtgcccaagggctggctcgacccggcgcgcaacatcctgccggtcaacggcacccgcgaagcgctgttcgcctttacccagaccgtggtcaaccgtggcgacgacgcgctggtggtcagcccgaacccgttctaccagatctacgaaggcgccgcgttcctggccggggccaagccgcattacctgccctgcttggacgaaaacggcttcaacccggattttgacgctgtgtcgccggacatctggaagcgctgccagattctgttcctgtgctccccaggcaacccgaccggcgcattgatcccggtcgacaccctgaaaaagctcatcgccctggccgatgaatacgacttcgtgattgccgccgacgagtgctacagcgagctgtacttcgacgaacaaaccccgccgccaggcttgctcagtgcctgcgtggaactgggtcgccaggacttcaagcgctgcgtggtgttccacagcctgtccaagcgctccaacctgccaggcctgcgctccggctttgtcgccggcgacgccgacattctcaaggcgttcctgctgtaccgcacctaccacggctgcgcgatgccagtgcaaacccaactggcgagcatcgctgcctggcaggacgaagcgcacgtgcaggccaaccgtgacctgtaccgcgagaagttcgacgcggtgctggccatcctcaagccagtgctggacgtgcagagcccggacggtgggttctacctgtggccgaatgtgaatggcgacgatgccgccttctgccgcgacctgttcgtggaggaacacgtgacggtggtgccgggttcctacctgtcgcgggaagtggacggcgttaaccctggcgccgggcgtgtgcgcatggcgctggttgcgccgttggcggagtgcgtggaagcggctgagcggatccgcgcttttatcacacgcaaccgataacgcaccacacacctgcaccccgcaatggggtgcaggtttaacactcgagttgcagcggctccccatcactgtaactggaaccaagtaacagaatgaaccacatatagacatggagaaatgaatcaaaggattaccgtacatctccgcaccgtggaacactcatgctcactataaacgcgaccaatttacatacccgttccgcactaaccgatcctgaaataaaccctcccgagtccgttagacatacacgcggcatcgccagcacgcgctacttatggccacaacactcgaccattaccatctcactgttcgacatgccggagaaagcaaaagactacgtaaagaaaaacataaatctttggcagccgtatacaaatctgaaattcaaattcatcgaaaccaatgacggtgatattagaatatcgggaaaaaaagatgggactggcagttattcagccgtgggcacgcaagcaaaagaatatccaaaagactcacccacgatgcacattgacctggtacaaacggccgacatgctgaaccacaccatacgccatgagtttggtcatgcactggggctggagcatgaacaccaacatccggaacacacgataaactgggacaaagacaagtggctcgaagagggtaagaaacttggactttcaaaagcagaagtttataaaaatgttctagatacccttgaccccagcctcacgatccgttccgcgtacgatccgaaatcaatcatgcactataaaacgccagcatgggtcaccacggatgggaaagaagtcccctttaccgaagacatatcagaagaggataaagcattcatgatgtctatttacccacctgaagagccggcgacggtctaatccgtcgttcgctgctccccacttgcaaggcgacgccctccgctacttctgcataccaagactcgcctcactcatatccaactccgccaatacctctctcaatacgtcatcaccaatctggtgatgacggctcaagctatacaactccaaccgctgcgctcgcagggccttgagccgcaacttgcgctcaagcaggtccatctgctgcgccagtgcctgggcttcggccgagtcgttgaacacttccaactgatggcgatactccgacatcagccgcgccttgagctcagtggccagtgcggcttgggcggcatcctgggtttcggtttcagcaggttcttcggcttcaagcgcatggatggcggctacggcggtcttcttccaggcttcacgcacttcgttgtggcgcttttcatccgggcttttttcgatgccgcgcaacagcaacggcagagcgatacaggcggcgatcaatgacagcaggatcacgccggcggcaatgaagatcagcaggtcgcgctccgggaaatcctgccccggcgccagcagcaacggcaccgacatgacacccgccaacgtaaccgcaccgcgtacgccgccgacggtcagcagccagcaggaacgggcagtcggcaccagggtcagttcacttttgccacgaatgcggcgcagcaggcccgacagtcgccaaatgctctgcacccagataaagcgcagcaccaccagcaccaggaagatcgcgatcacctccaggcagcgatacaacagggctggccacagcgtcggctcgtggctgacaacggccttgatgatgtccggcagttgcaggcccaacagcaggaagatcaggccattgaaggcaaactccagcagcgaccagacactgcggttgagcaagcgcgtgctggtctgacgtggcagcaggtcgagccagctttgcatcatgcccgccgccaccgccgagagaatgcccgaggcacccaggcgttcagccaatacatacgccgcaaacggcagcagcaacataaacaccacatgggtcgccgggtcatcccaaccccgcgcgatcatccaggcgcgcaaacgcccgaccagccagctcaatgccacgccaaccgccaggccaccgacggccaccagcacaaaggtaaggctcgcatccgccagggagaacacgccggtcagcgccgccgccagggcgaacttgaaggtcaccaggcccgaggcatcattcatcaaggcttcgccctgaagcatgtgcatcagcggcttgggcaaacgattctgggaaatggctgacaccgctacggcatccgtcggtgataaaacagcccccagggcgaaggcaaccggcaatgggatcgtaggcagaatccaatgaatgaagtagccagcaccgatcacggtgaacagcaccaaccccaccgccaacgtcaggatcggcccacgcaggcgccacaactcgcgtttgggcatgcgccagccatcggagaacaacaacggcggcagaaacagaaacaggaacagctccgggtccaacgccacatgcagacccagcgtcggccaggccagcaaggcaccggcggcaatctgcaccaagggcaacggcagtggaatgatgcgcccgacaaggcgcgaaacgctgaccagcatcagcaggataagaacggtgtaggcggtttgcataacgcgggtttcccggacaatcgacttgctgcaacacacatcaggcaacaactggccgttgaagtgccatattacccggctactttacttgcctatgctacgcgatggcttttgcacaaaagtcgcacgaagcactgcacacccgtgacgagcggcacccaaacccgctggtcatggcataatccgtaacctttcgtttttacttggcccaaaggggggcaattccttgaccgcttcaagcaaaacgttgcaccttttcggcatcaaagcctgcgacaccatgaaaaaagcccgcacctggctcgatgagcacggcgtgagctatgaattccacgactacaaaacggccggtatcgaccgcgaacacttgacccaatggtgcgacgagcacggttggcaggtggttttgaaccgtgcgggcaccacctttcgcaaactcgaagacgaacgcaaagccgatctcgatcagtcgaaagccattgaattgatgctcgcacaaccctcgatgatcaagcgccccgtgctcgatctcggtgacagaaccctgattggcttcaagccagatagttattcggcggccctcaagtaggccagccctttccatttttgtagaggtaacagcatgtccaattccctgttcagcctgggcttcggcgtcggcactcagaaccgccaaggtgcttggctggaagtgttttacgcacaacccttgctcaacccgtcggccgaaatcgtcgccgccatcgcgccgatcctcggttacaccgaaggcaaccaggccatcactttcaccgtctcccaggcgctgcaactggctgacgcactcaaaggcgtcgacgctgcccaagcggccctgctgagccgtctggcggaaagccacaccccgctggtcgccaccctgctggccgaagacgccgcactgacttccacgcctgaggcctacctcaagctgcatctgctgtcccatcgcctggtcaagccgcacggcctgagcctggccggcgtgttcccacaactgccgaacgtggcatggaccagccagggcgcgatcgacatcaatgagctggccgaacgccaactggaagcacgcctgcgtggcgagctgctggaagtgttctcggtggacaagttcccgaaaatgaccgactacgtggtcccgaccggcgtacgtatcgctgacgccgcgcgtatccgcctgggcgcctacgtcggcgaaggcactaccgtgatgcacgaaggtttcgtcaacttcaacgccggcaccgaaggcccgggcatgatcgaaggccgtgtctcggcgggcgtgttcgtcggcaaaggctccgacctgggcggcggttgctccaccatgggcaccctgtcgggcggcggcaacatcgtgatcaaggtcggcgaaggttgcctgatcggcgccaacgccggtatcggcattccgttgggcgaccgcaacaccgtggaatccggcctgtacgtaaccgctggcaccaaggtcgcactgctcgacgagaagaaccaactggtcaaagtggtcaaggcgcgcgagctggccggccaaccggacctgctgttccgtcgcaactccgaaaccggtgccgtggagtgcaaaacccacaaatcggccatcgaactgaacgaagcgctgcacgctcacaactaagcagccactcgatgccactagcgggtcgcgccttcgggtcggcccgcttatacgagtcttgaacaccatgcttgtgccctctccctggcgcgccgatttcccggccatcgccaccctgcaacggcaagaccagacctacctggacagcgccgccaccacgcagaaaccccaagccctgttggatgccatcagccattactacgccaatggcgcagccaatgtgcaccgtgcccagcatttgccgggcgcccatgcgacccaggcgtttgaagacagtcgcagcaaggtcgcgcagtggttgaacgcaggtgacagcgggcaaatcgtgtttacccatggcgcaacctctgcgctgaacctcttggcctatggccttgagcacttattcaatgcgggcgatgagattgtcatcagcgccctggaacaccacgccaacttgctgccctggcagcaactggccaaacgtcgcgcgctcaccctggtggtattgcccctggacgatgatggcgtgatagacctgcaggccgccgccgagttgatcggcccgcgcacacgcctgctggcggtgagccagctgtccaacgtgctcggcgcctggcagccgctggaagcgctgatagcgcgcgccagggcccacggcgcgctgaccgttatcgatggcgcccaaggcatcgtccacggccgccacgatgtacaggccctggggtgcgacttctatgtattttccagccacaagctgtatggcccggacggcgtgggcgtgctgtatggccgcaacgaagccctgcatcacctgcgccactggcagtttggcggcgagatggtgcaacaggcggactaccacagcgccagctttcgccctgccccgctgggttttgaagcgggcacgccgccgattgccagtgtgatcggcctgggcgccagcctggattacctgagttcgttggatcagccagcggtgatcgcccatgaagcggcgctgcacgactacctgctgcgcggcttgaaagcacgcaatggcgtccgcgtcttgggttcgccgcacgtagctttggccagctttgtggtggaaggcgtgcacaacgccgacctcgctcacctgctgaccgagcaaggcattgccgtgcgcgccgggcaccattgcgcgatgccgttgctcaaggccatgcacctgtcgggggcgatccgcgtgtccctggcgctgtacaacgactcggatgacctggaacgcttctttgaagcgctggaccaggcgctggatatgttgcgatgagcttgccaaccgaagccgcggctgcgctggaagccttccaggcggtcggcagttgggaacagcgcgcgcggatgctgatgcaatggggcgagcgtctgcccgccttggcggatgcggacaaagtcgacgccaacctggtgcagggctgtgaaagcctggtgtggctggtggggcatttggaggacggccattggcagttcgccgccagcagcgatgcgcggatgattcgggggttggtggcgttgctgctggcgcgggtcaatgggttgtcggcggcgcagttgcaggcggttgacttgccggagtggttcaaccagctggggctgtcccggcaactctccccgtcacgcagtaatggcttgaatgctgtgctgcagcgcatgcgggcattaagccttacacaaaactaaatgtgggagctggcttgcctgcgatgcagacacctcggtttatcagtcaaacctcggtgatgctatcgcaggcaagccagctcccacattttagagttgcaccaggcagtggcattcaggcgggtttaacccgctccgacggccgacgcacccccgccacaatcttatccaccgccttggtcgccgcgaccatgccaaaagtggccgtcaccatcatcaccgcgccaaaccctccggcgcagtccagcttcacgccgtcgccgacaaaacttttctgcaaacagatgctgccgtccggcttgggatagcgcagctgctcggtggaaaacacacacggcacgctgtaatggcgggtcaccgtgcgggagaaaccgtagtcgcggcgcagggtggaacgcactttcgaggccagcgggtcgttgaaggtgcggttcaggtcgcagacctgaatcagcgtcgggtcgatttgcccgccggcgccgccggtggtgatgatctgaatcttgcggcgtttgcaccaggcaatcagcgcagccttggcgttgacggcatcgatgcagtcgatcacgcagtcgatgttcggggtgatgtactcggccatggtgtcgcgggtgacgaagtccgccaccgcgtgcacggtgcaatccgggttgatgccacgcaggcgttcagccatcacttcgaccttgggtttgcccacggtgctgtccagcgcgtgcaactggcggttgctgttactcacgcagacatcgtccaggtcaaacagcgatatttcgcccacgccgcaacgggccatggcttccgccgcccaggagcctacgccgccgacgccgacgatcgccacatgggccgctttcaagcgttccaggccttcaatgccatacaagcgggcgacgcctgcaaaccgcggatcttctgtgctcatgaccattaccccaaaaaccggcgcgcattatggactacacagcgacaagatcgaagctacaagctacaagtaaagaacttcgatggtctttcgctgactaacgtccggcttttctctgtctgctgtacgctcggtgaaaggccggtgtaggatgcgcgccgttcggcgtaggccgacacctcttttcgttccacaccctttggaacccgaaatagccatgtcatcgcgtaaatttggactcaacctggtggtagtgctggcaattgccgcgctgttcaccggcttctgggcgctgatcaaccgcccggtcacgacccctaactggcctgaacagatctccgggttttcttactcgccgttccagcaaggccagtttccgcagaaagatcagtacccgacggacgatcagatgcgccaggacctggcgatcatgagcaagttgacggacaacatccgtacttactcggtcgacggcaccctgggcgatatccccaagctggcggaagagttcggcctgcgcgtgacgctggggatctggatcagcccggacctggaacgcaacgagcgcgaaatccagcgcgccatcgaaattgccaacagctcgcgcagcgttgtgcgcgtggtggtcggcaacgaagcgttgttccgtgaggaaatcacgcctgaagcgctgatcgtgctgctggaccgtgtgcgcgccgccgtgaaagtgccggtgaccacctccgagcagtggcacatctgggaaaagaacccgcaactggccaagcacgtcgacctgatcgccgcgcacatcctgccgttctgggaatttatcccgatggacaaggccggccagtacgtactcgaccgcgcccgcgacctgaaaaaactgttcccgaaaaagccgctgctgctgtcggaagtgggctggccgagcaacggccgcatgcgcgggggcaatgaaacctccccggccgaccaggcgatttacctgcgtacactggtcaacaagctgaaccgccaaggctacaactacttcgtgatcgaggcgttcgaccagccgtggaaagtcagcgatgaaggctcggccggcgcgtattggggcgtgtacaacgccgcgcgccagcagaaattcaactttgaaggcccggtggtcgcgatcccacaatggcgcgtactggccatcggctcggtggtgctggcgttgctgtcgctgaccctgctgatgatcgacggctcggcgctgcgccagcgtggccgtaccttcctgacgtttatcgcgttcctgtgcggctcggtgctggtgtggatcggctacgactacagccagcaatacagcacctggttcagcgtaaccgtcggcattttgctggccctcggcgcactcggcgtgtttatcgtgttgctgaccgaggcccacgaactggcagaagcggtgtggacccacaagcgtcgacgtgaattcctgccggtggaaggcgactcggactaccgcccgaaagtgtcgatccatgtgccgtgctacaacgagccgccggagatggtcaaacagaccctcgacgccctggccgccctcgattacccggacttcgaagtcctgatcatcgacaacaacaccaaggacccggccgtctgggagcctgtgcgcgactactgcgaaaccctcggcccgcgcttcaagttcttccacgtcgcgcccctggccggtttcaagggcggcgcgttgaactacctgatcccgcacaccgccaaggatgccgaagtgatcgcggtgatcgactccgactactgcgtgtcgccgaactggctcaagcacatggtgccgcatttcgccgacccgaaaatcgccgtggtgcagtcgccgcaggattaccgcgaccagaacgaaagtactttcaagaagctctgctatgcggaatacaaaggcttcttccatatcggcatggtcacccgtaacgaccgcgacgcgatcatccagcacggcaccatgaccatgacccgtcgctcggtgctcgaagaactcggctgggccgactggtgcatctgcgaagacgccgagctgggcctgcgcgtgttcgagaaaggcctgtcggcggcgtattaccacgacagctacggcaagggtttgatgccggatacctttatcgacttcaagaaacagcgtttccgctgggcctacggcgcgatccagatcatcaagcgccacaccgccagcctgttgcgcggcaaagacaccgagctgacccgtggccagcgctaccacttcctcgcgggctggttgccgtgggtggcagacggcatgaacatcttcttcaccgtcggtgcgctgttgtggtcggcggcgatgatcatcgtgccgatgcgggtcgacccgccgctgctgattttcgcgattccgccgttggcgctgttcgtgttcaaggtcggcaagatcatcttcctctaccgccgtgcggtgggtgtgaacttgaaagatgcgttctgcgcggccctggccggcttggcgttgtcccacaccatcgccaaggcggtgctgtatggcttcttcaccaccagtattccgttctttcgtacaccgaaaaacgcggataaccacggcttctgggtggcgatttccgaagcccgcgaagagatgttcatcatgctgctgttgtggggcgcagcactggggatttacctggtgcagggcctgccaagcaatgacatgcgcttctgggtggtgatgctgttggtgcaatcgctgccgtacgtagcggcgctgatcatggcgttcctctcgtcgctgccaaaacctgcgccagcggttgagccggcaacggcagagtaaaaacttgcgcaatgcactaaacggcggcctctggccgccgttttgctataagataacggccgttttgtgagtcctggcccaggccctgttctttgtgggagctggcttgcctgcgatgcagacgccgcggtctggcaggtacaccgcagcgatgccatcgcaggcaagccagctcccacattcgtcctgcgccgattcaggttttgtattgcacattcgtccagcgccccttacacgcttcccggagttttcccatgacggcccacgccgagctttcgccgacccttcaactcgctatcgacctgatccggcgcccatcggtcacgccgattgacgccgactgccagaagctgatgatgcagcgcctgggcgacgccggcttcgcgctggagccgatgcgcattgaggacgtcgacaacttctgggccacccacggcaagcatgaaggcccggtgctgtgctttgccggccacaccgacgtggtgccgaccggcccggtgcaggcctggcagaacgacccgttcgacgcgttgatcgacgaaaacggcatgctctgcgggcgtggcgcggcagacatgaaaggcagcctggcggcgatgctggtcgcttccgagcgcttcgtcaccgactaccccgaccacaagggctccgtggctttcctgatcaccagcgatgaagagggcccggcgcaccacggcaccaaagccgtgatcgaacgcctggccgcgcgcaaggagcgcctggactggtgcatcgtcggcgagccgtcgagcaccacgctggtgggcgatgtggtcaagaacggccgccgtggctccctcggcgcgaccctgaccgtgcgcggcgtgcaaggccatgtggcttacccgcacctggcaaagaacccgattcacctggccgccccggccctggccgaactggccgccgagcactgggacgacggcaacaccttcttcccgccgaccagcttccagatttccaacctcaattcaggcactggcgccaccaacgtgatccccggtgacctgacggcggtgttcaacttccgtttctccaccgagtccaccgtcgaaggcctgcaacaacgcgttgcacagattctcgacaagcacggcctggactggcacgtggagtgggcgctgtcgggcctgccgttcctcaccgaaccgggcgccttgctggatgcggtttccgccagcatcaaggcgatcactggccgtgagaccaaagcgtccaccagcggcggtacgtccgatgggcgcttcattgccaccctcggcactcaggtggttgaactgggcccggtcaacgcgacgatccaccaggtcaacgaacgtattctggccagcgacctcgatgtgctgaccgaaatctactaccagaccctgatcaagttgctcgcctgatgctcgcctgccccatttgcagcgcaccgctcaacgcggtggacaatggcgtggcgtgcccggccgggcaccgtttcgaccgcgcgcgccagggttatctgaacctgttgccggtgcagcacaagaacagccgcgaccctggcgataacctcgccatggtcgaggcgcgccgcgactttcttaacgccgggcactatgccccagtggccaagcgcctggcggaacttgccgccgaacgcgcgccacagcgctgggtcgacatcggctgtggcgagggttactacacggcgcaaatcgccgacgccctgccccacgccgacggctacgcactggatatctccaaggaagcggtgaagcgcgcgtgcaaacgcaacccggcgctgacctggttgatcgccagcatggcccgcgtgccactggcttcgggcagttgccaatttctcgccagcgttttcagcccactggactgggcagaggccaagcgcctgctcagccccggcggcggcctgatgaaggtcggcccgacggccggccacctgatggaactgcgcgaacgcctgtatgacgaagtgcgcgagtacaccgacgacaagcatctggccctggtgccggacggcatgagcctggcgcacagcgaaacccttgagttcaccctcagcctgagcgaacccaaggaccgcgccaacctgctggcgatgacgccgcatggctggcgcgcaagtgcagagcgccgcgccgaagtgatcgaggccgccgaaccgctgcaggtcacggtgtcgatgcgctacgattatttcgtgcttcaataactgactttcaagcatccgcgaatggattttcgaatcccgcaacgaggaacatccatgcgccaacctgatatcgagatttacctgaaggacgccgacgtcgaccacaaggccatcgccgcctggctgggcgccgcgctgggcccgtgcaccgactgggtccagaaaggccagacctacaagtgcaaggccggcaaggtgcccgtcacctggctgcccaaggccgtaggcaaatggaacagcctgtacctggaaagcgaccagaccccgtgggaagacgacatcgcctgcgcccgcgccgcgtttgccgcgctgaacgtcgaagtgcgctgcgcaccgggcacgtgggttgaggaagaaggtgaagaaagcgccgacacctggattcgcatcagcgtggacggtgaagagcagatcacctggaaaaccgcctgatccaaacctgcaaacccaatcaacatgtgggaactggcttgcctgcgatggcatcactgtggtctgtctgatagaccgaggtgtgtgcatcgcaggcaagccagctcccaccgttgattgggttaccagaccaagacaggtccggccttacagccccaccacatcctccgcctgcaaccccttctcgccggttaccacggcgtattccacctgctggccctcggccaatgagcggtggccgtcaccgcgaatcgcgcggtagtgcacgaacacatccttgccgtcttcgcgttgaataaagccatagccctttgcatcgttgaaccacttcacattgccggtttcgcgcgttgccatctgttttgctcccacatgcttttattgttgagtcgctcgcattgaactgccgagtataagacaggctcaaaaacgttcaactcaagtttacttcgccgcttttttgccgattttcggcgaatacggcacactacccgcccgagcgcctgctcggtttttttccacttgaagcagcacgcctatgacccgctccccgttccgccgtctggtgtttggcaccttgcgccgactgttgtacctctgggttcgctcggagacgatcaaccagtcgtcactaacccttaacctcgaccgcagccggccggtgttttacgtcctgcaatcgccctcactcaccgaattggccgtggtcgatgccgagtgcaccaaggccggcctgccgcgcccagtgctgccggtgtcggttggccctttgatggaaccggcggcgttcttttacctcacgccggagcccgactggctcggccgccaggacaagcgcggcgcgccgccgaccctgacccggctggtcaacaccctgagcgaacacgccgaagagaatgcacaaatcattccggtcagtgtgttctgggggcagtcgccggagagcgagtccagcccgtggaaactgctgtttgccgacagctgggccgtcaccggccgcctgcgccgcttgctgagcatcctgatcctgggtcgcaagacccgcgtgcaattctccgcgcctatcaacctgcgtgaattgatcgagcacaataaaggtcacgaacgcaccgtgcgcatggcccagcgcatcctgcgtgtgcactttcgtaacctgaagaccgccgtgatcggccccgacctgtcccaccgccgcaacttggtgaagggcctggtcaacatgccgctggtgcgccaggccatcgcggatgaggccgagcgcgaaaaaatcaccccggaaaaagccaaggcccaagccctgcgttacggcaacgaaatcgcttcggactacacctacaccgccatccgcttcctcgaagtggtgctgagctggttctggaacaagatctacgacggcatcaaggtcaataacatcgaaggtgtgcaaaaggttgcccagggttacgaggtgatctacgtaccgtgccaccgcagccacatcgattacctgttgttgtcttacctgctgttcaaaaacggcctgaccccgccgcacatcgccgccggcatcaacctgaacatgccggtgatcggcagcctgctgcgccgtggcggtgcgtttttcatgcgccgcaccttcaagggcaacccgctgtacacctcggtattcaacgaatacctgcacaccctgttcaccaagggtttcccggtagagtacttcgtcgaaggcggacgctcgcgcaccgggcgcatgctgcaaccgaagaccgggatgctggcgatcaccctgcgcagcttcctgcgctcttcgcgcatgccgattgtgtttgtgccggtgtacatcggctatgagcgcgtgctggaaggccgcacgtatctgggcgagttgcgcggggcgagcaagaaaaaagagtcgatcttcgatattttcaaagtggttggcgcgctcaagcagcgctttggccaagtcgcggtcaacttcggcgaaccgatcaaactggccgagttcctcgacgccgagcaacccgactggcgcgcccaggagctggccccgaactacaagccggcgtggctcaacgaaaccaccaaccgccttggcgaacaggtggcgcgccacttgaacgaagccgccgcagtcaacccggtaaacctggtggccctggcgctgctgtcgaccacacgcctggccctggacgaacaagccatggcgcgccagttggacctgtacctggcgctgctgcgccgcgtgccgtactcgccgcataccaccctgccggaaggcgatggcctggcgctgatcaagcacgtcaaggacatggacctgctgtcggaacagagcgacgccctcggcaagattttgtacctggacgagcagaacgccgtcctcatgacctactaccgcaacaacgtgctgcacatcttcgccctgccggcgttactggcgagcttcttccagagcagttcgcgcatgagccgcgaacagatcctgcgctacacccgcgcgctttacccgtacctgcaatcggagctgtttatccgctggtcgctggacgagctggacgcggtggtcgaccagtggcttgaggcgtttgtcgagcaaggcctgctgcgcttcgagaacgacgtgtacctgcgcccggcgccgagttcgcggcattttgtgctgttgacgttgctgtccaagagcatcgcccagaccctgcagcgtttctacatggcgatttcgctgctgctcaacagcggccagaacagcatcagcgccgaagaactggaagacctgtgcacgatcatggcccagcgcctgtcgatcctgcatggtctcaacgcccctgagttcttcgacaagagccttttccgacattttatccaaacgttgctggagcaagatgtgctgcgccgcgatgaggccggcaagttgagttaccacgacttgctcggtgagctggctgaaggcgcggcgaaacgcgtactgcccgccgatattcgcctatcgatccgccaggtggcattgcaccgtgtcgatggcgcagccgaggcgcccgtcgaacccgcagccgtcacgcctgaagaaaaccgctagattgaataaggcgccggatggattccggcgccgttgaaaaggagctgtaccatgaaaaagatcatcctcctgggcctgaccgccctgctcggagcctgccaatccatgcaccccgcgcccaaggccagcctcgacggcgaagtgttctacctgcaacgcatcgccctgccgcccgccgccaccttgagcgtcagcctgcaggacgtgtccttgatggacgcaccggccgtgaccctcgccgaacagaaaggcccggtcaaaggccaggtgccgctgccgtttcacctgagctacgacccggcacaggtcaagcccggccacacttactcggtgagcgctcgcatcgagctggacggcaagctactgttcatcacgactgaacggcacgcggtgcagctcaatggccaagacccacaaccgctgcgcctgcgggtgaatgcggtcgcgcactgatattttccagaacataagccctatcaaaaggaagcgcccatgctccgtaactctcttcgcctcactgccctgtgcgccggcctgctgctcggcgccaacgccatggccctgtcacttggcagcctgtcccaaggtgacgccagcggtggcctcaaggacgcactgacccaaggcgcacaaatcgccgtgaaacagctgggggttcccggtggtttcagcaataaccctgaagtgaaaatcggcctgcccggcaagctgggcaaagtcgccgacaagctgaaaatgtttggcatgggtgatcaggtcacgcaactggaaaccagcatgaacaaggcggctgaaaccgccgtgacccaggctcaaccgatcctggtcaatgccgtgaagaacatgagcgtgaccgacgccaagggcatcctcaccggcggccaggactcggccactcaatacctgaacaaaaccagccgtgaagagatccgtgccaagttcctgccgatcgtcaaggccgccaccgacaaggtcggcgttgcccagcagtacaatgccttggccggcaaggcggcagcgtttggcgcggttgatgccaaaagtgccaacgtcgaaagctacgtgaccgaacaagcgctggacggcctgttcaagatgatcgcgcagcaggaagaaaccattcgcaagaacccggcggccgcagcgaccagcctggccaagaaagtgtttggcgcgctgtaacccttcacaacgggtacgccaacctccgttgttacggacgttggcgtaccggccttacgctagtaccttatcggtgcaacgaagtcagcgagtgcatcggcctgtcgggcaacgggtattcgcacaccgggtagggatgcgagttgccgtgacccggcctttcgggcagggagtggcccgcgccagttgtggatgaataagcagggtgagagcgcttacgccggtgtggcgagtgggtttcaggcccccgaacagacacgttattgcctaacaaggcgccaagaaacgcacctttgaacgcagcgatagcattaagaaacgacatatgacactccatgaactcattggaaaagcccggccgccaactggcaaagccgaaacctgtgcctgtccatcaggcaaatctgagtggagtaaaaaaagccgatcgttccagccacattgatgcctgtttgcatcagcatgtgaatcaacccatcaccgagtccgccaaccgcccgatcatgagcgtggcaaaacagcaaatggccacggaggttgcccgattgatcttcagcggtgtgagccacgcctgctgacccccttcgaaacggctgcccagtacgatccacgcagcgcctaccggtatcaccaccaacgccagcgtagccatgaacccggcatagccttgcaacgaatcaaacgtgctgaccggcgcgataaacgaaacgatcagcaggcctttggggttcatcactgtgagccagaagaaatacaggctggagaaagggtcgccggccgcaatggcatcggcgcttttgcgctgccaaagcctgaaagagacatacagcaggtaacaggccgcccccagctgtatggttttcaaagcccatgacgaatacgccgccagatacagcaatgccacgccccacaccgatacctgcaacaggtacgccaggcactcgatgaatgccagcttccacgaagcccgccacccgaacaacacaccggcacgcaacagcagcgtgttggttgggcccggggcgagtagcaacaacgtcagggctgaaacggtggccaacatgattacgcgacgtccttcctcactcggaaccacgcagcatacagggccggcaggaacaatagggtcaacgccgtcgccacaatcaaaccgcccatgatcgccacggccatcggcccgaagaacacgctgcgtgacagcggaatcatcgccagcaccgccgccagggctgtcagcacaatcgggcggaagcgtcgcacagtggcttcgatgatcgcttgccacggcgccaggccggccttgatgtcctgttcgatctggtccaccaggatcaccgagttacgcatgatcatccccgacaaggcgatggtccccagcatggcgacaaagccgaacggttggcgaaacaccagcaggaacaaggtcacgccgataaggcccagcggcgctgtgagaaacaccatcgccgtgcgtgagaaactgcgcagttgcagcatcagcaacgtcagcaccaccacgataaacagtggcaccccggccttgaccgaattctggccacgcgcggaatcctcgacggtgccgcccacttcaagcaggtaaccatccggcagttcggcacgtacgccttcgagggtcggcaggatttgctgcaccaacgtggccggttgttccttgccatagatatcggcgcgcacggtcaccgtcggcagccggttgcggtgccagataatgccctcttcgaaaccatattcgagggtggcgatctgcgacagcgcaacgcttttaccgttgtcggtcggcaccgccaggctcggcaacagcgacaattcggtgcgttcatgcacggtgccgcgcagcaggatttcgatcaattcattgtcctcgcggtactggctgacgctggaaccggtgagagaactctgcaggaatttcgacaggttggcggtgcttacgccgagggcgcgggcgcggtcctggtcgatattgaggtagacgatcttgctcggttcttcccagtccaggtgcacgttgaccacgtgagtattttcgcgaaccttggccgccactttgcgcgccagggcgcggacttcttcgatgtgttcgccggtcacacggaactgcaccgggtagcccacaggcgggccgttctccaggcgcgtaacccgcgagcgcaactcggggaactgttcattcagggtttcaatcagccaggtgcgcaggctttcgcgctcttcgatggtcttcgccagcaccacaaattgcgcgaagctggcggccggcaactgctgatccagcggcaagtaaaagcgtggcgaaccggtgccgacataagccacgtagttgtcgatacccgcgtgttccttgagcaaggcttccaggcgcttgacctgctcggcggtgttgctcagggaagcgccttccgccagtttgaggtcgaccatcaactccaaccgccccgaggccgggaagaactgttgcggcacaaagcgaaacagcgcgaccgagccgataaacaacagcagcgtcagtacgatcacggttttgcgccgacgcacgcaccattcgaccaaacgtcttacacgctgatagaagggtgtgccgtagggatctggcccatctgtgccgtgtttggccgcatgaattttcgccagatccggcaggagtttttcccccagatacggcacaaacaccacggcagcgacccaggacgccagcaacgcgatggttaccacctggaagatcgagcgggtgtattcgccggtgctcgattgcgcggtggcaatcggcagaaagcccgccgcggtaatcaacgtgccggtgagcatcgggaacgcggtgctggtccaggcgaaactcgcagccttgaggcggtcgtagccctgctccattttgatcgccatcatttccacggcgatgatcgcatcgtccaccagcaggcccagggccaacaccagggcgccgagggagatcttgtgcaggccgatgcccaggtaatacatggtggcaaaggtcatcgccagcaccagcggaatcgccagtgccacgaccatgccggtgcgcacgccgagggagaagaagctcaccagcaagacgatggccagtgcctcggcaagtacctggacgaattcgccgacgctggttttcaccgccgccggttggtccgacaccttgcgcagctccatgcctgccggaaggttcttctgcagccgtgcgaattcgccttcaagcgccttgccgagcaccagaatgtcgccgccgtcgcgcatggccacggccaggccgatggcgtctgcgcccatgtagcgcatgcgcggggccggtgggtcgttgaagccccggtggatgtcggcgacgtcaccgatacggaaagtgcggtcaccgacgcggatcgggaagttacggatctcctccaccgtcttgaagttgcccgacacccgcagctgtacacgctcggtcggggtttcaaagaagccggccgtagagacggcgttctgctcctgcaaggcctgttgcacggccgccaatggcaggccgagggtggcgagcttgaggttggacagctcgatccagattttctcgtcctgcaggccaagcagctcgaccttgcccacatccggcacacgttgcagttgaatctggatgcggtcggcgtagtccttgagcaccgcgtagtcgaagccgtcacccgtcagggcgtagatattgccgaaggtggtgccgaattcatcgttgaaaaacggcccctgaatatccggcggcaaggtctggcgaatgtcgctgattttcttgcgcacctgataccacaagtcgggaatctgcgccgagtgcatcgagtcgcgtgccatgaaggtgacctgggattcaccgggacgcgagaaggagacaatgcgttcgtagtcgccggtctccatgagttttttctcgatacgctcggtgacctgccgtgagacttcctgggccgtggcccccggccagttggtcttgatcaccatggccttgaaggtaaacggcgggtcttcactttgccccagcttggtgtaggacaacgtgccaaccaccgccagcaggatcatcaggaacagtacgatctggcggttacgcaacgcccattcggaaagattgaaacccatcggggactactccttgttggccgccagattcaccacgcggttggagcgatccaccgggcgcacctgctggccctcatggagcacgtgcacaccggctgcaatcacccagtcggtgggcgccaggccttccagcaccggcacggttttttcaccgaaggcgccgatgcgcaccggggtgcgcttgagcgtgttgtccggctgcaccacccagacgtaggacgcgccgttctccgcactcagggccgacagcggcaccgacagcgcaatcacgccatcggcctgtatgaacacgcgggcgctttggcccagttcagccgggactttgccgccggtgaacgcgacgcgggcagcgaaggtgcgcgatttggggtcggcggcaggcgacagctcacgaatgcgcccggcaaaacgctggtcgggctggctccacagttcgaccgacaccggttggccgatcttgaaccggccaaagccttgctcgggcaggctgatcaacacttcacgctcgccatcggtggccagggtgaacacggtctggcctgcggacaccacttggccaacttccaccgcgcgcttggcgaccacaccgtcctgcggcgcgcgcagcacggcgtagcccgcctggttgctggacacgtcgaactcggccttgatctgcttcaggcgtgcttcgccggagcggtagaggttttcggaattgtcgtactgggaacggctgaccatctgacggtccatcagggtcttgtagcggtcacgctcggcacgcaccaggctcaggttggcctcggcggcggcgacctgggcgcgggtagcttccaattgcaggcgcacatcctgcgggtcgagttcggccagcggctggttggccttgacccgctcgccctcctccaccaggcgtttgctgactttgccgccaatgcgaaaggccaggtccggctcataccgcgcccgcacctcgcctggaaagctgtccatcgcctgcgccgaaggctgcggttgcaccaccatggccgggcggatggtggtttgggccgcttcttcatggccgcaggcggccaacaggaagaccaggctgacaggcaacgcaaggggcaggaaagtactgcgcatgctgaaggacctttcgcaaatggagctaggaataattatactggccggtatgttattaataccaaactcaccagtccagtattaaaggtgaaaatgtccgacaatcctgtgaacaccaatagccccgggcgtcccaaggacatggcaaaacgccaggcaatcctcgaagcagcgaaagtgttgttcttgagcaatggctacgcgagcaccagcatggacgccgtggcccttgaagccggcgtgtcgaaactgaccgtctacagccacttcaccgacaaagagacgctgttcaccgccgccgtcgtggcgaaatgcgaagagcaactgccggtgatgtatttcgaactgccagcaggtatgcccgtggacaccgtgctgctgaacatcgcacggggtttccatcggctgatcaacagcgaagagtcggtgaacctgcatcgcctgatgatgaccaccggcaatcaggacgtgaaactctcgcagatcttctttgaggccgggcccatgcgcatgctgcagggcatggagcgcttgctcagcaagatcgaccagagcggcgcgctgagcatcgacaaaccgtttacggcggccgaacacttcttttgcctgctcaagggcacggcgaatttctgtttgctgtatggctgcggcgggcaactgagtgaagaagccgccgaggcgcatgtgcaggaggtggtggggttgtttatgcgggcttatcggccctgacgtcttgtgctgcctgtaccggccctatcgcaggcaagccagctcccacagcagaatgcattccagcaatgagaacccggtcaactgtgggagctggcttgcctgcgatgagaccttaaggcttaagcgctttcttgggatagatgtcataccggctcgacttgccatccagcgcatggctcggcttgggcccttcaatgcacggcgccttgcgcgggcgcttgaccaccacacggtggctggccaaggccaaggccgcggcaagcaacgccggcgcgtccgggtcatcgcccaccagtggccggaacaggcgcatttccttcttcaccaaggcagttttctcacgatgaggaaacatcgggtcgaggtagatcacctgcggcggctcaccttcccaattgcgcatcacgtcgatggagttgcctttgagcagctgcatgcgcgccacaatcggtgccacttcaaaatcatccgagccacgggccaggccgtcttcgagcaaggcgccgatcagtggctggcgctcgatcaggctcatctcgcaacccaggctggccagtacaaacgcgtccttgcccagccccgccgtggcgtccagcacccgtgggcgtacgccttgggcaacgcccacggccttggctatcatctgcccactgccaccgccgtataaacgccggtgcgctgcgccgccttcaacaaagtccacacgcaccggccccggcgcgtctggcccgagctgttgcagctgcaggccatgttcaccgacttgcagggaaaaatccgcctcatccagttgcaaaggcaagccaagctgcgcagcccagtgctcggcgcgcgccttaaaaccttcggccaaggcctcgactcgaatgcggctggccgctggttgttcgctcatcaatcgctacgctcaaaaatattaaggatcggcaaacaacggccgataaaaacaacagtcaggtattttgccagagctgagcgtcgaccgagaaaaatgtcagacattcttcccctaactatcggtgtactgccgacccacaaccattacggcctgcgcaatactcaagcgctggccggggtgagtcatgtgtggcaggacttcttcgcccgggcgctggccgagcagctcggcgacacgccggacgcgctcgccgccaaggcaccggcaccgagagacccggcggtagagcccagtgaaggcgccgacctgctgtcgcagatcctcacccagcgtgagtgcgacgtaaaagacaccgagatcgccccgccggagccgctgttcctgccgatcgccgaatttgaaaccgagctgctgccaccgcccgccacgccgttcccggccgacgaaatcgtcgcccaacaacgccagcaaaacttcgaaagcggctgggtccgtccgattgtactgagcgccggccaaccgctgcctgaacctggcccagcgccggaaccccagccactgcacctgccgatcgccgagttcgaactggacctgctgccaccgcctgcaacgccctacccggccgaagaactggcggcccagcaaaaggcgctcgacttcgactaccactgggcacgcccactgatcctcaacaacctgcgcctggccgcctgagtatcagcgacagacccaccaacggcccatgtccagatggaagtggttgcgatgggcggcgttgtagtccggactcaacaccacgttgaaatcatcacacgcagcgtcgcgcacttgccgcaaaaaccgtgcactttcgccctcgcccggccagtccttgagcacgctgatgctgcgcccgtccgcgaggcgaaagccggcgatatccagggcattggccgaggcatgctgactcagccggccatctgcgcggttatacatgttgcgacaggcaaagctgcccaggtgatcgacccgcgtcaccgcctggccaaataccgcctgggccgcgggttgcaggctgtggcgctcgaacagggcaaacgccacagccaacgggcaactggcgagaaaactgctgctcaaggccacgtcggcgccctgtacgcgcaagacgttgcgcaatgggcacgcggcatccgccgggctgtcggcctgatggctgacgcgcaaacccgaggttttcagcacctgatcacacaaccccggatcatcctgcaaccggccaagtttgaaacgggtcagcaggttcgggctggcacgcacatccagcggcgcccacgggttccactcatcaggcaacggcagccaaccccgccacacgcctacagcgcacagacacgccagcaacagcagtacaccgatcactttgaaaaaccgcacggttcaacccttgaagaattggttggcctggctgaacggcatcttgcgctcggtgaaggtaaaggtgcccaactcatacacctcctgcgcggcccggtagaactcgccatacgctgccagcgccaaggcggagccgacgctgatacggcgcacgcccatcgcgctcaactgcgcgacgctgaggttcaagccaccggacatcaacacattcacaggctttggcgcgacagccttgaccacggccagtacttcttcggcgctgcgcagcgccggggcatacaacacgtcggcacccgcttcggcgtaggcctgcaggcggcggatggtgtcaggcaaatccaggcgaccatgcaggaggttttctgcgcgagccgtcagcgtgaagggaaatggcaggctgcgtgcagcggcaactgctgcttcgacgcgctcaaccgacaaatcaaaagggtagattggatcgacggcaatgcccgtggcgtcttcgatggagccaccgacgatgccggtggccgccgcacgcaggatcgtttgggcacagccttcaggcgtgtcgctgaagccgttttccaggtccgccgccaccggcagcgacgtcgcccgcgcaatggttccggcgttgcccaaggtgtcctccagcgacaatgcgccttccgcatccggccgcccgaggctgaacgcaaaccctgcgctggtggtggccaacgcctcaaaaccgaggctggcaagcatgatggccgagccggcatcccaagggttgggcatcacgaacgcgcgatcacgctcgtgcagggccttgaaggtttcggcgcgaagggtttgggcatccatgtctgactcctggcggaaaaaggagccctagagtaaccccagttgctccactgcgggttcgcgatgcaaggtcggcagcggcggcaggcccggcaagcgtgccatcagtttttcatgaaatcgcagtgccagttgggcagcgaggcggttatccgaggtgtgcaggaacacgtacggcgtacgcccttcctcgatccaaccggcgattttttccacccaggggatcagaaacgggtcgttggcttccagctccggatggccgatgaaccgcacttggggaaacagcgtcagcgcagcagggcgcggcggcaccttgggctttttcgattgggcgtgcagcacggcagccgaggtggaagtacaactgaacagagcgcgcgggtcgaggcagattcgctcgacaccccgatcacgcagcaggcggttgagcatccgctcggcatcgcccttggcgaagaacgcctggtggcgcacctctaccgccagcggccgctccaggccatcaataaacccagccagttcgccgaggcgttgtggcgaaaagctcgccgacaattgcagccacagcggcgaaacacgttcgcccagcgggctcatcaagccgacaaaactttccgccgccggcagttgctcgcgcaggtcgccagcgtggctgatgtcgccggggaatttggcggtgaagcgaaaatcctcaggcatgatttcagcccagcgctgcacagtggcggccgagggtcgggcataaaatgtggtgttgccttcaacggcgttgaagacttgggaatacaacgaaaggtaatcgccggagcgcgcatcggccgggtacaggtactcgcgccaggcgttttcactccaggacgggcagccgataaagtaaggcagacgcatcagatatggatgtcgagacccagcacttccatatcccattcgacaaagccggcggtggtcaggtagctggccagggcggtggcgacgcttttgctcatggagcgggggaagaccatgtcttgctgacgggcgggaagaccgctgatacgcgcgccacctgcagcgccttgtgcgctggcatgcgactcggactgaacctcgatgaaatccggcgaatcttcgacggaatcgtctaccgtcacgttcgccttgcgcggcttacgcttgagtgggtaggactgtgaggaaaagccgtctatacgcatacatgcagactcggtatcaatgatggcaatttagcggcactttccgtagtgcgcaaatgctctggtgataactagaacacataatttgtaaaaggtttacaaacaggggcaaattctgacgattggcggagtttgccccaaattgccatcatttttggcgtcaaataatcccgcgttccgccttggtttgcgcgaccttatcgcgcaagtaaaccggcgccgcctgatccgccgcaatcgcctcgccgcgttcgaacgcgaagcgtgccagggtcagcaagtcttcggcatgcggcaacatcgtggcgtcctggccaaccagctttacgccgatgcgctcaccataaccccaaccagtgcccgcgccgaaccagtcaccactggcatcggcaggcaataccgaggactccggcgcctgcaccgcttcgacgccaaccaggcgcatttcgccagcggtctcgcggtagcagccccaatagacttcgtccatgcgcgcatcgatggcggccgccacttgcgcagcgccgtgttcacgcagggcgcgctgggccagcacggccaggttggacaccggcaacaccgggcgctccagcgcaaacgccaggccctgcaccacgccgatggcaatacgcacgccggtgaatgcgcccgggccacggccgaaagcaatcgcatccacggcagaaagcgtggtgcccgcgtcctcaagcagttgcttgatcatcggcaacagcttctgcgcatgcaggcgtgggatcacctcgtagtggctggttactttgccatcgtgcagcaaggcaacggagcaagcttcggtcgcggtgtccagggccagcagggtgctcatcggtgtaggtgtccaagtcgaaaaaaagtgcgccagtataaacaacaacggcccgcaagcgggccgttgtgcatgcagctgatcgtttgatcagctcagcgcttgcagcaccttggcggtgatggcttctaccgaacccacgccagggatatggctgtacttcggcttgccttgggcagccgacagcttctggtagaaatccaccagcggcttggtctgcgaatggtagaccgacaggcgatggcgcacggtttcttcggtgtcgtctttacgctgcaccaggtcatcgccggtgacatcgtccttgccggccacttttggcgggttgtaaacgatgtggtaaacgcggcccgaggcttcgtgaacacgacggccagcgatacgctggacgatttcttcatcttcaaccgcgatttcaaccacagcgtccagctcgacgccggccttcaccagggcttcagcctgaggaatggtgcgtgggaaaccgtcgaacaggaaaccgttcttgcaatcttcctggctgatgcgttccttgaccaggttgatgatcaggtcatcggaaaccaggccgccgctgtccatcacgctttttgcgatcaggcccagctcggtgccggccttgacggcagcgcgcagcatgtcaccggtggagatttgtggaatgccgaatttttcagtgatgaactttgcctgagtacctttaccggccccgggagctcccagcagaatgacgcgcatcgatgtgctcctcaattttttatagagatgacgctcggattcgccgcgtggggccaatctcgtaaaaatatgggtctagccgatcaaacggccaaaggctgatcaagatacacagcgggctctatccatacaagccgccgaaagtcgcaagaacccgcgccgcgcatgcgtcacaggtcgggtgtgcctgagtgcaacccggcgccataaacgccgaccgcccttttccgggcggccgtcgtggtttatctgcaagcctttgagaacacgcagaaaaccttagccggtgttacgcaaaccggcggcgataccggccacagacaccagcagcgcctgttccagagggctgtcctgtgctgcttcctgttgacgcgagcgcgccagcaactcggcctgcagcaagtgcagcgggtcgaggtaggtattgcgcagccggatgaactcaagggtgtcggggctatgggccagcagttgcgactggccagtcaggccaagcaccacgctgcacgcctgcgacaataggtcgcgtaagtgcgcacccaatggcagcaggtcaggctgcaccagacgctcgtcatacagccgcgcaatatcggcatccgccttggccagcaccatttccagcatgtcgatgcgggtgcggaagaacggccattgctcgcgcatctgccccagcaactcgccctcgccacgctccagcgccttgctcaaggccgcttcccagccgagccaggcgggcagcatcaggcgggtctgggtccagccgaagatccacgggatggcccgcaaactttcaatcccccccgcacgccgcttggccgggcgactgcccaacggcagacggccaagttcctgctctggggtggattggcggaagtactcgacgaattgcggattttcccgcactacggcgcggtaagcgctgacaccgtctgccgccaattcgtccatcaaatgacgccaggccggttcgggcggcggcggtggcaacaatgtggcttccagcacggcagccaggtaaaggttgaggttctgctcggcgatgtccggcaagccgaacttgaagcggatcatctcgccctgctcagtggtgcggaaacgccccgccaccgagcccggtggctgcgacaggatcgccgcgtgcgccgggccgccgccacggccaacggtgccgccgcgaccgtggaacaacagcaattccacctgttgttcgcggcagatatccaccaagcgttcctgcgcccggtattgcgcccaggcggcggcggtggtgccggcgtccttggccgaatccgagtagccaatcatcacttcctgcgggccttgcaaccgcgcgcgatagcctggcaattgcagcagggtttccatgaccggcccggcgttatccaggtcggccagagtttcaaacagcggcaccacgcgcatcggccgttgcacgcccgactctttaagcagcagctgcaccgccagcacgtcggaggcggcgcccgccatcgagatgacatacgagcccagcgaggccgccggtgccgcagcgatttccttgcaggtgttcaacacctcggcggtgtctgccgagggtttgaagtaacccggcaacagtggtcgacgattggccagttctttggtcaggaagctgatccgcgcctgttcgtcccagtcctcataacggcccaggcccaggtaatcggtgatttcggtcatggccgacgagtgccggctggaatcctggcgcacgtccaggcgcaccaggaacaggccgaacgtcaccgcgcggcgcagacagtcgagcagcgggccatcggcaatcacacccatgccgcactcgtgcaacgactggtagcacagctccagcgggtcgagcaggtcgcggttgttctgcagcacctcagccggcgccggggtggtggtggtcagcgatgtgtgcgcccattggcgcgtcgcgcgcaggcgttcgcgcaattgcttgagcaaggcgcgataaggctcgacgctgtcgccgaccttggcttgcaacgccgggctggcctgctgcatcgacagttcggaggccaggtggtcgatgtcgcgtaggtacaggtccgccgccatccagcgcgccagcaacagcacttcgcgggtgaccggcgcggtgacattcgggttgccgtcacggtcgccgcccatccacgaagcaaagcgaatcggcgccgcttccaacggcaggtgcaggcccgtggcggcgtgcaaggcctggtcggccttgcgcaagtaattggggatggcgtgccacagcgagtgttcgatcaccgcgaagccccatttggcttcatcgaccggcgtcgggcgcacgcggcggatttcttcggtgtgccaggcttcggcgatcaaccgttgcaggcgttcgcggatctgctcgcgctcggccgtggtgaggtcgcggtgatcctgcagcgccagttgcgcggcaatcgcatcgtatttctggatcagggtgcggcgcgccacttcggtcgggtgggcggtgagcaccagctcgatttccaggcgcgccaactggcgggccagggattcgttgctgtggccttcgccttgcaagcgggccagcagctcaggcaatacgcgggactcgaacggcgccggttgcgactcgtcgcgccggtggatcaactggtattgctcggcaatgttggccaggttgaggaattggttgaaggcccgcgccacgggcaacagttcgttttcctgcagttggttcaagctggcgctgagttcctcgccagcggcctgctcggcggcggcaccacggcggtcggccttggcgcctttgcggatctgctcgatcttgtcgagaaagtcgtcgccgtactgctctcgaatggtgttgcccaacagctcacccagcaggtgaacatcctcacgcaagcgtgcatcgatatcactcatcaaccaatctccagccagaaatccgggacgcgcaggtgttccagagtgccgcccgcgtcggtttctgacaagacactttaaaccttgtgacttgcagctagtctcaacagtgagtcgtcgcgttatccacgcaggcgactggacactcatcaccgtctgccacagcaggctttattgaggttgccatgaaaattcgagaactggcccagcattgggaagagaacgccaagggtcgcctgaccaaaaccgagtacgcgattcatctggacgtggagtccgccgcacgcctggccgccatcgccgagatgtaccccaagcgccacaccgaagaactgctcggcgagctgatcggcgccgcgctcgaagagctggaagcgagctttccgtacatcaagggccagcacgtcatcgctaccgatgaagagggtgacccgctgtacgaagacgtcggccctaccccacgctttctgactttatcgcgccgctatctgcatgatttatcagccgcggctgacgaacagaagcactgataaacatcctttaaactccgttccccccagataatccgggcctccaagaggctcggactacctctgcgcaatgcaaaagttccaacttttaaacgctgaccgatcagtcagatatttttttaggcaattcgccatcttctctgaacttttgaaaaaagcctccggtcacagccagtaagccatcacttggaacggccgtttgaaagggcatatggtgctttaccgccgggcccgcaaccgctgaccaacgaagtggattttgatgtttttcaggagttacccaatggagttgaagacgatgaagaccagcactgccaaatcctcgtttaaccacctgcgcgggctgaaattggccgcgctggcaatcggcaccagcttcgttctggcgggctgcgccggcaaccctccgaccgagcaatacgctgtgacccaatctgcggtgaacagcgctgtcagcgccggcggcaccgagtacgcagcggtagaaatgaagtcggcgcaggacaagctcaaagcagccgaaatcgccatgcacgacaagaactacgacaaggctcgccaactggctgaacaagccgagtgggacgctcgcgtcgctgagcgtaaatcccaggccgccaaagcccaacaggctgtgaaggactcccagaaagctgttcaggagctgcgtcaggaaggcatgcgccctgctgttatccaacagcaataaggcccagaccactgactgcactgcacccgaaatcgaattgaaaggacgacacgactatgcgtaaacaattgatgatccctgccctgctggcgatgagcgttgccttggcggcctgctccaccccgccgaacgcgaacctggaaaacgcacggaccaacttctcggccctgcaaaccaacccacaagcgaccaagcttgcggcgctggaaaccaaggacgccagcgaatggctggacaaggctgacaaggcctaccgcgacaaggaagacgagaagaaggtcgaccaactggcctacctgaccaatcagcgtgttgaagtggcgaaagacaccatcgtgctgcgcgaatccgaagccaagctgaaaaacgctggcgacgaacgtgctcgcgccctgctgcaagcccgtgacgcgcagatcaagcaactgcaagacagcttgaacgccaagcagactgatcgcggtacgctggtgacctttggtgacgtgctgttcgccaccaacaagtccgacctcaagtccagcggcctggtgaacatcaccaagctggcgcagttcctgcgtgataacccggaccgtaaagtgatcgtcgaaggctacaccgacagcaccggctccgactcgtacaaccagagcctgtccgagcgtcgtgcggcttccgtacaacgtgcactggctcaacaaggcgtagatatctcgcgcatcgtgacccagggttacggcaaggaatacccggttgccgacaacggcagtgtctcgggccgtgccatgaaccgtcgcgttgaagtgaccatctccaacgacaatcagccggtcaagccacgttcttccgttgctaattgatcgattgaggtaataaaaacccaccttacggtgggtttttttatggatcagatttcgattttacggctgctgtcatcggctggcatcatggctgccatgccttggcgacccgccatcattttttcaagctgctctgcatccatctggccctcggagccgccttgagcgccaccggccgccttcgacagcatgtccatgagcatcttcatcgggtcttgtttctcttgcttctgcgcgccctctgcgccttgcgcaccgccttggtccagctttgctgcgccctgggccatttccaacatcttgctgatcgcgccaattccgccaatcatgctcacactccggagtcgtttacgtaagttaattatcagcaacactgacaagtcattcagtggcgtcttacgcaaaacggttccagttatttccttgtttaggcgtgtgcgacgaaggccggctcagtcctgcaactgcggggtttcctggcccatgcagcgcacagcttgcttcttattgttgaccagcacaccgctcaagcctttttgctcggtatcaaacatcaccagcacaccgtccacacactgcgccacctgcgcggcaggggtcagggagatcttgtagtcctcgcccggcaccgtcttgagcatggtgaaatcgctgagcagcaacgcatcctccggcttggcgaagtgcaggtagccgtagaaccacaggcagccgacagtaccgatgatggtgccgatgccggtgaggatcagcgggatcatgttgcgttcttcgctcattgcgggctctctgatgaatcaactgtagggttcgggtagttggggatttcccccaggcgacgcagaccgttgaagtgctgcgggtcgtccagatagcgcagcatcacggtttgccaggttttgtcggcaaaggtctgcacatgaccgccacgggtcaactgcaacaccctgggcggcggcgcggcctggtacaggcgaatgccattggccagcggcacgatcgggtcgtccaggctatgaaacagcagcttgggcacgccggtcagctgcggcatggcattgatcgcactgtcgccgtcgggcaccagccaggacagcggtacctgaaacggccatgttaaccaagaggtgctgagggcgaattgtcctacgtcacgataactggcgggcacgccgtcgagcaccaacgccttgagctgcggctgacgctgcgggtgcgccgccaggtagtgcaccgccagtgcgccgcccaggctttggcccagcacaaccagcggctggccctgggtttcgggcgccttgtcgatccagctgaacgccgcatcgatgtcctgataaatcgccggcagcgacggcttgccttccgacaggccataaccgcgatagtccagcagcagcacttggtagccttgctccggcaaccaccaactgccgcccaggtgccatgccaggttgccgccgttgccatgcaggtgcagcaccgtgcctttgagcggcaccccggcgttggccggcagccaccaggcgtgcagttttaccccatcggcggtggtgagcgtgacgtcgcggtactgcagatgggccttttccggcgtgaacggcagaccaggttcggggtagaacagcagcgaactgcagccgttcaaggtgaagagcaggcaaagaatgccgaggattctcatccgttgaagcctcgtgagtgggttgaaaaacggttcctgagatcaatgaagatcaaatgtgggagctggcttgcctgcgaaagcggtctgtcatttacaagtgcatcaactgatagtcagccatcgcaggcaagccagctcccacatgttttgacccggttgcttcagggaaatccctaaagaatattcgagtaatccgcctcgatccgatccaggctcagatggttgaggaagttggagaaacacatccacgccgccagcgcattcatgtcgcgaaactgctcgggcaggtatttgggcggcaccaccaggccttcgtccaccagttggcgcagggtccgcatgtcttccaacgtggtcttgccgcagaacagcaacggcacttgttccagcttgcctttgcgcacggccagctggatgtagttgtagaccatgataaagcccttgaggtaggacaaatccttggtaaatggcagaccggtcggcgttgaaccacggaaaacccgactggcattgccgtagctttcggccatttcaaagccttgctcgcggaagaattcgaacacctgcaggaagtcggcgccctcctcgaccatatgaatggcgcgggtgcggttggtcaatttgcgcaagcggctcgggtaggacgcgaaggtgatgatctccatcaaaatcgccaggccttcctgggtcacggtcgaggacggcgggcctttggacaggaacgtgcagatcggctggttctggccgttgagcgtggtgccgacgtgcaccaggccttcatgcacttccagggcgcgcacatcgcggtcgttgaacatcgcgtcggcgcggatcttgatgtaatcggcgccggccgccgcgtcggcgacgataccgtcggactcaaacacgcggatggtttcttccgcctcgccaaacactttgttcagtcgggtttgcagcaacgccacggcgtctttggcggtgagggtcttggcttcgtctttgagatcgccacggccgtcgatattgttcaggtagtcggacagcatcaggccgaggtcagccagggtcgggtcgccggcgtggaacgcatcggaggcggcgccatacagctcctgggagatcaggccgaagtcctcggtgccgcgcgcttcgagcatgcgcaccaccatgcggtattcgcggcacatgcgccgcatgatctgccccaccgggctgaactggccgaggcgacgggtgatgtcgcgctcgatgttctggaactccagcttgaccgcgctggagtcgaacgacagcggccggcccaggtagtaatcgcggtccacggcgggcatggccttgcctttggccttgagaaacccttggcgaatgttttcgtcccacttcacggcgtcgaggacgcgaatcggtgtttgcgccagcacaatgcgatcagacaaggtgcgtatcgtctgctggtaatcgtccacccggtgcttcccctttaaacgttatttgcccgcacgctggtagcgcacggcttcaacgaacacatcggcattggccgggtcatccaggtaggcaaacacctggtccatggggctgtcgaccagcacgccgtcgccttcgacggtatcgacggtgctgccgtgcagcactttttgacctatggcttgatggatctgctcaaggtcgaggttgtagaccaccaattcgtgcttttcatcaaactcaaagccagccaggaaaaaatgcccgccgagtttatccggcagcggcgccgacaaataccagcggctgccatgacgagacaccgtaaacaggtactcatcgcgcaggcccggcttggctttagggtagctcacggctttgtaacggtgctcacccacgcgggtgatctgcaggttgaggggctcaccccaggcatttttgctcgaccaatgaccgagcaaggcagccggcgcgttttcacgggccggcagcgggtccttgaaggtcaccaaacaaccgctgagcaacaggaacgacaaggcgatgatcgcgacacgccaggctttcattgcgtactccatcaagccagctcccagatgaggctagaccgaggccagcaccaaatgcatgtaacgcttgaggatctcaagcatctcttcaccggtcagaggctctgggccgccaagcaggccctgatattccatccgactgattatcgccgtcaacactttggcatcctgttgcggctcgcgagagcccaatacctggaaaaactgccccgtgccctgcagcagaatctgttgatgggaacgcaccagctccgccaggcgcgggttgagcaaggcttcctggcgaaacgcctgttcggccatcaggtgttcgcggcggttggtcagttggcgcagtacgtagtcggcggtaagccgcgcgatgtcgtcggccagctgcgagcgcgactgcgggctgccatcgccataggcgaccatctcgcgcagcaggccttcgttgcgcacccacagcttgcccatgaaggcggcactgcgttccacgtattgggcgaaggtatcggtgagcaggtcatcgatatccttgaagtagtaggtggtggccgacaacggcacgccggcctcggccgcgacggcgcgatggcgaacgccacgtacgccgtcgcgcacgacgatgcgcatggccgcatcaagaatgtcctgcctgcgctgttcgctgcctcgtcggctggccttgcggccctggtactgaacactttcagccacggcagcagcaatgccggcggcaccttcttgagccattacgcggttcacgacagatcttcctttaaggggtgacgcggagcgtcacgggctgcgtttccacgcagagcgtgggaacgatcatcccacgcagggagtggggacgatcacctggcgccgttctcttgacggctgaatacaccacataaaaaagccgccttataaaaggcggcttcgggtttcgctacggttacgcttgtggccgcatgtgcgggaacaagatcacgtcgcggatcgacggcgagttggtcagcagcatcaccaggcggtcgatgccgataccttcaccggcggttggcggcatgccgtattccagggcgcgaacgaagtcggcgtcgtaatgcatggcttcgtcgtcgccggcgtccttgtcggccacctgggccatgaagcgctcggcctggtcttctgcgtcgttcaactcggagtaggcgttggcgatttcgcggccaccgatgaacagctcgaaacggtcggtgacgttcgggttgtcatcgttgcgacgggccagcggcgacacttcgaacgggtactgggtaatgaagtgcggctgttccagcttgtgctcgaccagctcttcgaaaatcatcacctgcagtttgcccaggccttcaaagcccagcaccttggcgccggctttcttggcgatggcgcgggccttgtcgatgtcgttcaggtcgtcagcggtcaactcagggttgtacttgaggatcgaatcgaacaccgacaggcgcacgaacggctcgccgaagtggaacaccttgtcgccgtacggcacgtcggtgctgcccaggaccagctgcgccagctcgcggaacagttcttcggtgaggtccatgttgtcttcgtagtcggcgtacgcctggtagaactccaacatggtgaattcagggttgtgacgggtcgagacgccttcgttacggaagttgcggttgatctcgaacaccttctcgaagccgccaaccacgaggcgcttgaggtacagctccggcgcaatgcgcaggaacatttccatgtccagcgcgttgtggtgggtttcgaacggtttggcggcggcaccacccgggatggtttgcagcatcggggtttcgacttcgaggaagtcacgcttcatcaggaagctgcggatgtgcgcaatgacctgcgaacgcacgcggaaagtctggcgtacgtcttcgttgacgatcaggtcaacgtagcgctgacggtagcgctgttcggtgtcggtcaggccgtggtgcttgtccggcagcgggcgcagcgacttggtcagcaggcgcacgctggtcatttcaacgtacaggtcgcccttgccggaacgcgccagggtgccctcggcggcaatgatgtcgcccatgtcccaggttttcaccgaggccagggtttcttcggacagggttttacggttgacgtaaacctgaatgcgaccggtcatgtcctggatcaccatgaacgagccacggttgagcatgatgcgaccggcaaccttgaccgggattgcagcctcggccagctcttccttggtcttgtccgcgtactgtttctgcaaggcatcgcagtagttttcgcggcggaagtcgttcgggaaggcgttacccttggcgcgctcggcagccagcttttccttgcgcagggcgatcagggagttttcttcctgttgcagggcttgcgggtcgagttgttggtcgctcatgtctttaaattttccatcaggttcgttgccccagcctttggctggggatcgcgggcaagcccgctcccacagggatcgaggggtgtcagccaatcccgcattgcatgtgttacaggcccgatttcaggctggcttccaggtattcgtcgatatcaccgtcgagtaccttgtcgcagtcgctgcgttcgatgttagtgcgcagatccttgatccgcgacgcatcgagcacgtacgaacggatctggtgaccccagccgatatccgacttggtgtcttccagcgcctgggaagcggcgttgcgcttctgcatttcctgctcgtacaacttggcccgcagcattttcatggcggtgtccttgttcgcgtgctgggaacgttcgttctggcagctgaccacggtgttggtcggtacgtgggtgatacgtacggccgagtcggtggtgtttacgtgctggccaccggcaccggaggagcggtaggtgtcgatccgcaggtcggccgggttgatctcgatttccactttgtcgtcgatctcaggcgagacgaacaccgcagagaacgaggtgtggcgacggttgccggagtcgaaagggctcttgcgcaccagacggtgtacgccgatctcggtgcgcaaccagccaaaggcatattcacccttgatgtgcacggtcgcgcctttgataccggcgacttcaccggccgacagttccatgatggtggcgtcgaaaccgcgtttgtcagcccagcgcaggtacatgcgcagcaggatgttggcccagtcctgggcctcggtgccgccggaaccggcctggatgtccaggtaggcgttgttcgggtccatttcgtggctgaacatgcggcggaattcgagcttggcgaggttttcctcgagacgggccagctcggcgacgacatcgcccactgcgccttcgtcattttcttcgacggccatgtccagcaggtcgcggcaatcgcccagaccggtgttcaactcgtcgagggtgtcgacgatctgcgccagcgcagcgcgctcgcggcccagttcctgggcgtattcaggtttgttccagacagccggatcttcaagctcgcgattgacttcggtcagacgctcatgcttttgatcgtagtcaaagatacccccgaatagtttcggagcgctcggacaggtccttgatggtgttaaggatcgggttgatttccatggcgggcagcactcgttggcgaacttttgaaagccgacgagtataacgacaaaccggcgacaacggcagcccgcttggcgaaaaggcgggtatatgcatgatctacacaaggatgcagatcaaatgtgggagctggcttgcctgcgatggcggtgtatcagatacggaggtggtaactgacaggccgctatcgcaggcaagccagctcccacaggggatcagcgtcgttgcgggttactcgatacccacctgattacgcccattgtgcttggccgtgtacaagcccttgtccgccgccatgattagctgccgacagtctgtgccctgcaccggcgtcagggtcgacaggccgatactgatggtcaggctcgcgccttccgacggggcaatgtgcgggattttcagcgccgccaccgccatgcgcagcttttccgccaccaggcgtgcgccgcccggcgaagtgttcggcaacaccagggcaaactcttcaccgccgtaacgcgccggcaagtccgaaggacgactgctggcttcgcggattgccgccgcgaccttgcgcagggcttcatcgccttcgacatggccgaagctgtcgttgtaggtcttgaagaagtccacatcgatcatcaagagcgacaactgagtctggtcacgcatggcgcggcgccattccagttccaggtattcgtcgaagtggcggcgattggacagcccggtcaggccgtcggagttcatcaagcgttgcagcaccaggttggtgtcgagcagttgctgctggctgacgcgtaatgcgcgatacgccgcatcccgctgcaacagggtcatgtaggagcgcgagtgataacgaatgcgcgccaccagctcgatgttgtccggcagcttgaccaggtaatcgttggccccggccgcaaacgccgcgcttttgatcagcgggtcttccttggtggacagcacgatgatcgggatattcgccgtagcgggatggttgcggtattcgcgcaccagcgtcaggccgtcgaggcccggcatgaccaaatcctgcaggatcaccgtgggtttgatgcgaatcgcctgggcaatcgcctgatgcgggtcggcgcaaaagtggaaatcgatgttttcttcatgggccaggccacgccgcacggcttcgccgatcatggcctggtcgtcgaccagcaacaccatggcggcattttcgtcggtcttgatgtcgtcgatctgtaaatcattcatgtgcagtcacctgaattactgtcctgcaagccggcactgcgggagggtttgatcattttgcaaagacctccagcaatctgggcgcaattctgtccagtgggcgaatttcaacagcggcatcaatggccgccgccgctttgggcatgccatacaccgccgaactctgctggtcctgggcgatggtcaaatatccttgttcacgcagcaatttgagcccctgggcgccgtcgcgccccatgccggtcagcaatacgccgacggcgtcgccgttccaatggctggcgacgctttcaaaaaacacgtcaatggatggccggtaaatctcgttcaccggctctgcggtataggctagcgtgccatttttcagcaggcgaatatggtggttggtgccagccagcaaaaccacgccactttgtggcggctcgccctcgcgcgccaggcgcaccggcagtccggacgcgctgctcagccactcggccatgccggcggcgaacacctggtccacatgctgcaccagcacgatggccgcgggaaagtcccgtggcaaacccttgagcaggctttccagggcagccggcccaccggccgaggaaccaatcgccaccaggctctggcgtttgccggtgctgcgctggggcgcggtttcggtgcgtacgcggctgccgcgctggccaaccagccagccaatgttgaggattttgcgcagcaacggcgccgccgcgtccttggcgttgcccacgcccagcgccggcgtgtccaccacgtccagggcgccgtggcccatggcttcgaacacgcggctgacattggcctggcggtctacggtgacaatcacgatggggcacggcgtctcggccatgatccgccgcgtggcttccacgccgtccatcaccggcatgatcaggtccatcagaatcaggtccggcgtcacttcggcgcagtgctgcacggcttccagaccattgctggccacccacaccacttcgtgcgcgggttcaaaactcaaggcgcggcgcaaggcctcgacggccatgggcatgtcattgacgatcgcgatcctcatgcccgtgcgcctccaatcagttccaccacggcgtccagcaaggcgtcgtcatggaaactggctttagctaaataatagtcggcgccggcgtccagtccacgacgccggtcctcttcgcgatccttgtacgacaccaccatcaccggcaacgattgcaggcgactatcacgacgcaagagtgtgaccaattcaataccgtccatacgaggcatatcaatgtcagtgatgagcaggtcgaagtcttcggagcgcaacgcgttccagccgtccatgccatcgaccgcgacagccacttcataaccgcgattaagtaacaatttgcgttgcagctcacgcacggtgagcgaatcatccaccaccagcacgcgtttgcgcggcgcttcggtggcctgctggctgcgccgggcgatgcgttccaggcggccggtattgagcagcttgtcgaccgaacgcagcatgtcttcaacgtcgacgatcaacaccaccgagccgtcatccagcaacgcaccggcagaaatgtcctggaccttgcccaggcgatcatccagcggcaacaccaccaaggtgcgctcgccgataaagcgctccaccgcaatgccatagatcgcatcacgctcgcggatcaccaccactttcaaggtttcttcgttgctctgcccggccgggcgctgcagcaactggctggccgcgaccaggccgacgtggcgaccttcgtgccagaaatgctggcggccttccagttgcacaatgtcgtccggcgccaggtcgcacatgcgttcgatgtgcgccagcgggaacgcgtaggcttcttcgccgacttccaccaccaggctgcgcaccaccgacagcgtcagcggcacctccagatggaagcggctgccctgccccgccgtctgctccagcaccaccgcgccgcgcagttggcgaaccatatgttgcaccgcgtccaggccgacgccgcgcccggacacttcggtgaccttgtcgcgcaggctgaaacccggcagaaacaggaacgtcagcagttcctcttcactcaggcgcagggcggtttccagcggcgacagatgccggtcgacgatggtgccgcgcaggcgctccaggtcgacgccattgccgtcgtcgctcaactccagcacgagcaaacccgcctggtgcgacgcgcgcaggcggatcaggccttcagccggcttacccgccagcaggcgctgctcgggcatttcgatgccgtggtcgaccgcattgcgcaataaatgcgtaagcggtgcctcaagtttttccagcacgtcgcggtcgacttgcgtcttctcgccttcgatctccagacgcacttgtttgcccaggctgcggcccaggtcacgcaccatgcgcacctgcccggcgagcacatcggcaaacgggcgcatgcggcacgccagcgcagtgtcgtacagcacctgggcgcgctgcccggcctgccagccgaactcatccagctccgcggttttttccgccagcagtgcctgggcttcgcttaacaggcggcgtgtgtcggccaaggcttcctgggcttcaaggttcaaatccagggtcttgagctgcccgtccaaggtgtccaaggcgcgcgcgctctggctttgaatacgcttgaggcgctgcatgctcgccaggtacggcttgagccgctgggtttccaccagggacttactcgacaggtcgagcaggctgttcaagcgctcggcggtgacccgcaacacacgctcaccgccttcggtcatgcgtttattctggcgcggcagttcactggtgaccggcggcgcgggttcgggctccggcggcggttcttcgacgacaggcgccggaacaggcaccggcggtggcgctggcgttgacggcggcgcgaccttggccatcggctgcgacggatcaagcaggcgctccatcagtgccacatagccttcgatatccgccggaccgacatcattgcccggcgtggcgatgcgcatcagcaggtcggtgccttgcagcaaggcgtcgatatgttcaggttgcaggtacaggcggctttcctgggcgctgaccaggcaatcctccatgacgtgggccacgctgaccccggcgtccaccccgacaatccgcgccgcgcccttgagcgaatgcgcggcgcgcatgcaggcttccagctggtccgcctgggtcgggttgcgttccagggccagcaaaccggcgctcagcacttgggtctgcgcgtcggcttccaggctgaacagttccagcagcgaggcatcgcgcatctggtcgggggtcatgtgaggctccgggtcacggcggacaacaattgcgcctcatccagccagcgcaggctgcggcctttccactgcaatacgccctgggtgaaacgcgcgctggcctgggtgccggaggccgatgcggccttcaacgtgcgctcatcgatggcatggatgccgtcgacttcatccaccggcaccacgaccgggccatcctgcgcggcgatgatcaacatgcgcggcatcacgcgcccgccgctgggggcgttgctggtagcgtccagccccaacagctcgaccaacgacaggcacgccaccagggcgccgcgcacattggccacgccgagcagcgcccgcgagcgttggtgcggcagcgagtgaatcggctgcagcggcgccacttccaccaggcagcgggtggcgatgcccagccactcttcgccgagccggaacatcaacagcgagcgcgtgaccacatcgctgtcgacctccgtggccgcctgcggacgccggtcgtcctgctgcaaggcgtagcggtcgagcaaacgcgtggcggcggcggaatacaccgagcagttgcggcaatgaatatgctccgccagcaacgggcaggatttgtcgccgtggatgccgatgcggttccagcagtcgtcgatggcttgggtatcggccagggtcaggtccaggcctgcagtgtcgagcgcgtcggtgctactcatggtttggactcactgtcagctcgctcgctacgcgcggcccgcgcttgcaagcggcgcgcccccgcactgtcgccctgggactcgagcaacgcggccaggtgcatcaaggcctgcgggtgctgcggttccaggtacaaggcttttcgataatagccctgggcttccagggcactgccggccacatcgctgagcaggcccagccagtaaaacacctgggctgccggcgggtggttactcaaatactgttcgcaggcggcgcgggcctcggcacttttgccttcgttggccagcgtggcgatgcggctgagcaagtcgccggcgtcggtgtgcggcgccctgatcggcgccttgatcggcgccttgatcggtactatgtgagcactcacggtgctgaacggacgcggtttgggcgcaatcggcgccgcactgcgctgcggcgccggcgcgggcatcggcacaaacgctggctcgggcttgaccggctcgacatgccggctgaaggcaaaggattgcggcacgccaatcgagcgcatgccatggcgccccagcaggctgccttcggccgggccgataaacagcacaccttccacgtgggtcaagcccttgagcacgtcaaagacttgcttctgggtcggctggtcaaagtagatcagcaagttgcggcagaacacgaagtcgtaggtcggctcattcgccagcaggcccgggtcgagcaggttgccgacgtgcaggcgcacttgttcgcgcacccggtcggcgatgcgataaccgtccggctcctcggtgaaatggcgctcacgaaattcgatatcgctgccgcgaaacgaattcttgccatacaccccgcgcttggcgcgctctaccgacagtgggctgacgtccatgccctgcaccttgaactggtgcggcgccaggcccgcatcgagcaaggccatggcgattgagtaaggctcttcgccggtcgaacacggcaggctcagaatacgcagcgcgcgcatctgcttgatctcggccaggcgcgccttggccaggcgcgccagggtcgcaaaggattcgggataacgaaaaaaccaggtctcggggacgatcaccgcttcgatcagcgcttgctgctcatcgtcggaattcagcaggagctgccagtaagcctggggcgtctgcgcctgcgtgacctggctgcgctggcgcaccgcgcgctcgataattgcctcgcccaccgaggcgacgtccaggccaatgcgttcctttaagaaggcaaagaagcgcgggtcgttgctcatacgctcagctcggcagaaaacagcaaggtgcgcaccggttcggtgagcagctcgttgacgccaatccactgcatcaggcccaaggcatcttcacgcaccagccccaggtaaggcgcgtcgcggttgtccagcccataggcctggaattcctcaaggccgcaccgcagggtgtcggtggcttgttcgaggatgaggcccagccagcgcgcttcaacccacggctgcggctggtagttgaccaacaccagccgcgtgctggtgcgcgcctgggccggggtgccgaacgtcagcgcacacaggtcgatcaccggcaccagcgcgccacggtgggcaaagatccctgccacccaaacgggtgcatgggcgatgggtttgagcggcaggcgcggcagcacctcggcgacttccgtcgccttgagggcaaagcgctcgccgccgatgtggaacaccaggaacaacgcctttttcgctgccgggacggcgccgcgtttagccgcgaggtcgctcatcagactttgaaacgcgacacgccgctgcgcagaccgaccgcaacctggctcagttcatcgatggcaaagctggcctggcgcagggattccacggtctggctgctggcatcacccagttgcaccagtgcgtggttgatttgctcggcacccgtggcctgggcctgcatgccttcgttgaccatcaacacccgcggcgccagggcctgcacctgatggatgatctgcgacaactgctcgccgacttgctgcacttcgaacatgccacggcgcacttcttcggagaacttgtccatgcccatcacgcctgccgataccgccgactggatctcgcgcaccatttgctcgatgtcgtaggtggccacggcagtctggtcggccaggcgccgcacttcggtggcgaccacggcaaacccgcgcccgtattcaccggccttctcggcctcgatggcggcattgagcgacaacaggttggtctggtcggcgaccttgacgatggtcaccaccacttggttgatgttgcccgccttctcattgaggatcgccagcttggcgttgaccaagtcagcggcgcccatcaccgagtgcatggtttcttccatgcgcgccaggccttgctggccggaaccggcggcgaccgacgcctgatcggcggcggtggacacttcggtcatggtgcgcaccagatccttggacgttgccgcgatctcgcgcgaggtggcgccgatctcggtggtggtggcggccgtttcggtggcggtggcctgctgctgcttggaggtggcggcaatctcggtgaccgaggtggtcacctgcaccgacgaacgctgggcctgggacaccagggcggtcagctcggtcatcatgtcgttgaagccggtttcgacggcgccgaattcgtccttgcgctccaggttcaaacgcttgctcaggtcgccgtcacgcatggtgccgaggatcgccacgatgcgctgcatcggcgccatgatggcgcgcatcagcagcaggccacataggccggcggcaaggatggccagggccagcgacacgaacatgctgacttttgccgccgacaccgcgtcatcaatcgccgtagttgcacggtcggcgacgtctttgttttcggtaatgatgtcgttgagcttcatgcggcctgccgtccaggcgggcgtcaggttggtgttgaactctttgcgcgcggcgaccaggtcattgcgctgcagggcgtcgagcacggtggccaggctcttgttataggcctggtgcaggccttcgaatttgtcgaattcggcttggtcttcgcggccgttgatggttgcctggtagttggccatctgcgccaggatgcgcccttcgaaggatttgaagtcggccttgtcggcgtcggtcagccccttgtcgtcacgcagaccgagcaattccagggtttgcaggtaactgtcgacccaggcgctgcggatcatcgagctgaggtaaacccccggcaccgcatcatcacggacagccgtttcgctgacctcgattttcagcaaccgtgaataagagaccacaaccattaacagcatgatcgcgataatgaccgcaaagctcgccaaaatccgttggcgcaaggtccagttcttcacagtatttcctcgaagggccattcaaatggagggagtatagctgagccaatggcctcatttatcaatgggttttgatgtagcgtgcacagaatgcaaataaaggtgggagggggcttgcccccgatagcggtgagtcagctagcgataagccgactgatacaccgctatcgggggcaagccccctcccacacttggatgtgtgtacagctcgtgtttatgcgttaagtcgcacctgtttttccagctcggtctttaagccgggttccagtttcagctggcgcgccaattcatccagataggccttttccataaagttttcctcgtccaccagcatcacgctggcgatgtacatctcggcggccatttccggggtgcctgccgcgcgtgccacatcggccgggtccaggggtttgttgagttcggcgtgcagccagctttgcagctcgcggtcgttgtccagcttggtgaactcgccttcgatcagcgcgcgttcgcgctcgtccacatgcccgtcggccttggctgccgcgaccagcgctttaagaatgccctggctgtgctgctcgacctgggccggtggcaagcggtcgatggtttgtggctcaccctggggcgcgttggcctgttgcgcctgccaattgccgtacgccttgtaggcaatcacgcccagcgccgccaagccgccataagtcagggccttgccgccgaatttgcgcgccttcttattccccagcagcaagcccatcgcccctgctgccagggctccgccacctgcaccaccgagcaggctgccaaggccgccactgccgagcagcccgccgagggcgcccttgtcgtctgactttggctggccacccgcctttttctgcagcatgtcctggccagatttgagcaactgatcgagcaatccacgggtattcattcgcagcctccaggcacttgggtttgtaggaccaataggcccccagcgtaaaacttagtgccaaaaagcccatgtctagagtgcttcgagttgtaacgtagccggccaaccctggaaacgtcttgtttcacatgcaacgccatcacgctgcaatcaatcaattttcctacgtcaccgaaccgcttaagctatccggcgtctgtttatagtccgttgcgtttggccgaaggcatgtccgaaccgttatttctgatccgctacgtgccaggaaaggcgcgggatttgctcacgacaggttgtctctatgcaccgcaggaatttgctcaaagcgtccatggccattgcggcttacaccggtttatcggccagcggcctgctcgctgcgcaggcctgggccggtaaccgtgccgccgatggcaaggccgtggcgtttgattttgaaacgctcaaagcccaggccaagcagctcgccggcaccgcgtacaaagacaccaagcaggtgctgccgccgaccctggcgaccatgacgccgcagaatttcaatgccatcggctacgacggcaaccattcgttgtggaaggaattgaacggccagctcgacgtgcagttcttccacgtcggcatggggttcaagacgccggtgcgcatgcacagcgtcgaccccaagacccgtgaggcgcgcgaggtgcatttccgcccgtcgctgttcaactatgaaaagaccacggtcgacaccaagcagttgaccggcgacttgggtttctccggcttcaagctgttcaaggcgccggagctggatcgccatgacgtgctgtcatttctcggcgccagctacttccgcgcggtagattccaccggccagtacggcctgtccgcacgcggcctggcgattgatacctacgcgaaaaagcgcgaggaattccccgacttcacccagttctggttcgaaaccccggccaaggacgccacgcgctttgtggtctacgccctgctcgactcgccaagcgccaccggtgcctaccgctttgacattgattgccaggccagtcaggtggtgatggccatcgacgcgaatatcaacgcgcgcaccaccatcgagcaactgggcatcgcgccgatgaccagcatgttcagctgcggcacccacgagcgccgcatgtgcgacaccatccacccgcaaatccacgactcggatcgcctggcgatgtggcgcggcaacggcgagtggatctgccgcccgctgaacaacccggccaagctgcaattcaacgcgttcgccgacaccgacccgaaaggcttcggcctggtgcagaccgaccatgagttcgccagctaccaggacaccgtggactggtacagcaagcggccaagcctgtgggtcgaaccgaccaccgcctggggcgaaggctcgatcgacctgctggaaatcccgaccaccggcgaaaccctcgacaacatcgtggccttctggaccccgaaaaaacccgtggctgccggcgactcgctcaactatggctacaagctgtactggagcgctttgccgcccgtgagcacgccgttggcgcaagtcgacgccacccgttccggcatgggcggtttcaccgaaggctgggcacccggcgagcattaccccgaagtgtgggcccgtcggtttgccgtggacttcaaaggcggcggcctcgatcgcctgcccgccggcaccggcatcgaaccggtggtgacctgttcccacggtgaagtcaaagacttcagcgtgctggtgctcgacaacatcaagggctatcgcattctgttcgactggtacccgaccagcgacagcgtggagccggtggaactgcgcttgtttatccgcacccaggaccgcaccttgagtgaaacctggctgtaccagtacttcccgcctgcgccagaggcgcgtaagtacacctgataccgaggtgcaacatgtgggagcgggcaagcccgctcccacatgttgatcgttcccacgctctgcgtgggaatgccgcctgggacgctccgcgccccgccactcatgcaacgtttgaggcctgtgcgagatgacgcggagcgtcacgggatgcgttcccacgcggagcgtgggaacgatcggctcagaaccgcgacacgcttttcatcgccccaatcaaataccgcatcgccacctgatcgctttcggtcagggcgcgatactgcgccagcaattcggcttcgtccgaactcaaccggctgccacgcaaggacatcctgcgggtcagaaaactcaccaccgcacccgcaacaccattggatttggccatggactgcttctcctgatatcgatctaagactcctggtgcccatcgcctgccttccgtgaggcgcaagaccttcgcggaaccaacagcctgactctctgggccagaaatcagacttaccctaagcgtagaaacaatctgctcacgtgtgggatttttttagagtattaacttaaaaaaacacttcggtaacaaagacctacagaaatttcgtacgcagcaaccgatggcggtaaatgtcatgcggcgcgtgcgcctgtgtcacttaaggtttgtgttgcgttaaacgcgagcaacaaaaaacccaccgggtcagggtgggtttcgggggttcacacgcaggatcaatcgcgcagatcagactcatgaatcggctgatcccgatgggtcgcccgttggtactgcgccggccagattgccttgcgcccacccaggtcatcgtcggcgtgcagcggccagtacgggtcacgcagcagctcgcgggcgaggaagatgatgtccgcctggcacgtgcgcaggatgtgctcggcctgggccggctcggtaatcatgcccacggtgccggtggcgatgcctgactctttgcgcacacgctcggcaaagcgcgtctggtaaccgggaccggtagggatctcggcgttggcggcggtgccgcctgaggacacgtcgatcaggtcaacgcccaagtctttcaggcggcgggccagttccacggtttcatccgggttccagccgtcttccacccaatcggtggccgacacccgcacgaacagcggcagctcctgaggccagacttcgcgcacggcctgggtcacttcgagcaccaggcgaatgcggttttcaaacgagccaccgtagtggtcctggcgctgattgctgatgggcgagaggaattgatgcaacaggtaaccgtgggcggcgtggatttccaccacttcaaaaccggcggtcagggcgcgtttggcggcggcgacaaagtcggcgatcacctgctggatctgcccttcgtccagcggcttgggctgggtgtgattggggtcaaaggcgatgggcgatgggccaactggcacccagccgccgtcttccggcttgacgctgccgtgcttgccgatccacggccgatgggtgctggccttgcgcccggcatgcgccagctggatgcccgccaccgcgccttgggcggcgataaaacgcgtaatgcgctgcagcggttcgatctgtgcgtcgttccacaggcccaaatcctgggcggtgatgcggccatcggcggtcacggcggtggcttcagtgaaaatcagcccggcgccgccgaccgcgcggcttccgaggtgcaccaggtgccagtcattggccaggccatcgtcggatgagtactggcacatcggcgacacggcaatgcggttgagcagggtcaattgacggagggtatagggttcgagcagctgactcatggcgcacctcttctgggttctgtgggcactattcaaacagtgcttagagcctagtcgacaacggtagcttgcacagggttcagacggaaaacgggagccgattgccggctcccgtgtcgcagcagcttacatttcgacctgggtgcccagctcgatcacccggtttaccgggagcttgaagaagcgcaggttgccgttggcgttcttcaacatgaacgcaaacaaactttcgcgccaacgggccatgcccttgatgcgcgaagcgatcaccgtttcgcggctgaggaagtaggtggtgcgcatcgggctgaaatccaggtcgtccagatggcacagcttcagcgcttcgggcacgtccggctcatcggtaaaaccgaagtgcaggatcacgcggaagaagccttcgccataggcgtccacctcgaagcgccgcgacgccggaacgcgcgggatatcttcgtagaccaccgtcagcattaccacctgctcatgcaacacctggttatgcagcaggttgtgcaacagcgcgtggggcacggcgtcgggccgcgcggtcaggaacacggcggtgccctgcacgcgatggggcggctgcacgcggatactgctgataaagatcggcaatggcaggccgccttcgtcgaggcggtccatcaacaactccttgccgcgcttccaagtggtcatcagcacaaacagcacaatccccgccaacaccggaaaggcaccgccctgcacgattttcggcacgttggcggcgaagaacaggccgtccaccaacaggaagccgatcaacaccggaatcgccagcaccggcggccatttccacagcagcagcatcaccgccgacaccaggatgctggtgatcagcatggtgccggtcaccgccacgccgtaagccgaagccaaggcgttcgaggattcaaagcccagtaccaacagaatcacgccgaccatcagcgaccagttcaccgcaccaatgtagatctggccttgctcggcgctggaagtgtgctggatatgcatgcgcgggatgtaacccagttggatcgcctggcgggtcaaggagaacgcaccggaaatcaccgcctgggaggcaataaccgtggccagggtcgacagcgcgaccagcgggatcaacgcccactccggcgccagcaggtagaaggggttgcgcgccgcttcagggttttccagcagcaaggcgccctggccgaagtagttgagcaccaacgccggcagcaccagggcgaaccacgcacgggcgatcggcttgcggccaaagtggcccatgtcggcatacagcgcttcggcgccggtcaacgccagcaccacggcaccgagaattgccacgcccatgccaggatgcgccgtaaagaaacgcacgccccacaccgggttaagcgcattgagcacttcggggtgttgcagaatgccgtgcacgccgaggccgcccaacaccaggaaccacaccaccatcaccggcccgaacagcttgccaatgcggtcggtgccgtgtttctggatcaagaacagccccaccagcaccaccaacgacagcggcacgacccaacgttccaggccatcaaaggccaattccaggccctcgaccgccgacaacaccgagatcgccggggtgatcatgctgtcgccgtagaacagcgccgcaccgatcaggccaagaatcaccagcaccgaacgcaacttggggtacggcgacgcagcccgccgcgccagtgccgtcagagccatgatgccaccctcgccctggttgtcagcgcgcaggataaacagcacgtacttgatcgacacgacccacaccagcgaccagaaaatcagcgccagaatgccgaagaccccgtcatgattgacctgaaccccgtaaccaccagtaaacacttctttaagggtatagagcgggctggtaccgatatcgccgtaaaccaccccgactgccgccaccagcatgccaatcggctttgcattggaatgctcggcacctgctgcctgactatttgcctgacccatcaaccactcctgccctttgacctgaggtcttttataaacaacgcgcctaagctgaccgtagcatgcgctgttttacttctcgtaacagacgttttattgacccaagggttttacccatgtgcaacggcgcgaagcatagcgcagcactcgtcgcatttccctgctcaagtgattcagggaatgcagtcagtaacagagataaaggcaatttggagcctttttgcctgcattgatcacatttacggccaaccgtatattttcggcccggctcagcaatgccgcctccgcggtgtaagcgggaaattcctcaacggcttacccgatcaataaatcgtgcccctgcatggcgcgcgcagccgatatagaaactcaatcatcggcctgtctcttttaaggtacattccttatgtacgaagtgaaacacgtgctgtcagtcaatggcgtggatatctaccaggcttggctagacaccgtgcaggacacgcgttcaaaagcaagaatcaccaccagagtggaccgcgcgtcccttggtcactttggcgctaccgagccagtgggtggtggggtctttgagatgaaactcgatttcggacctgggtttcgcgtgtattacgcaatccatgatcggcaaattgtttttctgttgggcggtggctcaaaagccagacagcagaacgacatcgatcaggccaaggctctctggaaatcttacaaggtgcagcaaaaatgaccattcgtacgcgttctcatgaagacagcgttcttgaaatgctgcgagacgacgaagcgttcgccctcgaatatctgtctgtcgcgcttgaggaaatcgatgaagcgggtggtgaggacgccttcctcgtcgctatccgtcgcgtggcggaagcgcgtggcggaatgctcagcttgtcgcagaacacagggctgaatagggcaaatctctacaggtccatcgccgtcggcggcgacccaaagctctctaccctactgaaagtgcttcaggcgttaggtgtgggcatgtctaaagttgtagcgcaccgcgccgagcaagacgtacgggcttaagagcctggtaaggtctgtgcgaatcagccactacagcactcgtcgcatttccctgcataaagctggtcaagtgcgttgcccatcgatagaattgcgcactttttgatcagaggcgcaccaagcgcccgtctaccgccgtgtcgtgcccgactggcggcgccattcaataccgaggttagacatgtccaccaccatcgcaaaagccaaccccaaggtcggctttgtatccctgggttgcccgaaggctctggtcgactccgagcgcatcctcacgcaactgcgtatggaaggctatgacgttgtgtccacttaccaggacgctgacgtggtggtggtcaacacctgcggcttcatcgactcggccaaggcagagtcgctggaagtgatcggcgaagccatcaaggaaaacggcaaggtcatcgtgaccggctgcatgggcgtggaagaaggcaatatccgcaacgtgcacccaagcgtgctggccgtgactggcccgcagcagtacgagcaggtggtcaacgccgtgcacgaggtggtgccgccgcgtcaggaccacaacccgctgatcgacctggtgccgccgcaaggcatcaagctgaccccgcgccactacgcgtacctgaagatttccgaaggctgcaaccacagctgcagcttctgcattatcccgtcgatgcgcggcaagctggtcagccgtccggtcggtgatgtgctggacgaggcccagcgcctggtcaaatccggcgtgaaagagctgttggtgatctcccaggacaccagcgcctacggcgtcgacgtgaaataccgcaccggtttctggaacggcgcgccggtgaaaacccgcatgaccgaactctgcgaagccctcagcagcctgggcgtgtgggtgcgcctgcactacgtttacccgtacccgcacgtggacgagctgatcccgttgatggccgccggcaagatcctgccgtacctggacatcccgttccagcacgccagcccgaaaatccttaaggcgatgaaacgcccggccttcgaagacaagaccctggcgcgcatcaagaactggcgcgagatctgcccggaactgatcattcgttccaccttcatcgtcggcttccctggcgaaaccgaagaagacttacagtacctgctggactggctgaccgaagcgcagctggaccgcgtcggttgcttccagtattcgccggttgaaggcgcgccggccaacctgctggacgcggccatcgtgccggacgacgtcaagcaagaccgttgggagcgcttcatggcgcaccagcaggcgatcagctcggcgcgtctgcaactgcgcatcggcaaggaaatcgaagtattgatcgacgaagtcgacgagcaaggcgcggtaggccgctgcttcttcgatgcgccggaaatcgacggtaacgtgtttatcgacgacgccagcggtttgaagccgggcgacaaggtctggtgcaccgtgactgacgccgacgaatacgacctgtgggccgtaaagcgcgactaagtctgtaaaaacttaaaaagccccgtttctggacaagatgcggggcttttttcggtctatcgtttgcgcattggcgaagatccagtcaaggagcagcgggcatgcgtcagctttcggttatccatacacccaaactcagcgacttcgcgcacttggcgcagctctgggaagactcggtgcgggcaacccacgatttcttgccggacagctacatcgtgctgctcaaggaactggtgctgacgcgctacctggactcggtgatgctgatctgcaccaaggacgcgcgccaacgcatcaccgggtttgccggggtggccgcgggcaaagtcgagatgctgtttatcgacccgcaacaccgtggccaggggcttggccggcagctgctgcggtatgccatcgaacacatgaacgccgataccctggacgtcaacgaacagaacccgcaggccctggggttttacttcaagcagggctttgaggtgatcggccgtgcggagcatgatgggctgggccagccgtatccgttgctgcacatgcgcttgcgccagcagcaactgcgcagaggctgactcaacaccgaacaaaatgtgggagctgggcttgtgtgggagctgggccagctcccacacaagcccgactcccacacaagccagctcccacaaaaagcccctgcgctgaaatggggccgggattaaccggcgccaggcaggtacaatagccgcccccttttgctacggcccttgtcatgactgaccccatacgcctctccaaacgccttatcgaactggtcggttgctcccgtcgggaggctgagctgtttattgaaggcggctgggtctcggtggacggcgaagtgatcgacgaaccgcagttcaaggtcaccacccagaaggtcgagctggacccagaggcgaaagccactgcgccggagccggtgaccattctgctgcacgcgccggtgggtgtggatgccgaaacggcgatggcttcgatcagcgccgagaccctgtccgaagaacaccgcttcagcaaacgcccgctcaaaggccacttcctgcgcctgaccgccagtgccgacctgcaagccaaggccagcggcctgctggtgttcacccaggactggaagattctgcgcaagttaaccgccgatgccgccaagatcgagcaggaatacgtggttgaggttgaaggcgacatggttgcccacggcctcaaccgcctgaaccacggcctgacctacaaaggcaaagagctgccggccgtgaaggccagctggcagaacgaaaaccgtctgcgctttgcgatgaagaacccgcaaccgggcgtgatcgcgctgttctgcgaggccgttggcttgaaagtcatcgccatccgtcgcatccgcatcggcggcgtgtccatcggcaaagtgccggtcggccaatggcgctacctgtccggcaaagagaagttctaagccgttccccttttttatcggcaccggcacatttgcgcggtgccctcagttgaataccaggattgcccaatgattcacaacgacgtactgcgcagcgtgcgctacatgctcgacatcagcgacaacaagatggtcgagatcatcaagctcggcggcatggacgtgaccaaggaagacctgctgacttacctcaagaaagatgaggaagaaggctttgtgttctgcccggacgaagtcatggcgcacttcctcgatggcctggtgatcttcaagcgtggcaaggacgaaagccgtccgccgcagccgatcgaaacgccggtgaccaacaacatcatcctcaagaagctgcgcgtagccttcgaactgaaagaagacgacatgcacgcgatcctcaaggccgccgagtttccggtgtccaagccggagctgagcgcactgttccgcaaattcggccacaccaactaccgcccgtgcggcgaccagctgctgcgcaacttcctcaagggcctgaccctgcgggttcgtgcgtaagccatgagttacaacgtctcgcccgtcggctttgtgcgctcctgcttcaaggagaagttcgccatcccgcgccagccacaactggcaccggccgcccgtggcgtgctggaactggtggcgccgttcgatcaaggcgaggcggtgcagggcctggagcaggtcagccatgtgtggttgctgtttctgttccaccaggccctggaagacaagccgcgcctgaaagtacggccgccacgtttgggcggtaatacgtccatgggcgtgttcgccacccgcgcgacgcaccggcccaacggcatcggccagtcggtggtgaagctggacaaggtcgagccagggcggttgtggatttccgggattgatctgcttgatggcacgcccgtgctggatatcaagccgtatgtgccgtacgccgacatcattgacaccgccaccaacgacatcgccagtggtgcgccgcagctgattgcggtgcagtggctgaagacggcgctgttccaggcgcaaggccatgctgagcgccttgatgagccattggtggcgttgatcgagcagtgtttggcgcaggacccgcggccggcgtatcagacgcctgggccggagcgcgagtatggggcgcagttctgggatgtggatgtgcgttggcactatccagagcccggagttatttgcgtgctggaagtggttcctgctgcctaaagccgcaaagcaaatgtgggagcgacttatgtgggagctggcttgcctgcgatgcggacacctcggttcaactgaacgaccgaggtgtccgcatcgcaggcaagccagctcccacacaagccagctcccacatttttttgtatcgactgcttacttctcgacgaacgcacgctcgatcagataatcacccggctcacgcatgcgtggcgacactttcaggccaaagctgttcagcacttcgctggtttcgtccaacatgcttgggctgccgcacagcatggcgcggtcgtcttcggggttgatcggtggcaggccgatgtcgctgaacagcttgccgctgcgcatcaggtcggtcaggcggccttcgttttcaaacggctcacgggtcacggttgggtagtagatcaacttgtcacgcagcgcctcgccgaagaattcgttctgcggcaggtgctcggtgatgaattcgcggtaggcgacttcgttgacgtaacgcacgccgtggcacaggatcactttttcgaaacgctcgtaggtttccgggtcctggatcacgctcatgaatggagccaggccagtaccggtgctgagcaggtacaagtgtttgcccggcttcaaatcgtcaagcaccagggtgcccgtcggttttttgctgatgatgatctcgtcgccttccttcaaatgctgcaattgggaagtcagcgggccatcgggcaccttgatgctgaagaactccagatgctcttcccagttcgggctggcaatggagtatgcgcgcatgagcgggcggccatttggctgttgcaggccgatcatcacgaactgaccgttctcgaagcgcaggcccggatcgcgggtgcacttgaagctgaacagagtgtcgttccagtgatgaacactgaggacacgctcgtggttcatgttgctcatgtacgggggactcctggaaatgggtctgcgccaagattgagatgcgcaattgcacagcattctaatggcggcgacaatatctgttaactggattattaagataagggttatcggttatatcgatatgcgatttactctccgtcaactgcaagttttcgtcgccgtcgcccagcaggaaagcgtctcgcgcgctgctggccttctggccttatctcaatccgccgccagcacctcgatcaccgagctggagcgccaatccagctgccaattattcgaccgcgcgggcaaacgcctgagcctcaacgccctcggccatcagctgttgccccaggccgtggcgctgctggaccaggccaaggagatcgaagacctgctcaatggcaagtccggcttcggctcgctcgccgtcggcgccaccctgaccatcggcaattacctcgccaccctgctgatcggcagcttcatgcagcagcaccccgaaagccaggtgaagctgcatgtgcagaacactgcgcatatcgtgcatcaggtggcgcactacgaaattgacctgggtctaatcgaaggcgactgcagccacccggacatcgaagtgcaaacctgggtggaggacgagctggtggtgttttgcgcaccgcaacatcacttggctaaacgcggtgtggcgagcatggaagagttgacccatgaagcgtggatcctgcgtgaacaaggctccggcacgcgtctgacctttgaccaggccatgcggcatcaccgtagcgcgttgaatatccgcctggagctggaacataccgaggcgatcaagcgtgccgtggagtcaggactggggatcggctgtatttcccggctggcgctgcgcgatgcgttccgccgtggcagcctggtgccggtggaaaccccggacctggacctggcccggcagttctacttcatctggcataaacagaagtaccagacctcggcgatgcgcgagttcctggagctgtgccgcgccttcaccgccggggtgcagcgcagcgacgagatcgtgctgccaagcatcgcctgagcgttagatcaggatcacggcccacaccagggtgatcatggtcagtgccacgaattgcgcggcgctgcccatgtccttggcgtttttcgacagcgggtgcaggtccagcgagatgcggtcgatggcggcttccacagcggagttgagcaactcgacgatcaaggccagcagacacaccgcgatcagcaaggcgcgttcgacccggctcacgtgcaggaaaaaactcaacgggatcaggatgacgttgagcaacaccagttgacggaacgccgcctcgccagtgaaagccgcgcgcaggccatccagggaatagccccctgcgttgaagatacgtttgataccggtttgacccttgaaaggcgacatagatgtaggcaactgaaccaaaggagtggggaaactagatgacgcaaagtcaaaaaagcgtgaaccagtaacaacttaatgctgcgaaattgactcaagttgttgcaagagcagcgccgcctgggtgcgggtacgcacgcccaacttgcggaagattgccgtcacgtgggccttgatggtcgcttccgacacactcagctcgtaggcaatctgtttgttcagcaagccttcgcagaccatggtcagcacgcgaaactgctgcggcgtcaggctggcgaggccatcacgggcggccttggcttcgtcggacacattgatttcttcaaacgcttgcggcggccaggacacatcgccgtccagtacgctgcgtacggcttgctgaatcgcttccatcgagctggacttgggaatgaacccgctggcgccaaactccttggagcgtaccaccacgtcagcttcttcctgggccgagaccattaccaccgggatttgcgggtattgcccgcgcaacagcaccagcccggaaaaaccgtaggcgcccggcatgttgaggtcgagcagcaccaggtcccagtcggatttttcgctgaggcgggcttccagctcggcaatgctggccacttcaaccagtcggacgtcggggccaaggcccagggttacggcctgatgcagcgcactgcgaaacagcgggtggtcatcggctatcaggatttcgtatgtggccattgattaaatgatcctgttttttatggctgccctgatgggttcagggttcgccagtacacaaggcaacagccaggcagccatcgccacagggcacgctcaacgtcaaaaacacctgcaacgacgctgaaaattcacggttacgccccaatcggcgcccagcatgcccagcgtagcctggggggtcaagcactacacccgtgggcattttagcgggttgcgggtttacggtgccatcatgcaaacgtcgtcgggtcataccgccggtatatgcggcgagagacgcgtatgcacgctgtccgtcgggtccagcggcagcaggaacttggccgccaagtaatgggtgctgaatacgtcgaggtaagcgtccagcacttcgctggcaacttgatcatccgccagttccaggcacagcgccgcgacttcggcggtgcagaaatggtcatcgcgcttggaacggcgcagtttgtagcgcgacaactgctcgggcgccaggctcagcaccggcaagtgttccaggtaggggctcttgcggaacatctttcgcgcttcgctccacgtaccgtccagcaggatgaacagcgggcgcttgccctcctccaccttcacctcgctgacaacccgctccggcgcgacgaattcgccgggaaacacaatatagggctgccattgcgggtcggccagcaaggtcagcagttcggggtcgacctcggtgcgcgaccaggcaaatgcggtggtgtcgtcgatgacatcggcgatcagccagccggtgttactgggtttcatcggttcgacatcgtgcatcagcaggcacatggccgagcgggcctgcacctgcgggcgccaggcacacaggcagtacgcgggaatcacccggcagccggggcagcgttcggcgcgcgaaccccggttgagaaaaggccgcacggcccgcgccaggcgctgagtgcgcaaacgggagacggcgtggctcatcgggtacacgccgtagaaggggaaatcgacactgaggaaactcggggcaggctttaagtggcggcagtttaacagagccactggcacttctgagcgatacgcctggctgtagtggcaagcgctcccctataattacgcgccactgaacgcacagcgcagtggctggtctatgcaccagtaaccgaatcaggagagtttcatgctgcgttccatgctgcgccttgttgccccatccgtcgcccttgcgctggtcctgcctatgagcgcccacgcggcctcgctgctggaggctcaaatgaacaggaagctgcaaagcgtcgcggctgaaagcaacaaagacctgccccgggaaatcgatgaaaaaaccctggaagtggcctacaccgttgacggcatgcaactgatcgaccacctcagtgtgcaacctgatcgggccgaacagatgcgcgccaaccccaaagccgtgtatttccagctgggccaaagcgtgtgcctgaacaagggctaccgcgagctgatggccaagggcgccgtgatgcgctacgacatcaccgagaacaagaccaaccgccccgtggcctcggtcaagtttgtagaagcggattgcccggcacctgcagctgccaagaagaaaaagtaacccttgctcgaccgtcgcgcgctactgtccagtggcgcgcacttcccccgctgcagttgcctgccgacagctaaactccatgatgtgtggccaataaccggttgccagccaagggtttctcggctcatgatcacgtcatcccggtaacccttcccgtgcgtgttccacgccgttctgtaacattttcagggcaaaagagggttgcccttctgcgacttgcagtgcaaaggtttctaaatcacaaggaacatacagaacccgctttgccgcttggcgaacaccgtgcacagcctctggcatgcagcgacacacgcagtgtcgcggcccggacgaatctctcgccgatggcccaggttctgtgaagaaggagaagttgaatgccttacgaatcgaatgacgctctgctccggcattttgaagaacacgggaccgacctcacacagcaggtcgacgcgcaactccagctgatcgctcccaacagcccgaacattcccctctatcgcgacatgatcctcaccgttctgcgcatggcccaggacgaccgcaaccgctggaacgccaaaatcaccttgcaggccatccgcgaactggacaatacctttcgcgtgctcgaacagttcaaaggccgccgcaaggtgaccgtgttcggctcggcgcgcacaccggtggaaagcccgttgtacgccttggcccgagaagtcggcgcattgctggcgcaatcggacttaatggtcatcaccggcggcggtggcggcatcatggctgccgcccatgagggtgcaggcctggaacacagcctggggttcaacattaccctgccgtttgaacaacacgccaacccgaccatcgacggcaccgagaacctgctgtccttccactttttctttacccgcaagctgttcttcgtcaaggaagctgatgcgctggtgctgtgccctggcggtttcggcaccctggatgaagcgctggaagtactcacactgatccagaccggcaaaagcccattggtgccggtggtactgctggacgcgccaggcggcggtttctggcagggcgccctggactttatccgcagccagctggaagccaaccgctatatcctgcccaccgacctcaagttggtccgtctggtgcacagcgctgaagaagccgtggatgaaatcaaccagttctatgccaacttccattccacacgctggttgaagcgtgagtttgtggtgcgcatgaatcacccgctgagtgagcgtgccctcgcccatttgcagagcgaatttgccagcctgcgactgagtggggagttccagcagttggcctataccggcgaggaacatgatgaaccgaagttcagccatttgacgcggctggtgttcaacttcaatggccgcgatcagggccggctgcgggagttggtggactacatcaatttgccggaaaactgggcacacgctcagggcaaggcgcagcagcgagcgacgcctgagacggcgtgatttttttaggcaaaaaaaaaggcccactattttcatagtgggcctttttgttttaccaagctctatcagctgtagattcactgtgggagctggcttgcctgcgatggcatcaccgcggttcaactgaagaaccgatgtgtatgcatcgcaggcaagccagctcccacacaagccagctcgattttaaattccagcagttcgaaagctcagtcatccatgtcccggccgcttaataggcggctgatcatgtccatcgaaaacccccgataactcaggaagcggccttgtttcgcacgctccttggcatcaatcggcagatggccggcaaacttgcggcgccaggtgtcttccaactgcgactgccagctgatgccgcactcacgcagggcgaggtcgatatcggcgcgttgcaggccacgttggcttagttcttcgcgaattcgcgcggggccatagccggagcgcgctcgataggaaacaaagctttcgaggtaacgggcttccgaaagcagcccctcttccgtcaaacggtcgagggcagtttcgatcatctcgggctctgcgccgcgctgacgcagtttacgcgtcagctcgactcgaccatgctcgcgtcgagcgagcaggtccattgcagtgcgccgaacggcgacgagtgtatccagtacaactgtcatcgtttaattcagatgtcagtgtcggcttcttctacttcttcaaccggctcgcggttggcagcagctttcacgtccggcgcggcggtcagcagcttgtcgcgaatctgcttctcaagcgtggcagcgatatccggattgtccgccaggaacttggccgagttggccttaccctgaccgatcttgctgccgttgtaggcataccaggcaccggacttctcgacgaaaccgtgcagcacgcccaggtcaatcatctcgccgttcaggtagatacctttgccgtagagaatctggaactcggcctgacggaatggcggagccactttgttcttcacgactttaacgcgggtttcgctaccaacaacctcgtcaccttccttcaccgcgccggtacggcggatgtccagacggaccgaagcgtagaacttcagcgcgttaccaccggtggtggtttccgggctgccgaacatcacgccgatcttcatacggatctggttaatgaagatcaccaggcagttggcgttcttgatgttaccggtgattttacgcagcgcctgggacatcaggcgggcttgcaggcccacgtgcatgtcgcccatttcgccttcgatttccgcttttggcaccagggccgccacggagtcgaccacgatcacgtcgatggcgttggagcgcaccagcatgtcggtgatttccagggcttgctcgccagtgtccggctgggaaaccagcaggtcatcaacgttgacgcccagtttgccggcgtattcagggtcaagggcgtgctcggcgtcgacgaacgcacaggtggcgcccatcttttgagcctgggcaatcaccgacagggtcagggtggttttaccggaagattcaggaccgtagatttcaacgatacggccttttggcaggccgccaatgccgagcgcgatgtccagacccagagagccagtggaaatagccgggatcgcctgacggtcgtgatcgcccatacgcattacggcacccttgccgaattgacgttcgatctgacccagggccgcagccaaggctttcttcttgttgtcgtccattaaagtcctcacgtaatcaataaggcctgacggccaacacctgtataagtagacagtattgttccacaaagattgaagatcgcctacccctgattgtctatttctgctgcagctcgtcgcaacaagccctccaaggcggcttttaccgtttgtcggcggacctcgtcgcggttaccggggaagtgcgccagctcggcggttacctcctcgcccacaccaaacgccagccagacggtgccgaccggtttgtccggcgaaccgccatccggccctgcgacgccgctgactgccacggcaaaacgcgacaggcttttttcctgcgcgcctcgcaccatcgcctccaccacttcctggctgacggcgccgactttggcgaacagcgcctctggcacccccagttgccgggtcttctgccgattggaataagtgacatagcccgcttcaaaccaggccgaactgcccggaatccgcgtgatcgcttcggcgataccgccgccggtgcaggactctgcggtggtgacgtgggcattgagcacctgcaagcggcgccccaattcagcggccagttgagtgatttccttcacggtcgtctccagaagtaggcggggatttgcctaccctacaggagcaattcgcacacgcaagcgacagactggatcaagatgctaacgcccgacggcgtgcacgtacgcctggcaggcgagctaagaaacgcctaacaccaccttggcccgtgtccacatctgcagacggtcctccagcccgttcaacccgccattgatgcgccgggtgatggtggtgaactggtccttgtcggcgagctcattcaaaccgttgctctgccagaaccacgccgcagattcacatgcccattgcggctgctccagcagctcgggctggcgcaacagccgatcgtcgccaaacagcgcctggctgcaggccagataattgcgccgcccggtaatctggatcagcccccggccccgatactgctggccgtcgccgtccgcctcgggggtgttgcccaggcgtgcggccaaggtgccggtgtcgtatttgctgaggtattgatcgctgcccaactcgcgcacgtagcgcagttcgccggactcgtgaccgacctgggcgaggaaggcggcaacgcgtttggccgtgttaatcgcgtaacgcgcaaacgctgcattcaagggggctaaaaaaacgcccgcgctaaggcgggctcccggcgtcacacccagcagttgagggagtgttatcagcattggctttactctgaaaaattatctatttcgacaacccgctcgccgtgatcgaactgcggtatcccgtggctggatcgccaacatgcaccacttgttttatcgaccagcgcccctgcatataagacggccagctctcatccagcactaacagaccttcggcggccaacaatggattgcctgggcaatcgatcagcaattgcagatcttcacgccccacacggcgtagctcaccttctgccaccgcgcgggcctcggcttcgttctggtagcgttggcgcaaggttttgaacggcgcattgccgacctgaaccacgcgctgcttgccggcgccggcatcccaccagctggcgcgacaaccttcgtattttgcgcgggacttttcgtcgagtttggcggtgatgaagctctgctcaccggggcggttgtcctcggtgacggacagcttcacgtccggcagaagctgtccggagagcgaattgacccggccggcttcggccaacacatacagttcgttaatcggtttggtgactgcacggtagagcctggccagccgcgaaataaacgccatgtcgctttcgttggactggtcgatatgcgcaatggcaatgccctccagggccggcgccacacgcggtgaatagccgtgacggctgaccagttggcgaaacagtgcgccgagggtggtcggcccgtaactggctgaccggcgctggcgatagccgctggcgtccgcaacgctgaagggcgcggcagtggccacgaccatcaagcgcatgggaaacagcaccggcgtacgttggctgacgacaaactcgcccttttccaccaagccggattccacataaccgacacgcaggccgatcttgccgttcaggctgggcaaaccctcgagcccttcgatattcagcgtcagctccagccggtcagcctcaatgcccgcagcgtcggtgtggctccagtgcatcaggcgttgattgagcagcgccgcgttggcgccataaaactccacgatcggggtaaatccctgtgccatgcagcctccttaatcccacgccagaatgggtcgcacggccgcgggccgcgcttgcatttcgggcacgatcacccacacacccgccggcagcaccgggccatattcggcaagcaaagggttgtggcgccacagggtttcttccgccgcgtcatcacaacgccccagctcgcgatagagcagcaggttgaccgaatcaccggcaatacttcgcactctacgcattgacgaattcctccagttcaagggtccaggccatgaccatggcagtgccgtcatcgatcacattgctctgggtttcgacgaccgaattgatccgccacaagccccagttgcggccgatgccatcaaccaggggcagcggcgtccgcgcattttgcagtgcacgcaattcgtccaggcgttgcatgccaacggcgtacatcgccgtaccgctgaacgtgagtttttccagcttctgaccgctctggcgcgactgaggcttgctggcaataatcgccaaatcactccagccgccgtcgttggtacgcaccagcgacgcataggcaaagcctcgggacaggccaaagataaagtcgccgaggaccatttgctgtcgcatcaatcacctcctgaaggatcagccagtgccacattgcgccggataccgagggcgtcagtgaccatcggcatacactggaattgcagggcctggatcacttggttgacgacctgctgggcatcggcggggttgacaccggtgatctggatgctcggggcgagggtgacctgcacgctgtccgcgcgcgcactattaagttctttgctcaccgcagtcggcgcaggcaagcgatcacttgggccgaacactttatcgcccagccaactgcccgcctcactgccgagcaaaccgccgattgcgccaccgacagctgtgccgacgccggggaaaatcagcgtgccgagcgcggcgccagcagaggctccagcccaggcgccaccggctgtggtgaggccggcaccgacggctttggcgtcgccgttgcgtatgccctgggccacatccatggcggtgtcgacatacttcaaagggcccaggcggcgggtggcggacgattcaagtttgctcatcgtgcccaataagccggtggtgggcagtgtcaacgagctgggtgacgaagaaggcctgggaacaaatcttcggtccaatgcctggatcaagcttggcgcgttgtttggagtacttggcgaccggccgttcagactcgctgcaggcggcggtaaaccttgacggcccccaatcgacgagccactcaatggcttgatggcccaatcgaacagaccacgggccacgccggcgaagcgaccggtttttttagctggcttttttgatgtgctctgggaacttgcagactttggcgcagtggaagtctttttcccgcccccgcctcccgggccaaaacggtcgcgccctcgtggaatctcgaccccggccgggcagcagcaactcttgccattgccaccgcccttgtctttatcgaagccgccttctcggaacaacttgccgatgacgggtattttgccaagcgtcacatcgaccgcgttggcagcaactcgggttttgatggtttctcccaacccggaaacaaagccggaaaccatcggcgcgatcacggcctcagccgttttgatcgcttcggcggccagcggtgagtcgttggccaaatcgttggtaccgtccatcaccgcggttttggttttcagccaggtttcttccaggaagatcggcgtaggctcgaacgttttggacaggcgcttctcactttcagtggatacctcccgaagcaccgttatcgacttctgcgaagtcgcctttgtgtcgaacgaaaggttggcattcgagtttcgaagggctgttaccggatcgagaggttgcacgccccccaccgtcatggcttcccgagtaatgcgtcgatcttcagactgagtcgatttgaactcagccaccttcgtcgtctcgctgtgcgcctgcgttttcaatggctgcgcatcagccgctttcagcagcgataaggaggcgccaagtgaatccacactttcgcgcaatccgtccagcgactgggtgagttcacccaacttcaaatctgtattggcgaacgccaacaccatcccggacagcggcgccagcaccgctgtaccctcgggactttcaggtcccagagcacctggactaacatcatcggcatcatttgcgccgtctgcgcctgcgaagatgtcacggccatccttgaccatggcattcgccagcgaatacttgttttgcatcccgcttactcctgtttgacgccaaggcgagagatcgcaatgtcgtagcggcgcaatgcttttccggcgtcccagtcgaggatttccgcctcattgaccgagtaaatcagcggcactacatcgaggattacttcgatgtcgcgctccgaaagaagtccgccggttgatttaaaaaatcgtcgatgcgctcctgcagttgcgtccagtcgggcacggtcaggccggccaggtcggggagcatcaagccgctgcagtgcgcggtgatgaactcggcgcgttctttgttggtggcgagttttttcatcaccttggtggcgcgcagggcgggcatttccaggggcagttcggtcagggtgcgaccggctgcgtcgaggggcaaaaggagttggaccggttggtcgtgggacgcttcttcgtgcacatccaggaagaacgacgcagggcgcgtcgacatttcgtgtacgtactgagcgatgcttacgtagtccgggcgcttgagctggtcgagctctttttccgacaggccggtggcgagtttcgccagttcaaaaaactggtcgtcctcgtcatcaccggcccgggccagcgcggctttttgcgcggcgtagaacagcggtttgagttgaatctgctggatcgtcgcgccagtgtcggcggtgatcggggacagcagaatatgcagcggtggcatccaggccatggggcaattccttgttgaacgttgttgaaaagcagctcagatccaaagctgagcgcggtcaatgtgggagctggcttgcctgcgatggcatcacctcggtacaccaggcacaccgaatcgcctgcatcgcgggcaagccaggctcccacattggctgtgcccgcttcagaccacggtcgcccttacggcatcagcaccgcgcggcgcgcatcaccgagaatgtcgacaccgttgagcacgaacttctgggtacgcacatcgatgtcgatcaccggaatgccgttttccagacggttgtaggtgcggcaggacagctccaacgtggtggtggccttctcgcccatcttcaacttggcctcggccagggatttcaacttgccgccgacggtgtgataagtgaaataggtcttgccgtcctggtcctggccagcttcacgtacgttcagcaggatgtcatcacccaggcgcacgccgagggccagcatgatttccgggccggcgccttgcagcaccagcgtggcgttgagcactttgccgctcttggccatttcctcggcgataaaacgcccgccggacatggcttccatgtcgaactcaatcttcggcgggtcgaactcttccacggtcgcggacaacggcaggccttgaagggtggccgcaatggcctgtcttacacggttggtaaacattagagaacgtcctccaggaactgctcgatgatttcatcgcgagcgttgagttgataaatcatgtgttcgttcggcgcgtagcggccgtagtcgatgacgatgaaccaggtgccgttcttgtacttctcgacactgttgagttccgggtgcaggtacacgctgccgccaggaatggtttcgtcggcgaccagggtttgcagccaatcgttgatgcgcttgacctcctggtccatgaaggacttggtgaggttcttggccatggctttctggccggccttgaccagcttgcggctgatggcatcttccaggcccacatagctgatgaacttgccggtgatggagcggttacccagcagcgaaaagccgccgaggatggtgcgtgcgtagtagctcacgccgtagcggttgagcaggtcgccttcggtggaggtgtcgaggatgttgtactcgaccacgcgggaaacgtcctcggcgaacgtcacctgattgcctgggctttcccactgcttgaccttggccagcgcggcgatggccagcgaggatggcgacaggaacacgtttttcttcgccgccttggagtacaccgacggcatgttgtgcaccaccaggcaacggtcgaaaccgaggtcggcaccgcccagctcgccgctgtaggtcacttggtcggcgacggacacgtccttgccatccagcaccacacgcgccttgatgcgcttgccgaaagaggcgaactcaccggccacggccttggtgccggtgaagccgggagcgccgatgatggtcaggtcttcgggaacgctgctcaaggcagcgaggccgagcttgcggccggtggtcggctcgttgccgccgatcacattgttgatcgtgtcggccggggttgcgccctcctccacgatcaccacgtagaccggcaccttcaccactttgaggatctggtacaccgcctgaaacagcgtgcccgcctcggcgccggtggggtccagcagcgcctgggtggtgaagctgttgatacgaaacggcgcgtttttcggaatcgacgcatgggcattcggcgcagtgccgactaggccgatgacgttgtcgccaaggccacccatggcctcgggggattcggtggcattcacggtaatgccgttgtgctcgaagttaagaacctcagccatggttagtcagccttcttgggggtggagttgaggacgctggtcagctccaggcggccagcggtgcgtagcgcggatgcttcgacgtcgagcagttccagctcctcgccggcggtggaccaatggccacctccggtggggaatgggatgaggacggtgtaggtttggcggttgtgcatgggtggaactctccgaatggaaaacgccaaagcccctgcggggaggggctttgagaggcgaaaaaaaaccgctttcgcggtgggttatttcaggaaggctggcagcgcgggccatatcagcttcgaggggtcacttgcctgctcaggaatatcgcgcaatgccttgcgataggccgcgacttcagcacgctgtgcgtcggtggccggatagtccggcaactgggtaaaatcggtggcgcgtagagattgatcacgacgggcacgagtagcggcccactccacttccggcatcggaaacgcaagtggcgcggtttgggtctggtcaatagctgtatcggacatattagtcacctcagttaaatacaacgttttcagtccgcgacaacttagacttcagttcgcccacattaaaaagccgaccattacccactctcatcgtgtcgacccgcacagtcgtataatagatatttggaaccagaattcgcattacgacgttcccattggcatccgcgtaaactgcaggcgtcatattaccaaacgtcgaaacattcataatggacctattgggcttatagcaataccccaccaccgtctcatcaataattttagcggttccgtagctgtacccctgaatattgaaccagaacatttcagaactaacgttaatattcaatggcaacttgaaatgcacgtataccttttcaagaccgcccaaatcagtcgattcgaaatctccgtccgacaaaacactcataggcgcacccagcccatctatcccaccggtagtatagacatgcccctgaaaaatattacgccgtacagagccaatcgcattagcgctcccctcaacatccttgagatttcgccattcgttaaactgcgccaacgcgccagccatcgtcgagtttatactgccgatttttccattgaccgaagtggtcaagttattcgccgctgtcaccagcgacgcaatagtcgtttctagactcatattcaaactcctgaactagttatgtttaacggcgcgattccaacgacatcacacgaaacagcaattcagtatgacgtgccatgttgtcgatattcgccgtcgccagtaccgcgatatcctcccccaacaaaatattgaggttgtcactccccaccacaatcgtcacgctgttcgctggcagcggcgaaatatccaacgtgaacttttgcagtacccgcgccgctgccgctttatacgtcagcaacttccccgccacggaatacaccgccagcaaggtcccactggcgaggtaaaaaccgaattcgccaatttcatactcagcctcgccatcaaacagcgcagccatcctgagttgtcggtcgccaaggtcctcgtaatccacgatggcgacccgctggcgctcatcgcgcaaggccacttctgtgccatcggggttgtagcggccggtgccagcgccgacgtgggtgatttcgcctttcaagccttggttctttgcctgcagcacttcatccaaacccttggaggtgaagcgcaccaggcgcgtaatgtcatctgtcatggctgcgccctgaggtcgtagtcgttaatagtgaagtaccgggcaaaaccggcactgttaagccgggcggctagcccgaattcaggcaatacgcctcccagctgcaactcgccatccgtcagtggtgtgtgggctgcgctgctaatggacgtgatgctgtgtagcttcacctcgggcaaggcacccggctggctgtcatcccgaatgctcagccccggatcagccgccgcggcgagccggaacccctgagaggtttcatgcacgattgtgatcgtcgcttggtcacgctcactttgtgcggcattgactcggcggatcagtcgattgtgatcaccgctggaccaactgcgcccgatgattgcctgcacgtcgaacgtgtagggcaaacccaacggccgctgttgataccaggcgctgatgtttggggtgaaacccagtgactccacggcataattcagggccttgggcgtacccgcctggcgctggatctgccaggacaaggccaccgtcaggcgcttttcttcctcgatggcgtccgcatcccattcgctgacgccacgatcggcggccaaataaggaagaaaaccggcaggcgtttgcaatggattcatcaatgccggaaacggcggcgtcacgcggtcgagcaacttgccaaacccctggtccaacgccttttccaacggcgaactattggccggcaacaaactcgctttaggctcactcatagcgtatgcacctccacttcaacccccgtgcaatacggcgcctggaacgcggtgcagatgatcggcgccagaggttcaaggatttgcagttgcgcagcccccgcactgtgaatcgcatagtcaatccaactcgggtcaacccgcccttccaggcgatgacaggactgtgcgtagtcctgcagcagtttctgcgcggcgacttgcgtgagcccggaatccgggccggcgttgatcttcgcgaccacgcggattttgtaaggcaaaatttgcgcgccttgtacgctgaccaggtcagtctccggttgtacatccggccgtgcgaaatggcgacgtacaccgtcaagcaaattggcggacggtgtgccgtcgccttcccttgaaagcacagtgaccatcacttcgccgggcgcggttcgacgcccgttgccgtccttgacctgcgccgcataaccgtccgggtcaaaggtgtagctgacggttaccacgccgggcgtcgcgctttgcaccttcaccgacggccgctcgcccagagtgaaaacctcacgccgatactgcattcgcgaacccgctgccggggcatgtggcgccaggtaataacgcaggcgtgcgtcgtcgtcgctttccaacgtcggcggtacgggtggaaacgcagccgggtcgccagggtcaagcacttggcgctccaggcccatgtcggccaggcgggcatccaggttgctgccggtggcccaccacgccagcatctgcttgatgcgggcgttgtatttgcgttcgtgggtctgcagccgcacgcaaaaggcttccagggccaaggtcagcaactcgctttcgttgttgaggctgtccttgagtttggccgcgctttgcggcgcgcgggtggcgacgtaatcgaccacgaacgccttgaattccgccagcaacggctcgaactcatccaccgtaatgatggccggttcggccagttggttctgcccggggatcagcatgctcatgtcacgacctcgaaggtttgttggcggtttttccaggtgccggcaaaacgcagcaacagaccggcgccctggcgggtggcgacgatgacctggggttgaaagtcggcgatgccgttctgggtgttgtagaacgcttgcgcggcgtagctttgggcgaggatcagcaggtcgtcgccgaggttctggccgagcaattgcgggatcagtgagccgtacagcggccgtttctggcgagtgcctacgggtgtggtcagcgctcgggtggcgcgctgcacgaattgcagccagtcatcgacggctgccccggtgttcctgtcgattccgatcatgggatgtccttatcaggggctgatgacgcgtccctggtggtccaccaccgggccgctgaagtgcgcgccgccggcgtccagcaacaggcgggtgccgccgatttgcagggtgatgctctgggcattgatcgtcaggctggcggcgccgaccctgacgtcgacctgttcgcgggagccgctgaaggtggtggggccgttgacccagttgaaggtgtggctggcgtcgtcgtagtcgctttgggtgccgtcctggtggcggcgtcgggtcagcgaggcaacgctggaaaccggcggaaacagactactgtttagaccgaacaaggccacagactgcgcgccaccttcaccgccgccgtagttgagcaacaggcattgctcgcccaccgatgggatacgggtttcagtctgcgctcccgcgctggggttgaaaaaacggatcgatggcgagagcaggtcaccgtgactgactttgcaggtattgctggcggcatcgactgcctggcaggtgccaatccgacagaaactttcagcgcgtcgatacaggtcttcgagctgggtttccatctccgccaagcgctcgatgatcggccccagttgcatgcgtaacagcgcgtcgaacatgggctactccgccagtggtttgtattgatcggggtcgttgatgttcgagacttcccaagtgcgggcaaacagcggttggcccgtgggatcgttgagcagcaccggtccgaaatagagggtttgcgtgaaggaaactgtccaggtgtcgtagtccgtttctgcggtggcacgcagtgagggagccgcaacgatagaggtcggcaaatcacactgagcccgtggcaggttccagcggttatccagcaccaaatccatgagttggctggccaggtcgcaggcatcaaacggcaatgcacccggcgcgaccatggccttgagggaaatcgacaaggcgtgagctttacggccctcacgggagcgaatgcccgggccgttgccctcgaccgtgatcagcacgccggttttatccccggcgccttgaaagtcctgatgattaccgaccttcaagtccgggaaggcggcgtgcagtgcgtcgctaatggcttggggcagttgggagggtttttcgataaggtccattttgatcagcgtccttgcaacggttattgcgggtcctggccggcgccctggttaacgccgatacgcttggcggcccagcgttcatagaggccgatggccacgtcggcgccggccatggcggtcaggcaaccaatggcgccggccgtccagagcgacataccggcggcgtagcacagcatcagggcagaaaccccacacaccatgcacgccccggaccgcagggccaggcgccgaatcagcgaccaaccacgggcgccctccttgtcggcgcgccacatttcgccggatacaccgccgatcagcgccagtacgatcaccagccagataggcatttccgctaacgcttgctgctcgtttgtcatgtcacgcctcctggctgagcattaccggcaacgggccggtgtctgggtaaatccatttataggtaggcattccaaaaagcccggtggcccgggcttttcagtaatgcggtccagattcgaacgttcggcgctactggcgcggtacggttctttcctaagatgtttttccgaccacgatccctgtctgccggataactgcttctggtgctttacgctgcacacccgggtcagttgccaaccctctgaaccgttaaggccggttcatcgctgcctgttttcttgaagcggtacaactaaagagcgtcggcatccttgccggtgttgcctggcttccctgccatcgcttcgatggcgtccttgccgatgttgcgtgccttccttgtcttccttggcagcatccttgccgcctccaccaggccttgttggctggcttgagatgaagaatatgcatgtatgcatatacagtcaatgcacaaatgcatttatttttcgtaccgaaatgcacgagtgcattttcggccttgtgggctaagggtttggcggttttctacaggcgaaaaaaagcccgcgcactggcgggctttgtcttacggaaggaggttaacgggcgtacataccccaccagaacacatgaccgaggatgctgatctgctcatcctggatatcctggaagctgtagtcctcatccgggtgctcatcgcgattgaaactgcgcaggcgaatcccggaaggcaggcgatagagctgtttcacccgcagctggccattgtggttgatggcatacaagtcgccatcgacgatatcgccaatgccactcttgcccgcattcaccccgaccgtggcgccgtcgcgcagcaccggcaacatactgttgccgcgcaccgtcacacacttggcctggtcgaactgcacaccgttatgccgcaggctgcgcttgccgaaacgcaagctggccttctcgctttcctcgatgacgaatcttcctgatccagcagccaattcaacctcgcgcagaaaggggatcgacacctcgtcatcattaacgggcgtgtcgtcatcccacaggcttatgtccttgagttccgaatgcatcgggtcacgcccgtcatcccgcaaagcccccaccgccgcgcgcccgcgcaagtggtcggtgctgacacggaagtactcggcaatgcgcgagatgtgcttgtccgacggatcaacgatcttgccgctgaggatccgcgagagtgtggattgaggcacgccagtacgccggtgaagctccgtgggggagatacggtcgcggtctaggagttctcttaagacggttgaaacgttgcgtttttgcataagggggatgatgacgggggattttggggttggcaaatgctaatttgcataaattatgcgaattcgggaagcgttagccaacacgtcactgagcaatggggggcctgggcactcgccaatttcaatgtctgacagggtgctttcggccaaaaacggtcactaacatctgagttaagccaagccgtgaagcggtttcggtttgaatgaattattagtacccatcgaccatcatgcacagttgggaggctctagtagtaggggagtcggctccgatgaacacgaggtcatctgagatctgcccatttgggtgcaacagaccgataacaaactcgcggccggtcttctgagagagcttaatgaaaaaagacactagctcggcgggacggccttactgagagtggaagtggataaactgaggccgaggttccatcctagcaagtcatcggggcctatatcgggaacgcgtggatatttgtcattaatgaccattgaaccttagacctagcttggcgaaaacgctgagaaggcctgcatcaacggcacttggaaccggtcaaggtcggatctgtcgacgtaaacgtagaaatcgagcattggtgctgcgcctgaattaggccgcgctgcgaagcagcgtcggcttgaatgaattgttagggcgcagccatgcccgctgggatccaaagatcatcgccctcaagatcataggtgcgctgctcgcagcccccatctttgcagcggacataggaaagcatacgggtcacaccatcgttgcgcgccaccagccagtagtaaacgtaaccatcacctgaaaactcggtatccggccaaacttcgatactgggatgagatgcgctgaggcgagagaacacttccgtggatttgatcatggatatgtcggacatactttttcctgtggcctaacacacgcattataggcgcgagcttccgagcgccctcattgacgcaattgttaattgtgttgcggcccaaatgggccgaatttaataatatcaccaatggccgatccaatggagggggctgtaacgcccctccttaaatcaacagtcataacaatgccctctcctgacgtattttcatctagttgggcgattagaattagcagattctcgtggaagtctctaattgaatttggtttctcaggcacttcaacgctactatgttcaatagttaaccagttgacgcgaggaatcttgagcccttgggttctctcgagctggaccatttgcattgctcgcctgcaatgatatagaaagtgatgttctttcaaattaacaagcaattcaattaaatctatgggcagcgacgtagcaaacttatttaaaaaaccgtctatcctgtcggcaaacttactattctcctgatcaataaattcaccccaggttattacaccttctccatatctagtgtcgtttgagaaaaaatcttgccgagagatttgatcatagtattcttgagcaaataattctccgggaactagtttgacaaagccccctgttactctggtcgtcgtcaccttataggtttcagaaagaacttccatatagctgacaatcgctggcctcaaaattgttagtaattttttcagagcatttctttcagcctcttcctcaaacgccttttgagcagaatcttttcgttcgctcagcttgtgagagatggaattcaaaaataaaccaatagtaataactcccaaaacaacctgggcgattactacgagaagaagtggggctgcatcaagtctgggagtcagatcaccaaaacccaatgtagtgactgtaacgacactaaaatataatgcttgcacataatttattgaatcgccgttgaagtcattcgcgaatacaaactcgtaaattaaactaaatgccaaaatatttgctaagtaaatcactccataagcaagtggcgcatatgaggtaatgtccaataagtttttgtgattcgtcttcaatctcaatttagccactgtattccactctgaaaaccaactataaatagacatgaattggcgtataacattctcttgctagcggccgcgacggctctagattaagcgatcagcactgatactggatctatacaccaacctgccaagcacttttaccagtatgttggctgggttgcacattagctttcaggcagggtccttgccaaaggaactgcatccgtgccggaattactgaaagggctgcaaggtaatgggtagttaggaattgttccctgtcttctaagatatccattagcggctgcttttgaccattttcttcccgccgtgaaaggcggcaatcggccagaagcggtcaattaaccgggtattagctacaggatcggcgtttgattgttgtcgctgatgcccaatgatccagctaccgaaatttgtctgaccccagccttcgcgttgagagtattagcaagcctgactttaagctaatcactggcgaagcagagttaagtcaacatatggattaactctgcctcgccgataacatttcactgccggcgggaaaattcgataccgagttcgagtctgactgcctgagccatttgggatgctatatcgaagcaagccatcgcctgataaagactttgacttcattttccagaatggcaatgcgtggtgagcgccaaacgctagtatagaactcagacccaataatctcatgaaagttaatttaatataacttacgaggaaaatctaagtattgttgcgtattcctactccatctcagcgcagaatatcccgaaattagtctatgaccgatccatcgcgggtctaccatgtgcggccttccaatctggtttgccaacaacagttcccccataaatgagcaccacgtcctttcattaattagggtcctaccatatccatgataagatcgaccgcttttataccatatgaaatcaaaaaatttttgtccgatgataggttccagtttatgaagctgcgcagctgaaccagtagacatatcgatcatggggatatggagaatctcaccgctcatcatcactagcttagaatgcactgcgacctccatctctcttggacagcgtcgaaaaacatcctcaatagtatccaaatctataaaatgcgcagggctcattgaaaaaatctgtcgatcatcaaatacagatcgagccacatacgtgtaataactaagctccacggacttgatcaccgactggttggcagcaataactgatctcacatgccagtaaggatgatcttctacccttaacaactctatatcctcatgccggaaagattttgatatgacgtagtggcaaaatcatccgtcattccagaaataaaatcagttataaggtgggcgcgtaaaacccactcatccgcaagagtatatccagcaacactctcaatcttctccagctgttccttgtaaacctgaatataattcttaggaaaaagcgtaagcagtttattttcaatgatgattgatcggctcttagcatctttagtcttatagtctagcgcagcacggaagcgagcagttcctgcgaccaaaagacaggagaagtggtctaatagaccatatatcgctcgataaccagccaactctactctctgaacactttcatgacaataaactttcttacggcaatagcctttgagagcctccaaaatttttccagccggggtatcagaaggaattaatgagggcagctgtccactgagaatgcggtcgtgaaattcgatgtactgatttgcagcaaactcgacaagcagcctgtttaatgacgttctgaaatcggtgaacgtaaatttccttccatcgtctctctcacctgcagctgcgaaacgcaatatcttgtcaatccggtccgaatcttgaccttccataccctcggcaagccaatcagtgcgaatctcttcaaaagctattgatttaactaaaagccccttttctatcgaatcctccaagtcgctaatgcaataagcgatatcatcggcggcttccatgatatatgccaaaggaaaacgctgcggtaatttataattaaattcactccaaacgtctaagacaatctgctcctcagtcgaaaaataaccacacttcttgacaaacggagaatcaatcgttttgtagccatgtctatttccgcggacatatttaaggtaagcggcgatcgtcgttttagttaaattcaagccaaactcatcaatatttctttgaagctttgtaacgacacgtatgccttgtggattcccatcgaactctagaaagtctgcaatagccgctgcactttgggcctcactgacatataatccattatctttatttgcttcctcaaacagcaacttcccattttccctgaaccattcagatattgcagattcgccgaagtgcccaaaaggaggatttccaatatcatgcatcaagcaagcagtttcaacaaatacagttaaagctgtacactcatctctcgaagcaaggttcgcctctatgagctttagggagattcggtctgctatatatcgccccgtctgtgcgacctcaatagaatgagtaagcctactcctaactgccgcatttggctccatggaaaacacctgcgccttttgctgtaagcgccggaaggcgggacaaaatagaagtcgacctctatcactttctgcctcgagcaggagggtatttcgatcctgcacctccgatggccggaaccgcattgaagatagaagcgttccatatatagagctcatttgttttccttaacctgcgacgttcacgtaaattatgcgaatcagtttattgcggtgagcgtgggaaaagcgatagccctgcgtgataaatttacccgttcgcgcgtattccccgctggaatgtatgagccctgggcacttgcccctaccaagcctgacaccaaatccctgttaacaagttggatctggcgaatcaagatgatcttccgcttctgcccgaaagctgccttcacctttaagccactgaccaggggtcttacatctttaggtgatcattccatgggcatatcctcctgcatgggtccgctggccactggcaaagcaaagaggttccccatttcccagttgcacccaccccaccaccacgctaccctcctccccgtcgctgccaattcagcgaccgggcctgataacccggcaagatgcaggcgcaccaagcgcccccaaaacccgatttgcaggcgttttttttcgcctttcatttcgtgcaatggcggctgtgcgtgggagaccttcgggtctgccgggttcctgtatctccggtttatcagcctgcgcacagctgccacccaattcgcctgataacgaatgtggtagctctcacttgatacgggagttttaccgatgaccgctacagatccgtctgcattaaccaccctcggcgtcacccccttctccttccactccgaccaacctctattccgcgtcaacagcggtgtttccctgcacgaagccttgcaccacgcctccgacctcctccacgttgccaagcagctcgcagaagatgcggcgatgaccaaggagacggaccgttacgcctgggcgtcgcattacttgcaggagatggtgaaagcggtggtggatgatgtggtgaaggtgttggattcgcctgttatcactcaagaaagggcgggcaaccgctaacctgtggcgagggagcttgctcccgttgggttgcgtagcagccccatcttttggggccgctgcgcgccccagcgggagcaagctccctcgccacagtgacggtgttcttccttagcagtgacggtgttctgccttaacagttgcggtgtttcttcctgggtggtgggtattacctagccgtttgcgacctgcgaagccccgacttcgcgtgttaaccttgcgcccatcgcaaaaatgctgggccaagcgcccgatgccgatcagttaagcgaccacgattgggcacgatgttgagctttcgaacttcagcgatgcaggggctgcggcctgccggtacagcgcggcgagcccttcgcagcctcgcaggggctcgacagctcccacattcggccagcgtcgtttggaagcctgcgctgcgcaactgatcgacactggaccaagcgccccctttgccccatcactttcaacgaatttgcctactatccaatgagtaaaaacacgtccgatctgtcttcccacacgccgatgatgcagcagtactggcgtctgaaaaaccagcaccctgatcagttgatgttctatcgcatgggcgacttctacgagatcttctatgaagacgcgaagaaggccgccaagttgctggacatcactttgaccgcgcgcgggcagtcggcggggcagtcgattccgatgtgtgggattccttaccattcgttggaaggctacttggtcaagctggtaaagctgggcgagtcggtggtgatttgtgagcagatcggcgacccggcgaccagcaaggggccggttgaacgtcaggtggtgcgcattattacgccgggtacggtgagtgatgaggcgttgctggatgagcgtcgtgacaacctgatcgcggcggtgttgggcgatgagcgtttgttcggcctgtcggtgctggatatcaccagcggcaatttcagcgtgctggagatcaagggctgggagaacctgctggcggagctggagcgtatcaacccggtggagttgttgattccggatgattggccgaaggatttgccggcagaaaagcgtcgtgggaccaagcgtcgtgcgccgtgggattttgagcgtgattcggcgctgaaaagtctgtgccagcaattctcggtgcaagacctcaaaggtttcggttgcgaaaacctgaccctggccatcggcgccgccggttgcttgctcggctatgccaaggaaacccagcgcaccgccctgccgcatttgcgcagcctgcgccatgagcgcctggacgataccgtggtgctcgatggcgccagccgtcgcaacctggagttggacaccaacctggccggtggccgcgataacacgctgcaatcggtggtggaccgttgccagactgccatgggcagccgtttgctgacccgctggctgaaccgcccgctgcgcgacttgaccgtgctgcaagcgcgccagacctctattacctgcctgctggatggctatcgttttgaaacgctgcagccgcagctgaaagaaatcggcgatatcgaacgcatcctggcgcgcatcggcctgcgcaatgcgcggccgcgtgacctggcgcgcctgcgcgatgccttgagtgcgctgccgcaattgcaagcggcgatggcccacctcgacacgccgcacctgcaacagctggccgtgaccgccggcacttacccggacctcgcggcgctgctggaaaaagccattatcgacaacccgccggcgatcatccgtgacggcggcgtgctgaaaaccggttacgacaccgagctggatgagctgcagtcgctgagcgaaaacgccgggcagttcctgattgatctggaagcccgcgaaaaggcccgcaccggcctggccaacttgaaggtcggttacaaccgcgtgcacggctactttattgagctgccgagcaaacaggccgagtcggcgccgatcgactatcagcgtcgtcaaacccttaaaggtgccgagcgtttcatcacgccggagctgaaagagtttgaagacaaggcgctgtcggccaagagtcgcgctctggcgcgcgagaaaatgctttatgaggcgttgctcgaagatttgatcagccgcctggcgccgttgcaggacaccgccgccgccctggcggagctggatgtgttgagcaacctggccgagcgcgcgctgaaccttgatttgaactgcccgcggtttgtcagcgagccgtgcatgcgcatcgtgcaaggccgtcacccggtggtggaacaggtgttgaccacgccgttcgtcgccaatgacctgtcgctggatgacgacacccgcatgctggtgatcaccggtccgaacatgggcggtaaatccacctacatgcgccagaccgccttgatcgtgttgctggcgcatatcggcagctttgtgccggcggccagttgcgagctgtcgctggtcgaccgcattttcacgcggatcggttccagcgatgacctggccggtggccgttcgacctttatggtggaaatgagcgaaaccgccaacatcctgcacaacgccaccgagcgcagcctggtgctgatggacgaagtcggtcgcggcaccagcaccttcgacggtttgtcgctggcatgggcggcggccgagcgtttggcgcatttgcgtgcctatacgctgttcgccacgcactatttcgagctgaccgtgttgccggaaagcgagccgctggtggccaacgtgcacctcaatgccaccgagcacaacgaacgcattgtgttcctgcaccatgtgctgccggggccggccagccagagttacggcctggccgtggcgcaactggcgggtgtgccgagcgaggtcatcacccgtgcccgcgagcatttgagccgcctggaagaaaccgcgctgccccacgatattcccgtggccagcccggccaaagccagcaacaaacctgccgcgccgcaccagagcgacatgttcgccagcctgccgcatccggtgctggatgagctggccaaacttgacctggatgggttgacgcctcgaaaagcgctagaaatgttatatgcactgcaagttcggatataacgcagacgcttgcaagctggtagactctcgcgcggtttgggatgctgcaggcttttagcctggcctgcagactatcgctcctgaacctcgcgagccctgccacaaagggtttcgctgccgccgcctgaggagaaaattagaaatgaccttcgtcgttaccgacaactgcatcaagtgcaagtacaccgactgcgtcgaagtgtgtccggtggactgcttctacgaaggcccgaacttcctggttatccacccggacgagtgcatcgactgcgccctgtgtgaaccagagtgcccggccgtcgctattttctccgaggacgaagtcccggcagagatgcaggaattcattcagttgaacgtcgagctggcggaaatctggccgaacatcactgagcgcaaggatccgatgccggatgcagcggagtgggatggcaagaaaggcaagattgcagacctggagcgctaacagcgccgccgcccaataaaaaaggccccttgcgggcctttttgcgtttctgtgtggcgggtttcacttttctgcaggcaaaaaaaaggggcggtatgacccgcccacattttttccctagtccctgtattccttttcatcgtcctgatgaatcgcatcctgcgacgttccttcaaccatcgttccttgatggctgtgtcaatccgtggacacagggctgatcttagagacttccaacgtaagttcaacgggatccaagcggcgggctgacagacttgaacgctcaaacaaatataaataattgttatatttcaacaagatagaaaatactctcgtcaattcgagacgtcccgtcccggtaaaaaaaccaaacacttacggaaaagtaagcgaatgcttacacgcgcaattgtgtaaaagcgcagtaacaccttgttgacctattcgcaggcaagaaaaagccccggcccagtcgaggcttgttttccttcaggcggatcagtcgtcgctgaccgtaatcgtcggcattgccggcgcagccgcttcttgaaggacgatacgcgcgcccacatgccgcgccagctcttgataaatcagagcgatctgcccatccggctcggcggccacggtgggtttgccgccgtctgcctgctcacgaatctccatcgccagtggcaacgaggccagcacttcaacgccgtattgcgtggccagcttcgcgccgccgccttcgccaaacaggtgctcggcatgcccgcagttggagcagatgtgtaccgccatgttttccaccacgcccagcaccgggatgttgaccttgcggaacatctccacgccttttcgcgcgtcgagcagtgccaggtcctgcggcgtggtcacgatcaccgaaccggccaccggaactttctgcgccagggtcagctggatatcgccggtgcctggcggcatgtcgatcaccaggtaatccaggtcgccccaggcggtctgcgtgaccagttgcagcaaggcgccggagaccatcggcccgcgccagaccatcggcgtgttgtcatcggtgaggaaggccatggacatgacttccacgcccatcgactcaatcggcacgaaccacttctggtccttgaccttcggccgggtgccttcggcgatgccgaacatcacaccttggcttgggccataaatgtcggcgtcgagaatacccacgcgcgcaccttcacgggccagcgccagcgccaggttggccgctgtggtggatttacccacgccgcctttgcctgacgccacggccacgacattcttgacgttggccaggccagggatttgtgcctgggccttgtgcgcggcgatcacgcactggatgtcgaccttggcggaacgcacaccgtcgagaccctcgatagccatttgcagcatctgcgcccaaccactcttgaacagaccggcggcataacccagctccagctggaccgacaccgtgtcgccctggacttcgatggcgcgtacacagccggcactgaccgggtcctggttcaaataggggtcggtgtattggcgaagaacggcttccaccgctgcgcgattgacggcgctcatgggctactcccgaaaaaagactgactgaaacaggcggctatcctaaccgttccagccgcccagcggcatgctttcgaaggttgagaggtggttgaaacagcctcacggggtgaaataaatttcccggcgctttatagtggccgacctccgtttcatcaagtagccgagccccatgtccgagccacgcaagatcctcgtcaccagcgccctgccctatgccaatggttctatccatcttggccatatgcttgagtacatccagaccgatatgtgggtgcgctttcagaagcatcgcggcaatcaatgcatttatgtctgcgcggacgacgcccacggttcggccatcatgttgcgcgccgaaaaggaagggattaccccggaacaactgatcgccaatgtgcaggctgaacacagcgccgactttgccgagttcctggtcgatttcgacaacttccactcgacccactccgacgaaaatcgcgagctgtcgagccagatctacacgcgcttgcgcgacgccgggcacattgccacgcgctcgatcacgcagtatttcgacccggaaaagaaaatattcctggccgaccgcttcatcaagggcacctgcccgaaatgcggcaccgaggaccagtacggcgacaactgcgagaagtgcggcgccacttacgcaccgactgacctgaagaacccgcgctcggccatttctggcgccattccggtgctcaaggattcccagcacttcttcttcaagctcccggatttccagcaaatgctgcaaacctggacccgcagcggcaccctgcaagacgccgtggccaacaagatcgccgagtggctggatgccggcctgcaacagtgggacatctcccgcgatgcgccgtacttcggcttcgagattccggacgagccgggcaagtatttctatgtgtggctggacgcgccaatcggctacatggccagcttcaagaacctgtgcgaccgcacgccggagctggatttcgacgcgttctgggccaaggattccaccgccgagctgtaccacttcatcggcaaagacatcgtcaacttccacgccctgttctggccggcaatgctcgaaggttcgggctaccgcaagccaaccggcatcgccgtacacggctacctgacggtcaacggccagaagatgtccaagtcccgtggcacctttatcaaggcgcgcacctacctggaccatctgtcgccggaatacctgcgctactactacgcctccaagctgggccgtggcgtcgacgacctcgacctgaacctggaagacttcgtacagaaggtcaactcggacctggtcggcaaagtcgtcaacatcgccagccgttgcgccgggtttatccacaagggcaatgccggcgtactggttgcggaaaacgccacaccggaactgaccgaagccttcctggccgcagcgccaagcatcgccgacgcctatgaagcccgcgactttgcccgcgccatgcgcgagatcatgggcctggccgaccgtgccaacgcctggatcgccgataaggcaccgtggtcgctgaacaagcaggaaggcaagcaggctgaagtccaggcgatctgcgccacgggcgtcaacctgttccgtcagttggtgatcttcctcaagccggtgctgccattgctggccgctgacgccgaggcgttcctcaatgtcgcgccgctgacctggaacgaccacgccacgttgctcagcaaccatcaattgaacgagttcaagccgcttatgacccgtatcgacccggtcaaggtgcaggcgatgaccgacgcttcgaaagaagacctggtcgccagccagaccgataccggcgacgcagcaccggccggcaacggcgaactggacaaggacccaatttcggcggaaatcgatttcgacgcctttgctgccgtggacctgcgtgtcgcgctgatcgtcaaagccgaagccgtggaaggtgccgacaagctgctgcgcctgaccctggacctgggcggcgagcaacgtaacgtgttctccggtatcaagagcgcttacccggacccgtccaagctcgatggccgcctgaccatgatgatcgccaacctcaagccacggaaaatgaagttcggcatctctgaaggcatggtgatggccgccggccctggcggcgaagagatctacctgttgagccctgacagcggcgccaagccgggtcagcggatcaagtaagcctgtctggctgagtggcgcgggcttgttgaagtgagttggcctgttgtagtacttgctgtggcgagcgggcttgttatggtgagtgggctcgttgtggcgagcgggcttgccccgcgttgggctgcgaagcagccccatcaggaccacagcgtttttacaagtagaacgaggcgcctggtctagggccgctgcgcgccccaacgcggggcaagcccgctcgccacgacaacccgctctctacagcaagcctgcttaccgcgacaggccctgtttgtttaaccggcacgccaatgatcaccccatgaacctgattcaacgtatcgacgcgctgctgccgcagacccaatgcggcaaatgcgggcacccgggctgcaagccttacgccgaaggcatcgctcagggcgaggcaatcaacaagtgcccgcccggtgggcaggaaaccatcgtgggccttgcgcagttgctgcgcgtgccggtgctggaactggacaccagccgaggtgaagcccccgcccaagtcgcctatatccgcgaggccgagtgcatcggctgcaccaagtgcatccaggcctgcccggtggatgcgattgtcggcgcggccaagttgatgcacacggtgatcatcgatgagtgcaccggttgcgacctgtgcgtcgcgccctgccctgtcgactgcatcgaaatgcgcccggcgaccaccgtgctgccgattgtgggcggcctggcagccaacgatcgccagcgccatgaacgcggcctcaagcgcgaccgcgcacgcaggcgttatgagcagcgcaacgcacgcttgcagcgcgaagaagcgcacaagctcgctgaacgcctggcgcgggccaaacgctcggcgccgattgcgcccgtgctggccgattccgccgcggccgccagggacgccgccgtcaagaaagccaagatcacggtcgccatgagccgcgcccaactgcacaaatccctgaaagcgttcggccacccgccgacctttgagcagcagtcgcagctgattgccctgcagcagcagttcgaagcggcggagcaggcgcttgcggcactggaagtgaacagcccgccgccacctccaaccaccaaagaccctgagctcaagcgcgcaaaaatccagctggccatgcgccgcgccgaattgaaaaaagctcaggacctgaatgccgacgagcagcaactggcgaccttgagcgccgcgctgcgcaacgccgaacaggcgctgcacgatgccgaggcgatcagcgaacagccccggcccgacttgcagcgcgtggaaaaacgccccatcgacacccaactgcgtcagttgaaaaccgccctggcctatgcccgcgccgatgtcagcaagctgcaacgccagtcggacgtcagcgcggacgaactgaaagccgcacaactcaaactggacgaagcgcagcgccaagtcgatgctcataccggcgcttgagccgcaaccggcgctgccgggcacggtgacgatggtttatcctgcaacgctcggccctacgttgcccctcacgctgaccgcccgtaaggaaaagcctgccccatgaacgccgcaaaacgcctggaaattttccgcaggcttcacgaagacaatccggaacccaaaaccgagctggcctactcgtcgccgttcgaactgctgattgcggtgatcctgtcggcccagtccacggacgttggcgtcaacaaggccacggccaaactgtatccggtggccaatacgccgcaggccatctacgccctgggcgtggaagggttgtcggaatacatcaagaccatcggcctgtacaacagcaaagccaagaatgttatcgagacctgccgcctgctcgtcgagttgcatggcggcgaagtcccacagacccgcgaggcactggaggcgcttccaggggtggggcgtaaaaccgccaatgtggtgctcaataccgcgttccggcaactgaccatggcggtggacacgcatatttttcgcgtcagcaaccgaaccggcattgcgcgcggcaagaacgtggtggaagtggaaaagcagctgatgaagttcgtgcctaagccgtatttgctcgactcccatcactggctgatccttcacgggcgctacgtttgccaggcccgcaaaccgcgctgcggcagttgccgcatcgaagatttgtgcgaatacaaggacaagacgtccgacgattgagggttcattggttttctcgatcagtcgattgaaaaaatcttttttaccctttcctggtttatcgttataaggagcgccaatggcagtcttagcctggagttaaccttatgagcactggcaaagaacaactggatgtagaggacgacctcgttgctgattcggaagacgagggggaagcacctcctgttgaggtggccaagaccaatttgagcaaacgtcgcactatcgataaccttctggaagagcgacgcttgcaaaaacagctggccgattacgacttcgatctctgatcgagccgccttcgaccggaagcctccctgacggaggcttttttttgccggttctacgggctcgtgcgggccgcccgccgcccgttataccaggccgttgcgttgggccagctcaatcaggtcgacgagggaacgcgcgttgagcttgagcagcaggcgcgtcttgtaggtactcacggtcttgttgctgaggaacatgccgtcagcaatctctttgttggttttgccacgcgccagttgctgcaacaccatcatttcgcgccctgacaagcgttcgaccatgtccgcctcactggcgttacccatggttgagcgcaccgagttgagcgcctggttggggaaatagctgtagccggagagcaccgccttgatggcgctcaacaactcagtcaggtcctgctgcttgcacacgtagcccgccgcgcccgcctgcatgcagcgcatggaaaaatgcccgggcgcctgggacgtcagcaccaacaccttcacaggcgcaggctgcttggtggaggcaaggcggcagataacctccaggccatcgagtttgggaattccgatatccaatataacaatgtccggcacatgctcgcgtgcaagttgcaacgcatcgacgccgttatcagtctccgcaacgacttcataaccatgacgctccatgagcatgcgcacagcaagacgaatgacgggatgatcatccacgatcagcactttattcatgagaaagtccaatttcgctgttcgaattatttagagcaagcacaatagcctagtcgtttcctagttggcatagcgctcccccccaagcaacagcaagcagagacccaacccacaacgatataggaattaacctacaaaaaaacattaacccagacgcgtccgattttatgcagactttcagacctttccgtgggcatacatatcttgagtgaaatatccgtcgcataaggggatcaaggtaaacgtgccgcacaagactttcaggaaatgcccattgcgtggcgccgccaggcgagtgaacaggtgagaaaattccgactcttttagttccattccacatattttctaacatccctaattcctacagaattttcttagtcttacataccattcgcacttatatagtgaatcttctgtaagacatagttcctaggcaggtgttaaaaaatcattcaccgacgtaaaaaaacaaacttcaaaactaaaacacagcgcataactttttcactgacaagccataaacattttccaaacgcgtttaaacatcacgccgtactcctggctagtgccttgaatattcaggcaaaaaaaatggccccttaaacaggggccacttttttacagcgaggggatcactcagaacagcttgcgacccttgttggccgcgatgcgcatgcgcagcgcattcaacttgatgaagcccgcagcatccgcctggttgtaagcgccgccatcttcttcgaaggtggcgatgttggcgtcgaacagcgactcatcggacttgcgaccagtgacgatcacgttgcccttgtacagcttcaggcggaccacaccgttcacgtggacctgggaggcgtcgatcatctgttgcagcatcagacgctcagggctccaccagtagccggtgtagatcaggctggcgtacttgggcatcagctcgtctttgaggtgagcgacttcacggtccagggtgatggactcgatggcgcggtgggcacgcaacatgatggtgccacctggggtttcgtagcagccacgggacttcatgcccacgtaacggttctcgacgatgtcgagacggccgataccgtgttcgccaccgatacggttcagggtcgccagcacggtggccggcgtcatttcgacgccgtccagcgcgacgatgtcgccgttgcggtaggtcagttccaggtactgggccttgtctggagcgttctccggggagacggtccatttccacatgtcttcttcgtgttcggtccaggtgtcttccagcacgccgccttcataggagatgtgcagcaggttggcatccatcgaatacggggacttcttcttgccgtgacgctcgattgggatggcgtgcttttcagcgtaatccatcagcttttcgcgcgacagcaggtcccattcacgccaaggagcaatcactttcacgcctggcttgagcgcgtaggcacccagttcgaaacgcacctggtcgttacccttgccggtggcgccatgggaaatggcgtcggcgccggtttcgttggcgatttcgatcaggcgtttggcgatcagcggacgtgcgatggaagtacccagcaggtactcgccttcgtagacggtgttggcgcgaaacatcgggtagacgaaatcgcggacgaactcttcgcgcaggtcgtcaatgtagatctctttcacgcccatggcttgcgccttggcacgtgcaggttcgacctcttcgccctgacccaggtcagcggtgaaggtcaccacttcacagttataagtatcctgcagccacttgaggatcaccgaagtgtccaggccgccggaatacgcgagaacgaccttgtttacgtcggccatgccatcactccacggggttgtacggaaagccgtcgattctaccgaccaaaaccgtgaatttacagaggcgcgacagcaaatgaagataaagcgacagattatgtcgagcgggcgaccgatggtcgcacctcaggatgtgtgggcggcgttgcttggcgcagtggcctgtggcgccggcttctcaggagcggcgacgcgttcgagctgaatgttcacacgccgattgcgcgcccggttggcagcattggtgttgggcgccagcgggtagctttcgccgtggaaacgcatggtgatctgcgcttccgggatgccattggccttgaagtagtccgtgaccgccagcgcccgacggcgcgagacgtcacggttggtcaggcggttgccactgttgtccgaatggccgttcaactcgatgtggttgacggtagggtcggctttcatgaacgcgagaatcacgtccagcttcttcttcgccgctgcgtccagctcgataccaccgcctgggaaaccgacttcggtctgtttgacttggtcgtaattcatcggcagcagcttggtggtgcacagttgatagtcgttgaaggccttgttgaatttcaccggcaacaggcgaatttccgagtagccgccttcacgcccgtaatgccgcacggttgggctgcgcccttcgagcaaaccggtgaacaggcgcccggcctgagcctgggagctgttgaacaagacgtcgccactgccgacacgcacagcgccaaggttgatatcgccacggcccggctgccagggtgcggcggccgccaataaggttgccgagcccgcgcccagcgcaccgttgtaggctttgagccgaaatgtcgcctgctcgccggcccggcgcacgaactcgcccgagccgaaatcggtgatcggctgggtgaggcggcactcgaactggtcgccttccaccttccactcaatattctccagacgtgtctggaacgtgagggccatcgcaggcaggctggcgaacacactgagcagggctagataatgctggcgcacgggaggctccactggtttctacaacacttcaaagcgtcatacgtcgttaaggcatacccagggatatcggtagcgtcctgcaaaacttgatagcgagtgcctgcaagagtcttttccggtagcattcccaccagattgacccgcctggaatccccaatgtccgaccgcctgaccctgctgcgtcccgacgactggcatattcatcttcgcgatggtgctgcgttaccccaaactgtggccgatgtagcgcgcacgtttggccgcgccatcatcatgcctaacctggtgcctccggtgcgtaatgccgctgaagccgacgcctatcgccagcgcatcctcgctgcacgaccggccggcagccgcttcgaaccgctgatggtgctctacctcaccgaccgcacccagcctgaagaaattcgcgctgccaaagcgaccggcttcgtgcacgccgccaagctgtacccggccggcgcgaccaccaactccgattccggcgtgaccagtatcgacaagatcctgccggccatcgaagccatggctgaagtcggcatgccgctgctgattcacggtgaagttacccgtggcgatgtggatgtgttcgatcgcgagaagatcttcatcgacgagcacatgcgccgtgtggtcgagctgttcccgacgctgaaagtggtgtttgaacacatcaccaccgccgacgccgtgcagttcgtcaacgaggcttcggccaacgtgggcgcgaccatcaccgcgcatcacctgctctacaaccgcaaccacatgctggtgggcgggattcggccgcacttctattgcctgccgatcctcaagcgcaacacccaccaggtggccttgctggatgccgccaccagcggcagcccgaagttcttcctcggcaccgactccgcacctcacgcccaacacgccaaagaagctgcgtgtggctgtgccggttgctacaccgcgtatgcggcgatcgagctgtacgccgaagcgtttgaacagcgcaatgccctggacaagctcgaaggcttcgccagcctcaatggcccgcgtttctacggcctgccggcgaataccgaccgcattaccctggtccgtgaagactggaccgcccctgccagcctgccgtttggcgagctgactgttatcccgctgcgcgccggtgaaacactgcgctggcgcctgctggaggaaagcaagtgagtgaagaccattacgatgacgaacacgagcacagtggtggcggctcccgtcacccgatggccgagcggtttcgcggctatctgccggttgtcatcgacgtagaaaccggtggtttcaattgcgccaccgacgccctgctggaaatcgccgccaccaccatcggcatggacgagcagggttttgtgttcccggaacacactcacttcttccgcgttgagccgtttgaaggtgcgaacatcgaagcagctgccctggagttcaccgggatcaaactggatcacccgctgcgcatggcagtgagtgaagaagcggcgctgaccgatatcttccgcggtgtgcgcaaggcgttgaaagccaatggctgcaaacgcgcgatcctggtcgggcacaacagcagcttcgacctgggcttcctgaacgctgccgtggcgcggctggacatgaaacgtaacccgtttcacccgttctccagcttcgacaccgccaccctcgcaggcctggcgtatggccagaccgtgctggcgaaagcctgccaggcggccggtatcgacttcgacggccgtgaggcccactcggctcgctatgacaccgagaagacggccgagctgttctgcggcatcgtcaatcggtggaagcagatgggcggctgggaagatttcaacgactgaggtttgcccgaacgctgttgtggcgaacgggctcattgtggcgagccggcttactgtggcgagcgggcttgccccgcgttgggctgcgcagcagccccagaaccagacgacgcggttcgccagatgaatcgcggcggtctaattggggctgcttcgcagcccaacgcggggcaagcccgctcgccacaacatacccgctcaccacaacatacccactcgccacaacagccctccagccactgaacaccagtcgccacaggggcatttcccgcgcataaaaaaaccggccttctcaggccggtttttttacgtcgaacgtggcttacagcttgccggcgttctcggtcaggtaagccgcaacgccttctggcgaagcgttcatgcctttgtcgccttttttccagttggcagggcacacttcgccgtgctcttcgtggaattgcagggcgtcaaccagacggatcagctcttccatgttacggcccagcggcaggtcgttgatgatctgcgagcgcacaacgcccttgtcgtcgatcagaaacgcgccacggaacgccacgccgccttcggactcaacgtcgtaggccttggcgatgtcgtgcttcatgtcggcagccatggtgtatttgactttgccaatgccgccatcattgatggcggtgttgcgccaggcgttgtgggtgaaatgggagtcgatggaaacggctaccacttcaacgttgcgcgccttgaaatcgtccatgcggtggtccagagcgatcagctcggacgggcagacgaaggtgaagtccagcgggtagaagaacaccaggccgtatttgcctttgatggcttcagacagtttgaagctgtctacgatttcgccattgccgaggacggcaggtacgtcgaaatccggggcttgtttgccgacgagtacgctcattgggtatctcctgatgtaagggtgacgattgaagtaaaaggaccggcccgagtctggcgcagctaagcgacagccctgtgacgcagtcacgcttcgtgaagaccgaccatcatacactgaaaaaaccgttcgtcagtgagggcgcagtgccagcgaataccctacgaatctactttgacaatcattctcgttaacattaagatccatcgcacttaagcctcaaacccgcgatggttctcccttatgtatgtctgcctctgcactggcgtcaccgacggacaaatccgcgaagcaatctatgaaggttgctgcagctacaaggaagtacgtgaaaccaccggcgttgccagccagtgcggtaaatgtgcctgcctcgccaagcaagtggtacgggaaaccctgacgcagctgcaaacagcccaggccgcgctcccctactcagcagaatttacacacgcttaatcaggcgtgttttgaagaaccggacttagtgtccggtttttttatgcctgtaattcaattagttagcgccaagacgcggaacacaaacattcttattccgattaattttcatttattattcaataacttaggtttgacactagggatttcgccgctcaaactccgccttatatacagctattacagggcaggaccccagtcatgaaaggcgacatctcagtcatccagcaactcaacaaaatccttgccaatgaactggtcgcgatcaatcagtactttctgcatgcgcgcatgtatgacgattggggcctggaaaagctcggcaagcgtgaatataaagaatccatcaaggccatgaaggacgcagatgcgctgatcaagcgcatcctgttcctggaaggcctgccgaacgtgcaggacctgggcaagctgaacatcggcgagcacacccaggaaatgatcagcagcgacctcggctttgaacgcaagagccacagcgacatcaaggccgccatcgctcactgcgaaaccaagggcgacttcggtagccgtgaactgctggaagatatcctggaagaccaggaggaacacatcgactggctggaaacccaattgggcctgatcgataaagtcagcctggagaactacctgcaatcgcagatgggtgaataagcgctgaagatcgttcccacgttctgcgcggtaatactgcttagacgtggctttgatgcttgagcagggtgacgcagagcgtcacaggatgcattcccacgcggagcgcgggaacgatcaattagccacaaaaaagccccgctctctttcgagacgcggggctttttattgcatgcaaatcacgcgtcagtcttggctgccgcgtttgctgctgcttctttgatcagagcctgcagcgaaccatcagccgccatctcggtgatgatgtcgctaccgccgaccagctcaccggcaacccacagttgtgggaaggttggccaattggcgtacttcggcaggttggcgcgtatttcagggttttgcaggatatccacgtaggcgaacttctcgccgcactgcatgatggcctgggaagccttcgcggagaaaccgcactgaggagcgttcggggcgcccttcatgtaaagcagaatggtgttgttggcaatctgctctttgatcgtttcgatgatatccatggaacacctcggctggaactttgcgactcacaggtcggcacggtggcgcattgtaacgcaaaattccagcgcggtgctcaggccttatgcggcggccacctgcaccggcacgccgttgagtgcggcgtttccggacaattcatccaattgccgctcgtcggtcaggtcgttggcacttgctcccggctggccgctggcgatgctcatctgcacacccgggcggccatggccccagccatggggcaggctgaccacgccgggcatcatgtccaggctggctaccacttccacttcaatcatgccgatgcgcgaactcacccgcacccgctggccgtcgctcaactgccggcggctgaggtcatcagggtgcatatgcaactgatggcgcggcttgcccttcaccaggcggtgatagttatgcatccacgaattattgctgcgcacatggcgacggccgatcagcagcagttcatccgccaccggcacaggctgcgaggcgaagcgcgccaagtccgccagaatcactgccggcgctgcctgcacctggccgctggcggttttcaagcgtgcgccaaggttgggcttgagcggccccaagtccacgccatgcggatggtccgccagcatggccaccgacaatttgtgcgcggaggcatcaccgtaagccccggcacgcaacccgaagtcgatcatctgcgccggtgccatggtcggtttaagcgccacgcccgtctgcgccgcgaaggcctcggccaagccgacaaaaatctcccagtcatgcaacgcgccggcaggcttgggcagaatcgcgcgattgaagcgcgtgacgttacgcacggcgaacatgttgaacgtggtgtcgtaatgatcgttttccagcgccgatgtcgacggcagaatcaggtcggcgtaacgcgtggtctcgttgatatacaggtcgatgctgagcatgaactccaagccatccagcgcctgctccagctggcgaccattgggcgtcgacagtacggggttgccggccacggtcaccaaggcacggatttgcccttcgccttcggtgagcatctcttcggccagcgccgagaccggcaactcgccgccatattccgggcgcccggacacacggctctgccagcggttgaagtgcccgccgccggtcgaggcaacaagatcgaccgccgggctggtgcacaacgcaccgccgacccggtcgagattgccagtcaccaaattgatcagttgcaccagccagtgacacaaggtgccgaacgcctgggtcgacacgcccatgcggccataacacaccgccttgtcggccgccgcgaagtcacgcgccaattggcggatctgctcggcaggcaccgcacattggcggctcatggcttcagcggtaaacccggcaatggcgtggcgcacgtcgtcgaggccttcaaccggcaaatggctgtcgcgcgtgagttgctcggtaaacagcgtgttgagtacgccgaacagcagcgccgcgtcgccgcctggccgcacaaacagatgctggtcggcaatcgccgccgtctcgctgcgacgagggtcgaccaccaccactttgccgcctcgcgcctgaatggccttaagacgtttttccacatcgggcacggtcatgatgctgccgttggaggccagtgggttgccgcccaatatcagcatgaagtcggtgtgatcaatatccggaatcggcaacaacaggccgtggccgtacatcaagtggctggtgaggtgatggggcagctggtccaccgaggtcgcggaaaaccgattgcgcgtcttcaactggccgaggaagtagttgctgtgagtcatcaacccatagttgtgcacgctggggttgccctgatacaccgccaccgcgttttgcccatgccgggcctggataccggccagccgctcggcgaccagcttgaacgcctcgtcccatgcgatcggctgccattcgctgcccactcgcagcatgggctggtgcaaacggtccgggtcgttctggatgtcctgcagcgccacggccttggggcagatatgcccacggctgaaggtgtccagcgggtcgcccttgatcgaggtgatcgccaggctgccgtcgtcggcttgggtggtttccagggtcaggccacaaatggcttcacacagatggcaggcacggtgatggagagtcttggtcatggccagtctcttattagggctttgaattcactatgggccgcgaccggcacaggcaccagcaacgtcagtgctgtgaatcggcaagcattacgcacggccatggctaagcgtgagcaaatgtttcagaaccctgcccgctacggctaaaaccgacacagcctggcccggagccgcccccacacattgcaaaaggtctcggcgccagtgtacaaatgggccgctgctgtcaggaatcagtcttcaaaagcgtctcggcgcccttcttgaacacccttaaaaaccgtagccctattggtaagacgcgacatttaattataagatcgcgccttcccctatttcgtcgccccgtgcggctttcgccgcaggtctcgcccgttgtcacaataaacaaggctttgagtatctgcggtctgttgcaaaaaggtagttaatgatgagcgcaaggcactttctctccctgatggattgcacgcccgaagagctggtcagcgtgatccgtcgaggcattgagcttaaagacctgcgtaaccgcggcgtactgttcgagcctttgaaaaaccgtgtgctcgggatgattttcgagaagtcgtcgacgcgcacccgcgtgtcgttcgaagccggcatgattcagctgggtggccaggccatcttcctgtcctcgcgcgatacccaactgggccgtggcgagacgattgccgacagcgccatcgtgatgtcgagcatgctcgatgcggtgatgatccgtacctttgcccacagcactgtgaccgaattttccgccaactcccgcgtaccggtgatcaacggtctgtccgatgacctgcacccgtgccagttgctggccgacatgcaaaccttcctcgagcaccgtggttcgatccagggcaagaccgtggcctggatcggcgacggcaacaacatgtgcaacagctatatagaagcggcgatccagttcgacttccaactgcacatcgcgtgccccgaaggctacgagccggatgcgcgcttcctggcgcaggccggcagtcgcgtgaccctggtgcgcgacccacgtgatgccgtgcttggcgcccatctggtcagcaccgatgtctggacctccatgggccaggaagaagaaaccgccaagcgcctggccctgttcgcgccgttccaggtgacccgcgcgttgctcgacctggccgcgccggatgtgctgttcatgcactgcctgccagcccaccgtggcgaagaaatcagcctcgacctgctcgacgataaacgctcggtcgcctgggaccaggccgaaaaccgcctgcacgcgcaaaaggcgctgctcgaattcctcgtccagccttcgtaccgtcacgcatgagccagccgttactgctgaacctgcgcaatctggcatgcggctatcaagatcaacgggtggtgcagaacctcaacctgcaccttaacgccggtgacatcggctgcctgctgggctcatctggctgcggcaaaaccaccaccttgcgtgcgattgccgggttcgaacccgtgcacgagggcgaaatcagcctggccggcgaagtgatttccagcgccgggttcaccctcgcgccggagaaacgccggatcggcatggtgttccaggactacgcgctgtttccgcatttgagcgtggccgacaacatcgcctttggcatccgcaagcacccgcaaaaagaccgcgtggtcgccgagttgctggaactggtcaacctgaagaacctcggcaagcgtttcccccacgagctttccggtggccagcaacaacgcgtcgccctcgcccgcgccctggcgccggagccacaactgctgctgctggatgagccgttctccaacctcgacggcgaactgcggcgcaagctcagccacgaggtgcgcgacattctcaaggcgcgtggcaccagtgcgattctggtgacccatgatcaggaagaagccttcgcggtaagcgatcaggtgggcgtattcaaggaaggccgcctggaacaatgggacacgccttacaacctctatcacgaaccgcagacgccgtatgtcgccagctttatcggccagggctactttatccgtggccaactgagttcaccggaatcggtgactaccgaactgggtgacctgcgcggcaatcgcgcctacacctggcctacgggtggcgcggtggatgtattgctgcgcccggacgacatcgtctatgcgccggacagcgcgctgaaagcgcggatcgtcggcaagaccttcctcggtgcctcgacgttgtaccgcctgcaactgccgaccggcgcacagctggagtcgattttccccagccacgccgatcatcaggtcggtgcgcaggtgggcattcgggtggcggctgagcatttggtgctgttccaggcctcgggcagcgtggcggcgcagattcctcagtctgaatcgggtgtacgccggtacagcccggcgaactgataatctgccgaaaccgaatcaaaatgtgggagcgggcttctgtgggagctggcttgcctgcaatagcatcactcggtctaactgaaagaccgaggcgcttgcatcgcgggcaagcccggctcccacatgggatgtgatgctcttcaacagtgacattcaggcccggccaatcggcgcaaatttggcctgggtatgttcagccagcaccgccgccggcaactcaacttccaaccccctcctcccggcactgacaaaaatcgtcgcaaacggctgcgccgtcacatcgataaaagtgcgcagacgctttttctgccccaacgggctgatgccacccagcaagtaaccggtagagcgctgcgccgccgccgggtcggccatctcgacttttttgaccccggccgcctgcgccaacgcctttaaatccagacttccgacgaccggcaccaccgccaccaacaattcacctttctcactgctggccagcaaggtcttgaacacctgggcagggtcgagccccaatttctccgcggcctccaggccataggacgccgccttgggatcatgttcgtaactgtggatgtgatgttcggcgcgaacttttttcaacaggtccagtgcgggggtcatggctattccgggcgtggcaaacagagggtcaattctaggccaaggccatgtaaaacgctctagtgcgccactcctgaaatgagtgctggcgggggcaagcgtgatcattcatcagactaatagtttgaaaatgaccaatggttcactttcgacctttgacagccgtcattcttgtctatattttttcgtttccgaatactgtaggaatagagctgcagtactccagcagtaagccatggtttggatggggatcctcgccacggtgaaaatcgcgcaacagcccgttgaggccgcgcgccaaacaagaacaacaatcgaggttttccatgacaactgctcttcaacagccttcactttcgagccaatgcatggccgagttcctggggactgcgcttctgatcttcttcggtacaggatgtgtcgctgcgctcaaggtcgcgggtgccagctttgggttgtgggaaatcagtatcatctgggggatcggcgtgagtatggcgatctacctgagcgccggtatttccggggctcacctcaatccggcggtgagtattgccctgtgcatctttgccgatttcgaaaagcgcaaactgcccttctatatcctcgcccaggttgcgggcgccttctgcgcggccgccttggtgtacacgctgtacagcaatctttttttcgattacgaacaaacccaccacatggtacgcggctcccaggccagcctggagttggcgtcggtgttctccacctacccgcacgccctgttgagcacggcccaggcattcctggtggaaatggtcatcaccgccatcttgatgggcgtgatcatggccctcaccgacgacaacaatggcctgccacgcggcccgctggcgccgctgctgatcggcctgctgatcgctgtgattggcagcgccatgggcccgttgaccggctttgcgatgaacccggcgcgggatttcgggcccaagctgatgacctttttcgccggctggggtgaaatagcctttactggcggtcgcgatattccctacttcctgattcctattttcgcgccgattgtcggcgcctgcctcggtgctgcggcctatcgcgggctgattgcccgtcatctgccaagcgccgcacctgctatagatgaaacacctgacacggctgtcaacggcaagacgcgtatttcctgatagcgccggcctggtccgcactgcccctttgcggcccaggctgattccttacttacttattttccgtctaaggcaatcgacatgaccgacattcagaataagaactacatcattgcccttgatcagggcaccaccagttcgcgggcgatcatttttgatcgcgacgccaacgtggtctgcaccgcccagcgcgaattcactcagcattacccgcaagccggctgggttgaacatgacccgatggaaatcttcgccacccagagcgcggtgatggtcgaggccctggcacaagccggcctgcaccatgaccaagtcgccgccatcggtatcaccaaccagcgtgaaaccaccgtggtctgggacaaggtcaccggccgcccgatctataacgccatcgtctggcagtgccgccgcagcaccgagatctgccagcagctcaagcgcgacggccacgagcaatacatcaacgacaccaccggcctggtcaccgacccgtacttctctggcaccaagctcaagtggatactcgacaacgtcgaaggcagccgcgagcgtgcgcgcaacggtgaactgctgttcggcaccatcgacagctggctgatctggaaatttaccggcggcaaaacccacgtcaccgactacaccaacgcctcgcgcaccatgctcttcaacatccacaccctggagtgggatgcgaagatgctggagattctcgacgtgccgcgcgaaatgctgccggaagtgaagtcctcttcggaaatctacggccgcaccaaaagcggtatcgccatcggcggcatcgctggcgaccaacaagccgccctgttcggccagatgtgcgtggaagccggccaggccaagaacacctacggcaccggttgcttcctgctgatgaacaccggcgacaaggcggtgaaatccaagcacggcatgctcaccaccatcgcctgcggcccacgcggcgaagtggcttacgccctggaaggcgcggtgttcaacggtggttccaccgtgcagtggctgcgtgacgagttgaagatcatcgccgatgccaccgacaccgaatacttcgccggcaaagtcaaagacagcaacggcgtgtacctggtgccggccttcaccggcctgggcgctccgtactgggacccgtatgcgcgtggcgcgctgttcggcctgacccgtggcgtacgcgtggatcacattattcgtgcagccctggagtcgattgcctaccagacccgcgacgtattggacgcgatgcaacaggactcgggcgaacgcctcaaagccctgcgcgtcgacggcggtgcggtggccaacaacttcctgatgcagttccaggccgacatcctcggcacccaggtcgaacgcccgcaaatgcgcgagaccaccgcactcggcgcggcttacctggcaggcctggcctgtggcttctggggcagcctggacgagttgcgcggcaaggcggtgatcgagcgcgaattcgaacctgcgctggacgaagccgccaaagagaaactctacgccggctggcaaaaagcggtaagccgcacccgcgactgggaaccgcacgaaggcgctgaataagccaagcgccggaccgatagagggttgtaactggcagggagcagattcctgcgtcatcatgggccacttttgtatggcagcccaaaggacgccccatgaatctgcctccccgccaacaacaaatcctcgaactggtccgcgaacgcggttatgtcagtatcgaggagatggcgcagctattcgttgtcaccccgcaaaccatccgccgcgatatcaaccaactggcggacgccaatctgctgcgccgttaccacggcggcgcggcctatgactccagtgtcgaaaacaccgcgtacgccatgcgggccgaccagatgcgtgatgagaaacaacgcatcggcgaagccatcgccgcacaaatccccgatcatgcctcgctgtttatcaatatcggcaccaccaccgagtcgatcgcgcgtgcgctgctgaatcacaatcacctgaaaatcatcaccaacaacctcaacgtcgcgaccatgctcagtgccaaggacgacttcgatgtgttgctgaccggcggtaacgtgcgccgtgatggcggtgtggtgggtcaggcgagtgtcgatttcatcaaccagttcaaggtcgactttgccttggtgggtatcagcggcatcgatgaagacggcagtttgctcgactttgattaccaggaagtgcgggtttcccaggcgattatcgccaatgcgcgccaggtgatactggcggcggactcaagcaaattcgggcgcaacgccatgattcgcttggggccgatcagtctggtcgactgtttggtgactgatcagcagccggtgccggcgttggtgcagttgttgaatcagcacaaggttcggctggaagtggtctaacctttcactatctctggcgcctgtaccgccgccttcgcgagcaagcccgctcccaccttttaaccgagttccagcatgagaatgcggtcaaaagtgggagcgggcttgctcgcgaaagcgatttagcgaacgcccttttcctttagccttccgcaagctcatgttcacaaattttcctttcttcgcccttcgatgagttttttcaatcgaagtcgggtggctgtgcgcgcgtttatcagctaccattttcgcaaatgaacattaatgttcgaattccaagacgaaaaattcgcgaggccagccgatgaacccttccaccttgcctgctccaccgcttgccgaagtctatgacgttgccgtaatcggcggcgggatcaatggcgtcggcattgcagcagatgcagccggtcgcggtttgtcggtattcctttgcgaaaaggatgacttggccagccacacctcctccgccagcagcaagctgatccacggcggcctgcgctacctcgaacattacgaattccgcctggtgcgcgaagccctggccgagcgtgaagtgctgttggccaaggccccgcacatcgtcaagcagatgcgctttgtgctgccgcatcgcccgcacctgcgccccgcgtggatgatccgcgccggcctgttcctgtatgaccacttgggcaagcgcgaaaagctcgccggctcgaaaagcctcaagttcggccctgacagcccgctgaaaagcgaaatcaccaaaggcttcgaatactccgactgctgggtcgacgacgcccgcctggtggtgctgaacgcgatggccgcccgcgaaaaaggcgcgcatatccacacccagacccgttgcgtcagcgcgcaccgcagcaacggcatgtgggaaatgaacatggaacgcgccgatggcagcctgttctcgattcgtgcccgggcgctggtgaatgccgcaggcccatgggtcgccaagttcatcaaggaagacctgaagctggattcgccatacggcatccgcctgatccagggcagccacctgatcgtgccaaaactgtacgaaggcgcccacgcgcacattctgcagaacgaagacgggcgtatcgtcttcaccattccgtacctgaaccacctgaccatcatcggcaccaccgaccgcgaatacaccggcgacccggctgccgttgcgattaccgaaggcgaaaccgactacatgctgaaagtggtgaatgcccacttcaagaagcagttgaaccgcgacgacatcgtgcacacctattccggcgtgcgcccgctgtgcaatgacgaatcagataacccatcggccatcacccgcgactacaccctgtcgctgtctggcggcaccggcgaggcgccgatcctgtcggtgttcggcggcaagctgaccacctaccgcaagctcgccgagtcggcgatggcccaactggcgccgtacttcacgcagatgcgcccaagctggacggccacggccagcctgccaggcggcgagaacatgagcacgccagaagcgttggccgaggcgattcgcgccaagttcgactgggtgccgagcgagatcgcccgtcgttggtccaccacctacggcagccgcacctggcgcttgctggaaggcgtgcaatcgctggccgacctgggcgaccacttgggtggtggcctgtacacccgcgaagtcgattacctgtgtgccgaagaatgggtgacgcaaccgcaggacgtgctgtggcgccgtaccaaactgggcctgttcaccacgtcggaagagcaggacaacgtgcagcgttacctgtccaaggttgaacacaaccgcgcaaagattgaagcggcctgacaggccgttttgaagagcccctgcaccgaaaggtccaggggcttttttatgcctcgagcgcctggcgctgataacgcagacccatttcgcgaatcgcgctgaaagccgagcccaacaacaccgggtaagccgccagcagaaaacccggcgtcgcggttgtcagcgcgcgctcaagccatacgcaggcttgggcctcatcgcccgcctccaccagctcggcggcatggttgtattgcccgcgaaaatccccggcctcagccgaacgctgataccactgccgcgccacttgcacatccttgggcactacaacgccctcgtggtgaaagcgccccagcaggttcatcgacttggcatgcccttttgcggcagcctgaccgaacagttcatacgcggcgagaaggtcgcgctccacaccgcgcccgcgcgtcagcagttggccgtagttgtacaaaccccaatccaaacccaggtcggcggcttgtcggtagtgccgggcgcactcggccaggtcgacttcacagccccagccattctccaggcagcgcccgaccatattgatcgccatcgggtggcgttgctgcgcggcaatgcggaaccagctcaacgccagcggctgatccttctggataccacggccgtcgagcaacagctgggccagggtcgcttgcgcgtcggcatcgcccagttgcgcggcatgcatcacccagcgcgcataggcgcgcgggttgtcgccgatttcagacgcatcactgcctgattgcccaccttgcatgcctgccccacatggcgatccaggaccgcgataaatttcatgaattatttcgttacaaactattacatttgagatcctttatcaattacgatcacatctcactttcactcacacgagaatattcaatggctaccgggatcagttctgcccccctttcatcgcggcatgtgctcgcgtcggcggtgggtttggcagtggctgcgcaaggaggattcagttatgcagcggagactgcagacgacggcacaggtgtgattcagctcggcgcgaccagcattgaaggtcaggcgcccagccagagcacttacaaccctgtggcgccttcgtcccccaaatacaccgaagccctgcgcgacacgccgcagacaatcacggtggtgcccaaggaagtcattcacgaccagaacctgctgaccctgcgcgacgtgctcagcaccgtgccaggcatcacctttggtgccggcgaaggcggcagcggttatggcgacagcatcaacctgcgcggtttctccgccagtggcgacatctacgtcgacggcgtgcgcgacagcgcgcaatacagccgcaccgacccgttcaacctcgaacaggtcgaagtcgtcagcggcgcaagctcggtgtattcgggctccggcgcggtcggcggcaccatcaacctggtgagcaaacagccagaactgcgcgacaaaaccaccatcagtgcgggcatcggcaccgataactacaagcgcaccaccctggacaccaaccagaccctcaacgacaccaccgcattccgcttgaacctgatggcccatggtaacgacgtgcccggccgcgattatgaagattactcgcgctggggcattgcgccctccatcgcctttggcctgggtacgccgacccgtgtcaccgtcagctatgaacaccagaaagacgacaacacgccgcaatacggcatccccatctacaacggcaagccgatgccgggcgtgggttggagcgactactacggctaccacaacgtcaatgaccagaaaatcacctcggacgcgttcagcctgaagctcgaacacgacttcaacgacgccgtgtcggtgcgcaacttcacccgcgtcgagcgtgtacgccaggacctgcgcgcctccggccccgaaggcgcccaggcgggctgcctggccaccggcacccagatcaccggcgcgccttgcgccgcaggcctcaagccgggctatttccagccaagcggcggctcgctgggtaacgagcgcaacacccagaacaaaatgttcaccaaccagaccgacgtgaccagccacttcagcacgggctttatcgaccacacgctggtgaccggcatcgccatcagccgtgaggaatacgaggcggacaccggcaaatggctgaccaacagcaatggcagcaccatcgtgccgccaccggtcagtttcagcgaccccaactccgagtggacaggccccgtcaacttcacccgtgccgcccacgtcgacggtgcactgaacaaccgcgccgcctacgccttcgacacgctcaagctcaacccgcaatgggaaatcaacggcggcgtgcgttacgagcacaacgccggcagttcggtgaccaatgcctattcgagcaccggcgtcgaaacgcctggcgtgcgctacggccaagcggatgacttgacgtcctaccgcctcgcgctggtgtacaaaccggtggaaaacggcagcttctacatcgcctacggcaacagcaagacgccgtcccaggccagcgtcaacggtagctgcttcaccccggcgaaatcctcaggtacgtccaccaacaactgcaacgtcgccccggaaactgccgtcagctatgaaatcggcaccaagtgggacttcctcgacaatgccctgtcggtcaccggcgcgatcttccgcaatgaccgcaccaactacaaagtcgccgaccccgaccccaccaacctgagcggcacgcaatcgctggacggtaaagcgcgtgcggacggcgtggcactcggcctcagcggtgcgatcactgacaagtggaaggtcttcgccaactacacctacctggacacccgcgtattgcgcagcgccagcgacttcaccctggccaacaccgggtttgacgcgcagaaaggcgagccactgccgttcacgcccaaacatgcggccagcctgtggaccgtgtacgacctgccctacgatttccaggtgggctacggcatcacggcgcaatccaagcaatacctggtcagcgccgccggggcaccgaccgcgccgggctatgcggtgcagcgcgcgatgctcggttacaaggtcaacaagcagttgaacctgcagttgaacgtcaacaacctgttcgacaagcaatacctgacccgcatccgtaacaacggctgggcggtgccgggggatgggcgtgcggcggttgtatcggctgactacacgttctgattggtgggagctggcttgcctgcgcccacattgatcgttccccacgctccgcgtgggaatgcatccagtgacgctccgcgtcacgcctttaagggcaggacgcaaagcgtccagggcggcattcccacgcagagcgtgggaacgatcaagcggctcttgaacacatcacagactattcggttttccgaacgacataccccggaccattcggtttgccggaccccaccgttacaaattccccgcaacaaaaacttaatagccttataaatcagccatatatccatttatttcaggtatggcacgactcatgctctacactccctgacgattgcctgcgacgcttcaggagccgtcatgggcattcgctgtacaaaagagagccgtctagccggcttcataaaaaaaacaaatgtcgaggaagtattgatgcgcatcgttccccatatcctgggcgcagctatcgctgctgctctgatcagcactccagttttcgccgccgaactcaccggcacactgaagaaaatcaacgactccggcaccatcactctcgctcaccgcgacagctccattccgttttcctacatcgcggatggctcgggcaaacccgtgggctactcccacgacgttcagttggctgtggttgaagccctgaaaaaagacctgaacaaacccgacctgaaaaccaagtacaacctggttacctcgcaaacccgtatcccgctgatccagaacggcactgcggacctcgagtgcggttcgaccaccaacaacgccgaacgcgcccagcaagttgatttcaccgtcaacatcttcgaaatcggtacccgtctgctggtcaagaaagacaaggatggcaagccgtcctacgctgactttgccgacctgaaaggcaaaaacgtagtgaccaccgccggcaccacgtccgagcgcatcatcaaggcgatgaacgccgacaagcagatgggcatgaacgtcatctccgccaaagaccacggcgaatccttccagatgctggaaagcggccgcgccgttgccttcatgatggacgacgccctgctggccggcgaagaagccaaggccaagaagccggacgactgggtcatcaccggtacgccgcagtcctttgaagcctatgcgtgcatggtgcgtaaagacgacccagccttcaagaaagcggtggatgacgccattgttgccctgtacaaatccggcgaaatcaacaagatctacagcaagtggttcgagagcccgatcccaccaaaaggcctgaacctgaacttcccgatgagcgaaaaggttaaggagctgatcgccaacccaagcgacaagccagcgcctgacgtaaaaatctgatacctgactaagcttatgtcctgagggggccaacgttccctcaggcgtctgttactacctgcgggctttaatttggaacactcgacctggcggttttcgagccgatcgcgtgtgcctgacgttcaacgtcaggcgggaaaggatcttccccaagcgggtgcttgtacatcgatcgatctcgaggggagaccctaatgaattacaactgggactggggcgtgttcttcaagtccactggcgttggcagcgagacttatctcgactggtacatcgccggtttgggctggaccatcgccatcgctgtcgtggcatggattatcgccttgttgcttggctccattctgggggtcatgcgtaccgtgccaaaccgcatcgtatcgggcatcgcgacctgctacgtggaactgtttcgtaacgtgccgctgctggttcagctgttcatctggtatttcctgatacccgacctgctgccgcaaaacctgcaggactggtacaaacaggacctcaacccgaccacctcggcttacctgagcgttgtcgtgtgcctgggcctgttcaccgccgcccgtgtgtgtgagcaagtgcgcaccggcatccaggcgctgccgcgtggccaggaagccgctgcacgtgccatgggcttcaagctgccgcagatctactggaacgtgctgctgccccaggcctaccgcatcatcattccgccgctcacctcggaattcctcaacgtgttcaagaactcctccgtggcgtccttgatcggcctgatggaattgctggcgcaaaccaaacagaccgccgagttctcggccaacctgtttgaagccttcaccctggccacgctgatctacttcaccctgaacatgagcctgatgttgctgatgcgcctggtcgagaagaaagtcgcggtgcccggcctgatctccgtggggggtaaataatggacttcgatttcagcggcatcatccccgccatccctggcctgtggaacggcatggtcatgaccttgcagttgatggtcatgggcgtgatcggcggcatcgcgttgggtacggttctggcgctgatgcgcctgtcgtccaacaaactgctgtcgcgcctggccggcgcttatgtgaactacttccgctcgatcccactgctgctggtgatcacctggttctacctggcggtgccgttcgtgctgcgctggatcaccggtgaagacacgccaatcggtgcgttcacctcctgcgtcgtggccttcatgatgttcgaagccgcgtacttctgtgaaatcgtgcgggccggcgtgcagtcgattcccaagggccagatgggcgccgcccaagcgatgggcatgacctatggccagaccatgcgtctgatcatcctgccccaggcgttccgcaagatgaccccgttgctgctgcaacagtcgatcatcctgttccaggacacctcgctggtctacaccgtgggcctggtggacttcctcaactccgcccgctccaacggcgacatcattggccgctccaatgagttcctgatcttcgccggtgtcgtctacttcatcatcagcttttccgcctcgctgctggtcaagcgtctgcaaaaaaggtttgccgtatgatctctatcaagaacatcaacaagtggtatggcgacttccaggtgctgaccgattgcagcaccgaggttaaaaaaggcgaagtgatcgtggtgtgcgggccgtccggctcgggtaaatccaccctgatcaagtgcgtcaacgcactggaaccgttccagaaaggcgacatcgtggtcgacggcacctccatcgccgacccgaagaccaacctgccgaaactgcgttcgcgcgtgggcatggtgttccagcatttcgaactgttcccgcacctgaccatcaccgaaaacctgaccatcgcgcagatcaaggtgctcggccgcagcaaggaagaagccaccaaaaaaggcctgcaactgcttgagcgcgtaggcctgtcggcgcatgcccacaagcatccgggccagctgtccggtggccagcaacaacgtgtggcgattgcccgcgccctggccatggacccgatcgtcatgctgttcgacgaaccgacctccgccctcgacccggaaatggtcaacgaagtgctcgacgtgatggtgcaactggcccacgaaggcatgaccatgatgtgcgtgacccacgaaatgggctttgcccgcaaagtggccgaccgcgtgatcttcatggacgccggcaagatcatcgaagactgcccgaaagaggagttcttcggcgacatcagcgcccgctccgaacgcgcgcagcacttccttgagaaaatcctgcagcactaaaaacagcagtgttctccctgcgagaacccagctaatgcaggcactggctcatgtgggagctggcttgtgtgggagctggcttgcctgcgatggcatcacctcggtgcccctgtgataccgaggcgtctgcatcgcgggcaagcccggctcccacaaaagccaggccccacacaaacaggtccatgccagggccggcaagctctggttgacccaaggcatctgtgatgaaatgcgaccccaaccaatttcgcgccgcaccgccatcacttgccgtgaaaccacgcctgatccgccaactgttcctgccgccgttgatcatcgccctgatgatcggcttgggctatatcggcttctgggtcagtgagtactatggcatccgcaccctcagcgacaacggcgaacgccagttggagctgcatgcgcgcaccgtcgaaagcgaactgagcaaatacacctacctgcccagcctgctggaactggagtccagcgtgtccacgctgctggccgaccccaaccaggaaacccggcagacggtcaatgattacctcgaaggcctgaaccgacgcagtcgcagtcgggccatctacgtgatggacaccactggccgcgtgctggccaccagtaactggcgcgatgccgacagttaccagggtgaagacctgtccttccgtgcctatttccagaatgccgtacgtggtcagcccgggcgtttctacggcatcggcagcaccaatggcgaacccggctactacctggcccatggccttgaagagcacggcaaaatcattggcgtcgcggtggttaaagtgcgcctcgaagcccttgaagagcgctggcagcgtgcacgcctcgaagcgtttgtgagcgacgaaaacggcattatcatcctctccagcgacccggcccgccgtctcaaggccgtgcgcccgctgagcgatgacaccaaggaacgcctggcccacagcctgcaatattactgggcaacgctgaacgagctggagcccctggcccgcgagcgcctgaatgaaggcactgaaaagctgaccttcccggccaacagcgaagtggtcaacgacgagcacgaagtcagctacctcgcccaaacccgcccgctcaacgacacaccgtggaatttcaccctgctcaccccgctcaatgacctgcgccgcgcggcgatcaaccagggcattctggtggcggtcgcgttcggcctggtcgcgtttttgctgatcgcctggaacgagcgacgcaaggtcatcgccacccgcctcgccgcgcgcgaagccctgcaggaagccaacagccagctggagcgtcggattgccgaacgcaccgccgacctgcgcgccagcaatgaacggctcaagggccagattcgcgaacgccgccaggccgaagagaccttgcgccgcgcccaggatgaactggtgcaggccggcaagctcgccgccatcggccagatgtccaccagcatcgcgcatgagttgaaccagccgctggcagcgttacgcacgctgtcaggcaacaccgtgcggttcctcgagcgtggcgccctcgacaccgccagcgccaacctcaagaccatcaacgaactgatcgaccgcatgggccgcatcaccgccagcctgcgctcctttgcccggcgcggtgatgaccagggcgaagccaacctcgccaaagccgtggacgcggcgttccaggtgctcggcgcgcgcctcgacgggctgccgttgaccgtgcaccgcaatttcgccaacgctcagttgcagatcgaccaaacgcgcctggagcagattctggtcaacctgatcggcaacgccctcgacgccatgcaagcgcaaccggcccccgaactgtggctggacggccacagcagcgaaggcaaataccgcctgcacgtgcgcgataacggccacggcatcgaccccgaaacccgtaaacacctattcgaaccgttcttcaccaccaaacccggcgaacagggcctgggcctgggcctgaccctgtccgccagcctcgcggcggccaccggcggcaacctcgccgtggaacacccggccagtggtggtacggcctttgtcttgtgcctgccgttggtgggcactcaaaaagctgagtcgacatgaatacagacactacagccgcaaaagacgctctgaccgtcctgatcgtcgaagacgatccccatgtgctgctcggttgccagcaagccctggcgctggaagacattcacagcgtgggcgtgggcagcgccgaggaagccctcaagcgcatcggcgcgaacttcgccggcatcgtcatcagcgatatccgcctgccgggcatcgatggcctggagctgttaacccgtctcaaggcgctggataaaagcctgccggtggtgctgattaccgggcatggcgatatctcgatggccgtgggtgccatgcgtaatggcgcctacgacttcatggaaaaaccgttttcccccgagcgcctggtcgacgtcgcgcgtcgcgccctggagcaacgcgggctggcgcgggaagtctggtcgctgcgccgccagttggccgagcgcgactccctggaaggccgcatcatcgggcgctcgccggccatgcagaatctgcgcgaattgatcgccaatgtcgccgacacctcggccaacgtgctgatcgaaggcgagaccggcaccggcaaggaactggtcgcgcgctgcctgcatgatttcagccgccgccattcccatcagttcgtcgccttgaactgcggcggcctgccggaaaacctgtttgaaagcgagatcttcggccacgaagccaacgcctttaccggcgctggcaaacgccgcatcggcaagatcgagcacgcccacgaaggcacgctgtttctcgatgaagtggaaagcatgccgatcaacctgcagatcaaattgctgcgggtgctgcaggagcgcaccctggaacgcctgggttcgaaccagagcgtggcggtggattgccgggtgattgccgccaccaagtccgacctcgacgaactgagccgcgccagccaatttcgcagcgacctttactaccgcctcaacgtggtcaccctggaactgccgcccctgcgcgaacggcgcgaagacatcctgcagttgttcgaacatttcctgctgcagtcatcgctacgcttcgaccgcaccgcgccggagctggacaaccagaccgtgtcgaccctgatgagccacgactggcccggcaacgtgcgtgaactgcgcaacgtcgccgaacgctttgccttgggcctgcccgccttcaagaaaagcggcagcggcaacgtcaaccatggcctggcctttaccgaagcggtggaagccttcgagcgcaacctgctcaacgacgcactgcaacgcagcggcggcaacctgacccaggccagccaggaactgggaatggccaagaccacgctgttcgacaaggtcaaaaaatacgggttgagccactgatggatctgttcttgaaggccgccattggcgcggcagtggtgttgatcctggcggcgttggccaagaccaaaaactattacatcgcaggattggtgccgctgtttccgacctttgcgctgattgcccactacatcgtcggcaagggccgttcggtggacgatttgaagaccacgatcctgttcgggatgtggtcgatcattccgtattttgtgtatttggcgacgttgtatgtgatggttgatcgtatgcgcctggaggcatcactcgccgtggcggcggtggcgtggttgatggcggcgacggtgctggtgagtgtatgggttcgtgtacacgcctgacactcctggtacacctcaatcaaaaatgtgggagcgggcttgctcgcgaaagcggtggttcagtcagcacttgtatggctgacacaccgtcttcgcgagcaagcccgctcccacatttgcttcagcagtgagcctgatagatcaacgcacgatcttgtccacctgaatacccagcttcttcaaccgataccaaaacctcctctcgggtgtgggttcgcctcaatacctggacacaccgggggtaaaaaatgtgggagctggcttgcctgcgattggcggtgcatcagcaccagatcgggtgcagacataccgctatcgcaggcaagccagctcccacatttgcttcagtggtgagcctgatagatcaacgcacgatcttgtcgacttgaatccccagcttcttcaaccgataccaaaaac

SEQ ID NO: 28 - DNA, 266624 bp, Pseudomonas poae FL10F
tgcgtcccgcgccagactgatgagggcggtagggacgacgcggcagccgctgcgctgcgaccggcgggagctagcggtgggggccgggcgggcgccgcgcgcagcgtcgcgcccccccgcccccatcccccccccccacccacctcgcccgctcgccacaaccacaacaagtaccctttcatgaagaaaaatttatacagccaaactgtagagttttcctgcacgggtgctacggttaaggcatgaccggctcttctcctgacaccgccagcctggccgccgaactgcgcatctccctcggcaagctgatccgccgcctgcgcgagcaaacccaccgcgacgacttcaccaccgcgcagaagtccgtgctgctgcgcctggaccgcgatggcccgaccaccgtgtccgccctcgcccgcgctgaaagcgtgcgcccgcaatcgatgcgcatcaccgtggccgggcttgagctgatgcaggccgtcagcggcaggccggaccctacggatggccggcagacgctgatcgaactgacgcccaccttgcgaaaacacctgactgaaagccgcgccgccaaagacgattggctgctgcgtgcgctgcaagaacaactctcgccccaggagcaagccgaactcgccgctgcggtgaaactgctggagcgcctcgccgatttttgaatcacctgattgaggaaatagcatggctgtcacctcgctggatgcaacaaccaccctgatcattgtggacctgcaacacggcattatcggttaccccttcactcaaccgattggcgcgatggtcgagcgccgggggaactgaaaccgtcatgagttttctcggcacgttccgctcgctgcgcagccccaactaccgcatctgggccgccggcgcgctggtgtccaatgtcggcacctggatgcaacgcaccgcccaggattggctggtgctcacccaactgaccccgcacaacgccgccgccgtgggtatcgtcatggcgctgcagttcgggccgcagctgttgttgctgccgtggaccggctttgccgccgaccactacgaccagcgcaagctgctgatcgtcacccaggcggtgatgggcctgctcgcgttgacgctgggggtgttcaccattaccggcttcgtggagctgtggcatgtgtacgtgttcgcgtttttgtccggctgtgcctcggcgttcgatgcgccggtgcggcagattttcgtcgcggagctggtgggcgagaaggacttgtccaacgcgattgcgctgaactcgacctcgttcaacatggcgcgcatgatcggcccggccgtggccggcgtgaccatcgcctcggtcggcaccggctgggcgttcctgcttaatggctcgagttttttcgcggtgctggcgtcgttgtttttcctgcgcgttgcaggcaaaaacccgaaggtgcgcgccctgcgcaccaaaggcagcctcaccgagggcatgcgttacgtgtgggcgcggccggacttgaaggcgatcctgttgatgctgtttctgatcggcaccttcggcatgaacttcccgatattcatctcgaccatggccgtcaccgtgttccatgccgatgcgcgcggctatgggctgctcacctcgaccctggccattggcaccattgccggcgcactgattgcggcgggcagcgagcggccgcagttcaagtcactgctgacgggtgccgcggtgtttggcttcggctgcgggctggcggcactggcgccgaactattggacgttcgccattgcactggtgatcatcggcgtgggcgccatgaccttcagcaacaccaccaacagcctgatgcaactcaccaccgagcccgcgatgcgcggccgggtgatcgccctgcgcgtcgccgtcgccctgggcggcacgccgattggcgcgcctatcgtcggctgggtcgccgaccacctgggcccgcgctgggcactggtggtcggcgcggtgtcgggcgtcctggcggtgggcgtggcgctctatacgatcaagcgccagttggatcgaccccagacgatcaagtccgacccaccgaccccgtgaccggcaaattgcccagcagcttgaggccggtgctcttcacaaaggtgtcgtagtccatcggcttctggatgcgcgtttcagcgttgggcagcacataggcccaggcgcgtttcgaagaggcgtcatacaccagcttgaacaggcgcgtcggcacccacaccttgttgtcgccgacggtgccgtaaccggcgtcaaacaaaggcccggtgaacacgaacacattgccgccggcacgcacggcgaacttgcgcacatcggcctcgaccttgctccagatcttgcggttgttggtggggtcttgcggcaccatgttcgacagcgcgaaagactgcgccatggcattggcgctcggcgcatcggccgccggcgactggtggccacggtccacggtcgggtgctgactgcggtagtcgctcaactcggcgcgggcgcctttgggaatgcgcgggtccgggtagaactggttggtgcgctcctcgcctttggcgtctttcagctgcgcggcattcaggcgctcaaccaccaccagcggcgtcttgctggtttgcgagtagagcaccgcgaaattatccgaacacagcgccaggggtttcatcgtggcgggcacggtggcggtgttgatcggtgtagcaccggggaacagatcggcgcagctgtcgaatgagggtcgctgctgtttgctggaataaagatcgagggccgcgcgctggctgatcgagcctgagcgcgaggtgtgttccgaggcgggtggcttgatcaggtccagcaggccacgcgcctgtgcccctggggtgaacaaaaacaacgctgacagactgactgcaataatgcgtaagtgcatgtttcatatcttaaagtgaggggccttatggaccctcacattgcactttagtgcgaccccaacctgatcgaattccaggccgcttcagccagcagttcgcgatactcccaagggctctttttaaccttcgccgacagccaggcccgtgagtagctttcggccgcgccgatgatcaacgaggggatcagttcggcgggcagatggctgaagtgttccttgcgttgcggtgcgctcatccagtctttcaacagctggttgcgctggcggttgcgcgcaatcagctcatccttgaacgggccgttggacacggcgaagcggctttgaaacacaaatcgcgcccactccggctgttcgtgcacccattcgacgtagctgtgcaccagccccaccacgccggcgtgcgccgtgtgcgcgtcctgcaaataacggtcgcgcagggtggcctggtcttcgagggcggcgaaaaacagcgcggcgaccaacccctctttattgccgaagtgatggtagatggcaccgacgctggtgtcgcagcgcgcacgaatggtttcgatattggtcgcctcgatgcccacctcgttaaagcacgccagcgccgcccgcaggatgctgcgcttgaggtcgctgcgcctgccgggaaaggtacgctcgataaggtcgatggggtgcatgcacacagacgccaaataaaaacagtttataggttcatccaccgccagagaaagcgccggttgacaggcatggaatttacagaatattgttccgttacagaattttattctgcaaaccaccttgaggatatcccatgagccaactgctcggcctgttcaatagcgctggccccgccgccttcacacaaatggcctgccaaatggcgccgtacttcagcagcatcgcgcctgagttcgcagagttgagcccgaaccgtgcggtggtgaatgtgccgtttcgcaaggagatcaccaaccacctggcctccgtgcacgccatcgcgttgtgcaacgccgccgagctggccggcggcacgatgaccgacgtgtcgattcccgccggtgcgcgctggattcccaaaggcatgaccgtggaatacctggccaaggcgaagtcgaacatccaggcagtagccgacggcagcgggattgattggcagaccgccggcgacaaaatcgtgccggtgcagatcttcgatgcaggcggcgtcaaggtgttcaccgcccatatcaccatgaatgtgaagctcgcttaggtcccggcctggctcaatgccccgccaccgcaggcccatcggctgaccgccgtcccggtttgaagccatgggcatgcgccgaccacgcgatcaccagcgccaccagcagcaatacgagcatcgcccagggaaatgacgcgacgccccagcgatccagcagcacaccgccgaccacgccgctgccggcaatcgcgctgttccaggccaccacgttcagcgacagcgccacgtccgcgccgtcaccggcagcatcggccagggcggtctgcagcagggtcgcggcaccgccaaagctcagcccccagacggccacgccgaggtaaatcacctgcggcatatcgcccgcaaaaccaaacaccacactcaccgccgcaaacgtcgccaggctcaccagcaccgtgcgccgcaacagcggctcgaccaacctggccgtcaaccaaatccccgccagcgcggcaaccccgaacaccagcagcaccacatccacacgactgcccaggccggctggcagcagaaatggcgcgatgtaggtgtacagaatgttgtgcgccagcatccagctgatcaccaccgccagcaccgggcgcacaccgggcgtggtcagcactttgcccagcgacacgcgctgatgcgcggcctgtggcgggtagtccgggactttcaccagcacccacacgatcagcaccagtgtcagcgccgacatgatcccaaacgtggtgcgccagcccaccaggccgcccagccaggtgccgaggggcacgcccaacgacagcgcaatcggcgtaccgaccatcgccaaggccagcgccctgccctgttgatgcggcgcgaccatgcgccgggcataaccagccagcaggctccacgccaaccccgccgcaaccccggcaaagaaccgcgccaccagggtgacgccgtagtgcgacgacagcgccgtgatggagttgaacagcagaaaaccgacgacggtcagcaacagcacattgcgccgacgccagccgcgcgtcgcgatggtcatggggatcaccgccagcaccgaaccgagcgcgtaggcggtgaccatctgcccggccatcgacggcgaaatcgccaggccggcgctgatcaacggcaacaggccggcgggcagggtttcggtgacgatgcagatgaaaccggtcatggccagggcgagcaaagcgccgatgggcaggcggtcggatgatgcggataagctgagagagggtgtcacgggagactccttgaggcgacttaaatactgatcgatacaaatgttgcgtgcagcgtacgcgcgttgtcaacaacttatgtatcgactagtatttatctcgttctgcacaggagattgcacatggcacaaatgggccgcccgcgtaattttgaccgcgaccacgccgtggaacaggcgctgcacctgttctggcagcacggctacgacgccacctccctcgcccagctgaaggccgggctgggtggcggcatctccgcgccgagtttttatgccgcattcggctccaaggaagcgctgttcgatgagtgcgtgcaacgctacctggcgacctacgcccaggtcaccgaatgcctgtgggacgaaaccctgctaccgcgcaaagccctcgaaaccgcactgcgccagtcggcgcgcatgcagtgtgacaacgggcatcccaagggctgcatggtcgcgctcggcgtgatgagcgcaccgagcccggagaatgcgcgagtgacgcaggcgttgacgcattcgcgcgcgcgaacgcgggcgggaatagtcgcgtgtgttgaacgcggcatacgtgccgggcacctgccgagcacgctgcatgcgccgtcaatggcggcggtgtttgatagttttctgcagggcgtttcgatattggcgcgcgatgatgtgccgtatcaggtgatcgacgcggcgatcagtcaactcctgctgacgtgggacattgccgcctctacgacgccgcccacgcgtcccgacgcgccattaaaaaatccacaaacgcccgcacccgatgcggcacataccgcccatggggatacaacaacgtaaacggtcgcgagcgcccgccaaacggtttcaacacttccaccagcgtgccgtcagccagttcctgctcgacgatgaacttgtaggtctgaaacagccccgcgccatgtttggccaaggtcacgccgcccagcacgtcatgggaaatgctgtaccccgcctgccccgcaaactcgtgttcctggccttgcacctggaacagccagggaatacgccggccattgctgggcagttcaaactgaatgcactcgtgcgacggcaagtcctgcaaggtctgcggcgtgccggcgcgttgcaggtaggccggggcggcgacgaccaccaattcggcgtcctccagcaaccgcgctatcaacgacgagtcgggttgggcacgcacgcgaatcgccaggtcatagccttcggcgacgaagtcgatattgcggttgctgatgtggatgtccacgctcacctgcgggtacagcgcgcgaaatgtgggtagcagcggcaacaagcggtgatgggcataggtggtcgggacgctgatacgcaattggccggacggcaccgactgcgcgcccatcacttcctgctgcgcctccaccaattgggtcagggcctggcggcactgttggaaaaacgtgcggccgctgtcggtcaggcggatgctgcgggtggtgcgcacaaacaggcgcgagcccaggcgttcttccaggcgcgaaatgctgcggctcacggcggccggagtcacaccggccacctgcgcggcgccggtaaagctactggcctcggcggcgaggcagaacagctcgatgctgcccagctgcaaatcttcgaaatggcgcttcatgattgattacaccaggtatcgataaacggagaataggctctatttaccaatacctggcgtacaaatacagcgctttgagccgcacaatagtcttgtggcgagcgggcttgccccgcgttggagtgcgaagcgctcccaagtcagccgccgaggtattacaggtgaaccgcgtcgtcaggttttagggctgctgcgcagcccaacgcggggcaagcccgctcgccacgaaaaggccgctcgccacaacaagcctgcttgccataacagattgggttaccgctagagcaacaaccgggaaaaatcgcagcaggcctgcgccatctgcgccacgtcctggttcaggccgaactggcggtccacccggtgcaacgccacgtagcgcacgcttggcagttccggttgcgtcaccagcgcacgcaatgtgccttgctcgatcaggtgcgacaggcagaccttgggcaaataactcacgccgatccccgacaacgccaacccgacctgcaccaacaggttgtggctggtgagcgtgcgcggcatctgcacgttatgcgcggccagccagcgctcgtagatcaagccggtgcccgactgcgcgccctgggtcagtacggtgtagctggccagcgtctccaggctgatcgggtcggcgtccgggaccagcccgggcgagcacatccaggcgttttccacgctctgcaacggcgtgctgtgaaagcgcgggtcgctgtagacctccggcacgatcaccaggtcgagctggtcgctttccagtttgcggaacagctcactgctgagctccaccgacggttcgatctgcactttggggtaggcatggcgcagtgcgtcgaccagggccggcaaccaggtgagcgccgtcaactcggtgacacccaggcgaaagcgccgcaccagcacttcgcgggcgctgacgcgttcgagcaaatggtcgcggctcttgagcaggtcgcgggcgtagtcgagcagttcgccgcccttttcggtcagccgcgcattgcgtttgctgcggtcgaaaatctccacatcgaaggtgtcttccagctcctggatgcgcttggagatggccgactgcgacatgttcagcttgttcgccgccgcttcgaagctgcccaactcagcgatccagtacagcgcgtcgatttgcttgaaggtaatcatggcggcggactcatgagaaaaagcgatgctatcacatcataaaatatcgctaaaactgtccgttcatcgctcctaagatccggtcatagcccgtcgctatccaacgattctggagatttgccatgtccttgcccggttcccgcatccttcccaacgcgccgatggcttcggccgagctggtcgaggcgtttgcccatgtggtcacgccgcatatcagcgacaacctcggtcgccacatcggcgcccgtgggctgacgcgctacaaccgcaccggcaagctggtcggcacggcgatcacggtcaagacccggcccggcgacaacctgctgatctacaaggccatgagcctgctgcaacccggccacgtgctggtggtggacggccagggcgacaccaataacgcggtgatcggcgagctggtcaagctctacgcccagcaacgcggctgcgtcggctttgtgatcgacggcgcgattcgtgatgtcgccagctttgaagacaccccgtgctacgcccgcgccgtggtgcacaccggcccgtacaaaaccggcccaggtgaggtgaatgtgccggtgtccatcggcggcatgctgatcaacccgggcgatttgctggtgggcgatgaagacggcctggtggccttctcccaggctgacgccgccgaggtgctgcgccgcgccgggcaacatgccgagcacgaagaagcggtcaaggccgagatcgccacgggcgccgtgcgccagagctggatcgacaaggtgctggccaacgccggcttggcgggctgaacatgagcactgcatttctttccgagcgcgtgctcggcatccagccgtcaccgagcatcgccgccaatgcgctggtcaccgagttgcgtgcccagggccgcgacatcgtcaacttcaccgtcggcgagccggacttcgacaccccggcgcatattctccaggccgccagcctggcgatgcacaacggcgacacccattacaccgccaccaccggcaccctcgcactgcgccaggcgatctgcctgaaactgcaacgtgacaacgacctggcgtacggcctggacgaagtggtggccggctgcggcggcaagcacatcatctatcacgcgttggccgccacgctgaatcgcggcgacgaggtcatcgtgcacacgccgtattgggtgtcttacccggatatcgcgcgactgaatgacgccacgccggtgatcatccctggcgatgaaagcctgggcttcaaactgtcgccccaagcgcttgagcaggcgatcaccccacgcaccaaatgggtgatcctcaacagcccgaacaaccccagcggcgcggtatacagcgaagccgaactgctcgcgctggccgaggttctgcgtcgccatccccatgtgctgatcatggcggatgagatctacgagcacttcgtttatggcgatgcccgccacgtgccgctgacgcgcctggcgccggatctgaaacctcgcacattgatcgtcaacggcgcctccaagggctacgcgatgaccggctggcgcctgggttttggggcggggccggcgtggttgatcgccgccatcgccaagttgctgtcgcaaaccaccacctgccccagctccttgagccaggccgctgctgtggcggcctttgccggtgaccaggcgcccatcgccggtatgcgtgaggaatatcaccagcgccgcgcgctgatgctcgggttgctggctgacatccccgaattgagcatgaccccacccgacggcgcgttctatgtgttcgccaacgtcagcgcgctgatgggcaaactcaccgcgcacggtgaaacgctgcagagcgacacccaactggtggactacctgctgcgcgactacggcctggcgacggtcagcggcgcggcgtacggcatgtcgccgtatgtgcgcctgtctttcgccagcgcgcgggacgtgatcgaagaaggctgtcgtcgcctgaaagacgcctgccacgacctgcgctgacacccttcgctgtacccggcggccaacggatggccgctgttttgactgcctagaacaacaacttaaaatcattgattacaaatgaggcattcctatgcacacgccccgcatcgcgctggtctggcaaatcatgatcggcttgctcgccggtatcgccctgggtgccctgttgcaccgctttcccgaatcccggccatggctggtggacaacctgctgcaaccggccggcgatatctttatcaagctgatgaaaatgatcgtgttgcccatcgtgttcgcctgcatggtggtgggcattgccgggcacggtgacggcaaaaccctggggcgtatcggactgaaatccctgagctattttttctgcattaccaccctggcaatcattgtcgggctgatcatgggcaacctgttcaaacccggcgccggcactgaactggccagcctgcaggcggcgaacattacattgccgaccagcaacggtggcggtcacagcctggggcaaatcatcgtcggcatcatccccgacaacgtgatcagcgccatggcccagggcagcctgttgtcggtgctgtttttcgcggtgatgttcggcctcggcgtgtcgcgcttgcccgccgagcgcaaagacccggtaatcgccctgctgcgcggtgtgtcggaggcgatgttcaaggtcacttcgatgatcatggcctactcgcccatcggcgtgttcgggatgatcgcggtcaccgtcgccaacttcggtttcggctcgctgatgccgctggccaagctgatcatggtgagttacctgtccatcgcgttctttgtgctggtggtgctcaacctggtcgcgcggttatgcgggatcaacttgttcgcgttgatgcgccatatcaaggatgaactcgtgctggccttctccaccgccagctcggcggcggtgatgccgcaactgatgaagaagctggaaacctacggcgtgccgccgtcgctggtgagctttgtggtgccggtgggctactcgttcaacctcgacggggcgtcattgttcctcggtatcggcacgctgttcgtggcgcagttgtatggcatcgacctgagcctggcagaccaggcgttgctggtggtgaccatggtgctcacctccaaaggcgcagccggggtgccggggtttatgtttgtgattctgtcggccacgctggccagcgccgggttgccgttggagggcattgcatttattgccggggtttatcggttgatggaaatgccgacgacggcgctgaatgtattgggtaatgcgttggcgccgttggtgattgcgaagtgggagcggcgtggggcagacactgcgtcacagagcgattcccaaacgcttcccacacgactctaagcaacaaaaatagccaggctcactgccacctctatatagtaacgcttcgcatttggcggtttacccaaggaacgcgcgccctcgcccagacggcgcgcgtcatcgtttagaaggatctttatgcaaagcgttacgctcttcccggcgcgcctgttcggtgcagcgatggtggtcgtctgcgggctgttcagcgcacaggcaaatgccgattacaccgaccgttccctgaccgtcgaaaaaaatagccaggcctacgtggtcaatcccgacggcagttttgtgctcgatttcgagctggtctcgcgcatcaatgaagaacgcgcgatcaagcccaacgcgcaacgctcggtgagcttcaatcgctcgctggaaaccgtggacatcgtggaggcctacacccagaaagccgacgggcgcaaagtgcccgtggctgccgaccagatcaaggaacagcaggagcaggcctcagccgaagcgccgatgttccaggactcacgcgtcaaagtggtgatctttcctgacgtagccgtcggtgaccgcatggtcttgcgctaccagcgccatcgcaccaccgcgatgttccccggacagtttgaagacctctacgcgccggacttttacgagaaccaacagatccacttcacctacgacatgccggccgacatgcccttgttcgctgacgtgaggggtttcaacgccgccgagcccaccaccgccaacgggcgaaaaatctatcgctgggacctgcaacccacggagaaaaaccgcgttgaagtcggctccgtcgcctacaccgattacgggcaacgcctcgccgtgtcgaccttcactgattacaaacagtttgcccaggcatatgccgccagggcgcaggttgaggtgacacccgccattacccaactggccaaggaactcacagtcaacctggatacgccgcgtagcaaagcgctggtgttgagtgactgggtgcgcaagaacattcgctacgtcgcggtttacgtcggcaatggcggcgtggtgccgcacgcggcgcaggcggtgctggataaccgttatggcgactgcaaggaccacgttgccttgctcgaagcgctgctcaaggcggtggccatcgaaagctcgcccgcgctgatcaacctcggcgacgcctacgtactgccgaaggtgccgaccctgggtttgcttaaccatgcgatcacttacgtcccgaccctcgacctttatctggactccaccgctacccccatcgccgccggctacctgatgattccggaactgggtaaacccgtgttgctgacccagagcggcgaactggcgcgtacaccttcaaaccaattgggcaaggtggacggcacgctgcacttcaagatcgacccgagcggcgcggcggacttcaccaacggcaccacggtggaaggctgggccacggaactcaatcgtttcctgttcaaatccatcatgcctgccgaccgtgatcaactgactcagaaagtcctcagcatgtacgggcaaactggcagcggcaagattgaaaccgaccccttggaaggcaatgccgccaccttcacgtcgacggtcaaagggcgtaccgagaacctggtcaacctgcccggccccacgggcgtaccgacgctcagcagcctcgcgggcggcatcggccagaacgtgttcagcctcatggcggaacaagaccgcacgcaggccttcatctgtacttccggcacgattgaagaaaaagcgcgcttcgacttccccaaacaattgaatatcctcgcggtgcccaaggctgtaacgctcaacaccggtggattcaactaccagaccacttacgtcaaggaaggcaacagcgtactcatcacccgcagctatgcgttcagccaccccgacgcgctgtgcagcccgcaggattttgtcgccatgaagccggcgattgaaggcatggtcaacgacctgaaaagccagattatcgtgcagacgctttaaccccgccttagcgattctcgcgcgacgggctgttgcaccgccgcgcgaggatcacaaccgttgcctctagaacttcgcctgcactcccacccgcagcgtgcgccccggcgccggcatgaaactctgcgccagtgggtccaggtagtagcgatcggtcaggttttgcagcgacacgttgaggctggcgtcttcctgcaacttgtagttaaggaacagatcgaccaaggccacttcgcggtaattcaattgcggcgtggtggcgccggtctgccagggtttgtcggcggtgacggtggggcctgaggtgtaggtgatgcgcgtaccgagcgtaagactctggtcgaagaagcgcaggcctgtggtgaggttgcctgcgaaccgtggcgggttctgggtgttggtgtaagaacccatgaagctgcccggcgtgcagttcggcgtattactggttttctggtagcggttactggtggcacgcagtgtggctgcgaacgccgcatcgcaggtttcggtcttcaggtagtaggtggacgacaggtcggcaaatacacgcccggcatcgtagcgggtttgcaattccaggccgctggtcttgtagctgtcggtgttgctgaagcgcatcaagccccacaagcccgggcttgggtcgtagtagcgggtgatgtagtgtttgatggtgttgttgaaataggccagtttgatcgccgccgagtcgtcatcgaacaacaaccccttttgcagtgcgctcgcgccgacctcccagttactcgaacgctcaggcttcaggcccttgccgggcatggtctgcaacacgccctggctggtttcgaacagcgaaggcatacgaaaacccagggtgtaggaggcgtagacgaaggtgtccggcagcacttcgatattgatgcccaccgccggggcaaaggcgccgccgctgttgctctctttgcgggaaaagtcatagccgctgaccacgctgccgaactgtgacggatagaccgtcgaatcgaccgcaccaaaatcgttatagcgaacaccttcaaagggatagttggtgttctggaaaacgatgccgttgttcaggcgcggatcggtggcgtcggtgtactggccgttctgatccgggaaccacatcatgttgccggagccgccagcgttgtagacccgcaggtagcgcaggttacgctcctgctcacgcgccgtggcattggcgatgtggtctttgctgcgatagtgggtgtaacgcccgccgccccataacgtgaggcggtccaccggtttgtactccaacttgccattgaagctgaactcttgccgcgagccttcgcgcaacatgcggttggcgttgatatcgtcctggttggtgaccacgcctttttgcgggcgcagctcttcgagctgaaacgagccgcccaggtccagtttcaagtcgccgtagtcggtcgcccagttcgaggtgttggccaggccgccgccaatacgctggttagcctgacgactccaggcgcggtccgaacgatacgcctgggacgccggcgcgcgtaccgaggtgagctggctggtttgcgcgtcggtgagccacaggtcggcagtcaggtccaccaacgggttacccgcaggcaagtagttgtaacgcgcggtgtaggtgtcgattgtggtgtggcccaaggggtactgatagatgccgccggtgccgaagcggaagatatccgaaggcatgatctcgccgatgcgcccgtcatagcggcggtaacccaggtcgaaagtatggccgtccgccgggcgcagggtggtcttgagcaggaacgattcggtcctcgacgaggagttcagcacttcttcgccagcgttgtaggtggttgccacgctggtttcttcatcgccccagcggtcgtaggtgcggtagcggtcctggccctttttgccggcgaaataattgccttggttgcgcttggaataggccgccacgacgtcgaaaaaatcatgggtataggcaaatgccgcgctgccggcctgcgcctctgagccgaacagcccaccgcgactctggtgcggttccgagtacaggtcttcggtcttggaatgcgggtctcgggaggctggagcaacgccgttgttccacaggtcgcccttgaggcgcaggccaatggtctggccgtccttgaggatgtcgtcgaccgtgagggtgcgcattttcaccgtgccgccgatggcgctggaggtcaggctggggcccttgtcgatcgtgacgtcgctgatcatgtccgggtcgatataactgcgctgctgcgtgccggcataaccgcgatagacatccagcgcctgctgcgacccatccaccgtgacccccacccggctctggccctggatgccgcggatattcacatccagcccgccaccattgcggctgtcgccgacctgcacgcccggctgccccttgagcatatcgcccaccgagaccacgccaaagcgctgcatgtcttcgccggagatgtacaccgatgagcgcggcgcgcggtagacgtcttcctcgtcaagattttcgcccgtgaccttttgcgtcggcagcaggactgcaccttgaagcgcacgcaagacatagccgccgtcggcctggcgctgatagcccaggccagtgcctgagagcagttgggtcaggcccgactcaatgttgtactccccctgcagcccgtggctgttcttgtcggccgtaagcagcgcactgcccgccatgctgatgcccgcctcggcaccaaagcgcgacagcacttgatccagcgggccggcgctaattcggtaagggcgttcgccggccgcaaaaaccagctcgccgtagagcggctgtaaactcaaaaacagcaagctgaatgtatgggtacgcaagacacgagcgggtgaaatcatgcaaggctcctaggggttgaaacccacctgtgccggtgggtaatacctaaaggccaagccagatcgaaaaaactatcgcgtcgcgaaaaaaaaacttcacgcagacaccaacgtcacccagtaacgcgttcttcgctcgatacgcaccggcaaagtgttggcgaccaacgcgagcgcagcatcggtatcgtccagctggaaactgccggtgatgcgcaggcttgccaccgcctcgctgcaacgcaataagcctgggcgatagcgcgacaactcagccaacaggcggtccaggcgcatgcgctcggcaggcaggatgccacgcatccaggcctgggccagcacccgatcgacggggctcgggcgccctgccccacgctcgtccacctgcatctgccagcctgcctgcaacggcaccggcgtgggctgatgccgcgtgctcacttgcgccagcccgcgcaacaccgtcacctgggtgccttggcgatcatgacgcaccagcaggtgggcgccatggctgtagagcaccgcgttgggggtcagcagttccagcgacgcagacccggccggggtatccagggccagctcgccctcgaccagctccacgctgcgttgccctgcgcccaagtccaggtttaccgcactggcggtgtttagccacagcgaatagccatccgccagggcccagtgccgccgctcgcccacacgcgtgcgatagctcgccaatgccgaacgcaccaacgtggaatccgccgtttgccaggagatcccacccagcagccccaacgccagcaaacacttgagcacctggcgacgacgtcgcgggtcagccccggccgcctgcaacgcccggcgcgccgtggcatcggctaatagatcggcgcccggctgaagcatcaacggcaagctgcttacccgctgccacgcatgctcatgctcggcactcgcctgacgccactgctgcagcgcttgataatcaccggcgctcatcaacccggactgcatccgcaccagccaatcgattgcacggtcgcgcacgcgcgggtcaactgcagcgcccctcattcaaagcgactcgcgtagcacacactgaatgccttgcccatggcccgctgcacctgggccaccgtcaggctcaactgcgcagcgatttgcggataggtcaggccatcgagctgggacaaaaagaaaatctgccgaacccgcgccgacaaccccaccagcagcgaatccaactgcaacaaggtctcaatcatcaggtggcgctcctccggcgaaggctcctcagccagcggccgcgccgccagcgcttccaagtacgcccgctcgatcgcttggcgacgccagcgattgatcagcaagccattggcgatggtggccagaaacgccatgggttggcgcaactcgcgcacatcctccttggagcgcaacacgcggataaacgtgtcgtgtgccaggtcttcggcatcggcactgtgccccagccgccgatgcaaccaaccccgaagccagccatggtgattcgcatacagcttggcgaccggcgagacgatgctgtcgtcgtgcatgtcagatccgcctcaaatgataattcttctcatcttatggcttcggggtgggcgttgtataggggttggggtggctgccatgagacgaatttaaggcaaaaaaacatgcatctctgcaggatttttactatcacaaaaacagcaagttaacatgcacgttcgaccacttttcgaacagtataatcagcattcctccgcgcccaataaaccttgttgatatgctgcgacacgaaatgctttctaagcgccgccatcgcaaacacacagtcaccgaacggaaagcaacaatctatgatccacgttttactcccctcatcccattcagattcatgaagtataaagtgcggatcttttaacagacgggcctcaacgtccgcagccaggttcgcccaggtaacataaccaataggattatcaaagctatcgaagaaaagcatgatctgcttgtgttggatggcgggcatcagccagactcttagatcgatcaatctatacagacaatacgttggactttgcatcgcaatccacaacgcaaaaccaaatgactttgcctggtcctcatggctgctttttcggcacaccgagaatattttataccgttgactcataaaaaatttttaccccatcgccatagaaagaagccgcacttttcatcaggcttacggctgcctcaacttcaaaaaatgcacctttaattattgcatctctcccaggaacttcagcgataaaaagatcgcttgccgcatcataatagattgttgtggttgcgtttttccaaaacaaggtgcgagtacccgtggaatactcatacgccaaacacgctaaatcgatggcttcctgaaaaaccccatcgtactctgccgcactcttttcagtcttcgcggccagacgcgtttgcataattttttcttgcaagccgaataacaataaaccgcacctattcaaccgagttgcattaatcgtcatcagcttgcaaaagcttgagtacgtcaccccagacgtctcagcgttacgcaacacaagatcaaacagagcgtcatacgcacctgtcaatccattgagtaacgcctggtcttttgaaacccacccaaagtcctcttcggattgataaattttacgccgaagaagttgcagataaagcttggaaacccagtgttcatgcccctgccaaccctcgctcgttgtgattggagtgacggaatactgatccaccctcagcacccgatgtataaatccggagtacgccaaaaaacaaacatcgccggataaattttttagcatcgcaaaaggaaagcctgcctgcgcggcgtggtagagtgagagacttctctcatactcgcttttaaatgttccgacggcctgttcaacgattgcacttgtagacagcgccgatatcacgccatacttgcacaagtaaaagcacatatctcgaataccacctaatgccgactcgtactccgtcaaaaactgcttgatattaaagccttcccaccagaccttatcggaaaacactgtggcgcctgccaagtccatccaggcaccgctgagtgttacattcgatgaactaatactctgatgaaatatccgttttgctcttgccgccgcaaactgctgggcataccgtgtcgccagctcaaccatgccctggcaaatgcgctcattcaaatcattagcgcgctgttcgtcgtcttttacaggaaggaaatcaacaagccgatgtatcgccagtttgacacgcttggcatcctcactcagcacgtcacgctttctctctttaaagtaaattgcacgaataaaatgggcgggccttacggccggcaaacgaactaacaagccacgaggaagcttctgatctggctcttcaaaatcgatttccgaatctatcactgccaccgtccttactgcgccgtaaggcagagcaatgttaatgacttccgcccaaatagactcgtaaatagcaacgtccagcgacaaaaagccattggcatgtgaattaccatacgtgtcccgaggcctggtcccgaccagttgattaggccccaatccttttaagtgaaaaaccccatcaaaaccacagcggcctccgccaccattagtgcaaatcccatcgcctccatatcgctctgcaaaaaaagtcttcctgtccagaacgttgtcacactcggcagccgtatcaagggttacataattatatttggacagtagctccgacgcgtttagttcatatccaaggttttcatggcagtagacaaccctgccctttagagccttaacggtttcaaacgccacaaacacttccggcaaatcactcaatgttaattcgggcatgacaccgccttgcagtagggaaaatccgttagcactttacagttcaccaatgggtgtacgtactgcgtcagacaacgcaagcgccccatcaaaggatatcaatcgatccgtcgttgctttccactcagcgatgttagggtaggcatttataaaccagctcaggttttcacacaaattgccaaaggcggaatttatctgcatgacgtcaccgaacatgatggcccctgaaaaaaaacgcggcaccgccagtaagctactaaagaccagggagagttggctataactttccgtgaacaatgacaagcgtacctttacaccaatggtatgacgcatgttagccagactaatatcaagtttgtcactgatgtgttccttttcagaatttcgcgtggcgcaggcaacgcctgtcttttttcgatcgcgaaaacgcacaagaaaataacgaaggtctgcttctgacttttgttgcttgttgttcaaggagactaacttgaagcctattttctgactgacatacatccccaacattgcatatataattgccgcccaaaacatatacgcaggcaccgtcaccccccacaatgacgcactccccgaaatcgttattaacaccacgctgaacgacacaatgctggccagcgtataaagcagtccgcaggccagataaaccgtagaaaacgtaaatttgttaatgtcttccgcaatgcgctgatctgggttgtcgacgcgacgttcaagttggtcaggctgtggagattggataatccaagcacataggtaatggttagtcagccatcgacgccatttgagcgcaataatatctaccagataggtcgccagcactgaacgcaccaccgaaaaacagacaatccccaaaaaaaccagggctagcgtgtaaaacctgtgagcgttcagctcctgaatagcgttatagaaatgcttgtaccactcattgagtgccaatgccgtcgcaacccccgacagtgagagcgtcaccaaagcaaccaatgcgcaccaggcaaacgccttctcttcggacttccaatacaatgaaagcaataaaaatgtatttcgcaaaaaactactttcgttaaatcgtgtcgcatccatactcgctgtatcggcatccatcatggcttctcggtttatttacatttatatttttaattttaatttaagttcaaaacactgatacttactttcaacgatcggcgtctatagcgcccaaaaccccaagcggcccaaactcgccgccaatttcaaacgcgccatttgccaactgttcagtgcaccgatatgttgttgctccgctgtcgcatacgcggtcaacgcgttaagcaattcgagcatgctgccgacgccggatcggtagcgaccttgcaccacctccagtgcctggttggattgctcgacccattcggccgttttttccagtgatctggtttcaatgatcaacgcttggtagttactccacaggtctatcgagatccgctgctcaacatcgctcagctctgcttccctggcctccagttgtgcctgagcaccgcggatcttgtaagtacgctcgaacccttcaaacaaagggatattcagttgcagcccaatgctgttgtcacggactcggctatcgccgttgaacgccattgactggttgagccgcacgtctgacgcgttggcgacaaatgacaacgtaggacggccttcagccttgctctcatcaatggctgcttttgctgcatccagccgggcctttgcagccactagcgaaggatgatcctgcttggcttgctcaagtaactcgtcaatgtttttgacaaaacgggtatccggacgccgcgtcagacttcctgccaactccagcggtgtttgcggtgccagccccatacgcagggctataaaacctttggcgttgattaaagcgccattgctgcgtatctcattgagcgctgcctgcgaataggcagcttgagcctgaaggcggtccgagagcgcggccgcgcctgcctcatatttggcacttgccgcctcgaggttttcagcggcgagcgccgccacttgagcagcggcgatttgactgttttgtgcggccagcgtgtcgtaataaagctgggcagcgagcacaaatgtttcctgcaattgctcatcttgatcggcgtttgcggcaaccaataactggcttgcattacgcaacgccgcatcgcgctggccaaaatcaaacaacacccagctaaaggccaatcgatgatcgacttggcttttgtggccgtggctggagttctctccacgctgggcatagtccgtatcactacgacccgcagtaacaccagaacttgcgtttaaccgaggtagatacgccgactgacgtgcacctacgttcgcagcctgggctctggcatttgcccaattcagacgcgcctggggatcgtgacagagcacacggccgatcatgtcctcaagcgttaaacgcgcaggcaccgggccggcatcacacgcgcctggcgcactgtcaaaacgttgagttgcagtgcctgagaccgtgcgctcagtcgaaaatacatccagaggtgcagccaggcaggacgaagaccaggcacccaaacaagccagcatagttacgatgcgagcacttcccatcacgaggtggccttgtccatcacgggcatagagcaggcatcgacagcatggggggcaataatccgcccctgctccagcaccaccactcgatctgctgatgcaatcgtctcggcacgatgagcgataataatccgcgtcacctcaagcgctcgtaccgcgtcattcacttgacgctcgcacgtcatatccaaatggctggttgcctcatcaagaattagcacatcaggcttcttgtagagcgctctggcgagtagtacacgctgtttctgcccacccgataacaccgtccccatatcgcccaccaaggtgttgtatcccatcggcatggcaataatgtctgcatggatagacgccatgcgcgcgcactccatggcccagtccagatcagggtttgattcaaaaaatacaatgttgtccgatagcgaaccggcgaataggcagtcgtcctgcatgacggttccgatcttgccgcgaaaccgctcagtacctaattgctgcaggtcacttcctgccatgagtatccgaccatctgtgggttgcaggatacctaacagcaagctgacaagcgtgctcttgccactacccgatacgcctgtgatagccaccgactcgccttgtgcgatgtacaaatcaacgccattaagcacaaaaggttcttggtcggaataccgatacttcaagcctttgacctcaatgtccactgggcatgagggccatgttgcgcacttgaatgtgtctcggccgtcttccggaggatgcatgacaatgtcggccagccgctcaccttgcagacgcaacatatagagctcaaatacatgatcgatcaagtttgcgacacgactgacaaactggtttttgtacgccatgaacgcgatcaacacgccgacagtgaactggttgctcatcaccattgatgcacccagtccgatggcgatcaggttttccagcccaaatatcaaaccgttcaactgcgtgtagatcaactgcaacttctgcgttctcaaacccgcgttgatctgttctaccagcaagccaagccacgcaaggcgccgttcattctggcgctggaatagtttaattggccgcatgccccgcaccgtttccaaaaagtgactttcctggcgagcggcatgcacaatctgctcttcacttgcacgacgcaatgggctgtaccacgcccatcgaaccatgacgtacaagaccatcgctacagccgcaattgctgccagtaaggggctataaataaacatgagcgtgaaggtcgcgacggtcatcatgccatccacgacagcggagaaaaatgccgcggtcagggtgccctgtatcacgtcgacagcaccaaagcgtgaaacaacatcccccagatggcgtttctcaaaataatggatcggcagccgtaatagatggctgaatacattggctcgccattgcacgctcaacagcgtgctcatgtgcatcattacccaggctcgtatggcgctcacgatttgctgcatcagcaacaataaaccaaacccgataatcaacgttttcagcagatcgtgatcttgggtcaccagtacgttgtcgagcgtccattgcaacaaaaacggactgaccagcgaaaatacttccagtgccaaggccagggccaacacttgcccaagcgagcgatagagaccactcactcttcccagcatgctcattaatttaacctgaggctcgggctcctgtttttcaaagtccccacccggccaaacttcgagtgctacaccggtaaaggacttaccgacctcagccaggctcagacgtctaacaccactggcagggtcatgcacaacaacgcagtggttttctactgccttgagcacaacgaagtggttgaaattccaatgtaaaacacaaggcaacttgagttttcccaagtcatcaagttccagcctgacagcacgagtgccgaggttcagtctgtcggcagtctggatcagttgcttgagtgtactgcccttaagcgacacgctgaactcgcggcgcaggtccatcagcgttacgtgacgcccatgaaaccctgtaatcatcgccaggcaggcaagcccacactcggtcgcctcggtttgcagaatcaggggcaggcgtctgcccagtcttagagatatcgcatcgagatagctcatgcagtctctcctagagtttgccggtcaggctatagagtggttcaagcacccactcatagagtcggcgggtctcctgcagaatgtctgcctcaaccaacatgccggcttgcagtggctgaggtttgccgtatgccacgactgactgcgcttcgatatcaacacgaatgcggtagatctgctcaccgtccaggcccagcccgggtacgctgccggtcatcgttgccagctcattagccgacagcgttgctttggagatagagataacgctgccactgtgttggccaaacttttggtacggatacgcctgataacgcaccctcaccgggtcgccgtcatgaatgaaaccgatggccttgctcggcgcgtataactcggcttgcaagtgagagtttgcgggcacgatgctcatcaagacgcgcgagctatcgaccatctggcctggctcaacaagaatcgcagtagccacgccatcctgaggagccgttatgactagggcacgcttggcttcgctttcaatcaattcctgttggactccagacagtgaacgctgaatgccggcaagctggttttgatgcagtgcagagaggcttgcaacttcgtgttgagtttccaccaactgctggttcagcaccgcagtttcgcgggccagcccttggagagtctggtgttggcccaacagttcggactgtcgttgttgaagctgatccattgagatgtagcccttgtccatcagtccttgataacgttcagcagcattggttgccagttttacaagcttctcctgactggccatctgctgcgccagagttaataactgtcttcgcagactcacgagcttactttgcagactttgccgctcttcagtttgaagttgctgtttcttggtcaattcgtcgttcaaggaacgctgccgaatgacaagctgatcacttacgtctgcctgaacgggccgtgaatcccctgcatagcgctcactggaaattcggaacagcggtgctccctgcttgaccggttggccttcgtcgacaaatcgctcaaggactaatccgtactgaggtgcgtatattttaagttgccccgaaaagggcaccaattgtcctgggacagtcatgcgcttggtgtaagtaccccagagaaaaaaagtcaccaccatggcggccaacagcacggcaatcatagtgaggatggcgaaagacacgggcctggcgagcacgatttcccctagccagttcgcatgacgagaggttactgcctcgcgccggaacaacggtgtttcggagctcaaaactcacccctcatctttcatccttgaatataaatctgggtgaagcaccctccgtgctggcagagatatccagctgctggacggagcgtcacgtcacatgaaaaaaaaaaacgaaaaaaaagtaaatttcagccatccccgttcgtaacaccctatgaacgcagggcgtcactacgaaaacgcgtcaatatttcaatactgttttcaacaccaatatcggacgagtaaacgcaaggaacagcgttctgaaaattacaaatcgagagttggaagtcatcggccttttaatacacggtctaactaacaagcagatcggccgagaactgggtatcagcaaccacacggtcagagaccacatatcatcaatgttgagaaaaacaaacaccaccagccgcgtcgagctggcagtcgtaatgagtggaataaagaaaacgctctgactctgtggcgttattcacaccaaggtttttaacgtttgacaggcctttgattctcgcacgcgggagagatgccatcgcttaatagttcacacgatcatgcgctttacttcacccctccaataagcgtcgggcgcatagacagcctgtacctgcccttctacaacaggcaggtacagttatcacccaacttagacagctgctttattacggcgcttcacttttctaaatgtgataaccacaaccgtcatcacaatggaataaaaaaacgccatccccacgcgctgcaaaaagctcccattgctcaagccagtcagattattcaaaacatcaagacaggtgtaaaacaacgaaaacaacattactaccatcttcgaagtttcaagcattatcgacttcatatttctcccttggtcgctaccgccggtagatggcaggcattttagataaacatgccgacacctcactttccgttagttgcaccgccggacgaaaagccgtttgagacgattacagacactacgtaggcagctccgcccgtcgccccgcccgcaacagcgcccggacctgcgcctatcccgccagccactagcccgcccatagcacctgcaacagcgccggcagcgaccgccgctgccatatcaggatagctgaacggtgcaccgcctgagataagcatgacttcgttatccgtaagcgctcgcatatagttcccttatgttattgattcgaaataaagaaaccaaataataacaattttcgcttttccatggacccctacacctgtagggcgcgaaacttgatgtgcacgacaatgtcagggaaatccacaccctaccctcttcacatttgcgcaccagcgtcgagcactgcgtgtcgacagactgaagaaatccaaggcaaaaaaaagcctgcatctctgcaggcttttctctatctggctccacgacctggactcgaaccagggacccaatgattaacagtcatttgctctaccaactgagctatcgcggaatgcgccgtatgttactgattaaaaagaagaagtcaagcaccgagggtgcattcggcgaaatgcctgcaaatcaccgctgccaccctctacaccgggttggccatttccttggccaaatccagccaggcgcgagccgcgggtggcaggtgtgcgctggcgcgccaggccagggcgatgtgccaatcggtgtggggttcgtccagcgggatcagggcgatgccggggtgttggtgcttgtgcgcaagcatgcgtggcaggaaggcgacgcccaggcctgcggacaccaggtcgacgataaagtcgatttgcccgctgcgcgcggtcacccgtggcgtgacgcctttgcgttcgcaggcagcgaggatcttggcgttcagggcgaagccggcttcgaacaggatgaacggtgagtcggccaggtcggtgaagtcgatgcgtttgcgccgggccagcggatggcttatcggtaatacggccatcagcggttcattgcgcacgggttggtagtcgaacccttcatccgccggtaataacaaggccgccaggtcgacctcgccggcttccaggcattcgcgcaggcgtttgctgccgtattcggtgagttcgatctcgatgtcggggtagcgcgtgcggtaagcggcgaacatcgccgcaaacaggacgccgcagcccacgggcggcaggccgatgcgcaacacgccgcgcttgaggccgcgcaggtcgttgatctcggcaaccaggtcgctctgctcggccagcaataccagcgcgcgccggtaggcaatttcaccggcggcggtgagttcgttgcggtggccgaggcgattaagcagcggtgtgcccaattcatcttccagcgtcttcaccgccttgctcacggtggattgggtcaaggccaccacgtcagccgcttgggagaagccgccctggcgcaccacttcaacaaaggcacgcaatgttcgcaggttcatcggtattcctttagcgactggatactagtaataaaagttgtttttatcatgccagctttttgcttatggtgaagcgaccttgcgctatggagaacccgttcatgatcatctcgtccgcctccgactaccgtgaagccgccaagcgcaagctgccgcgctttctgttcgattacatcgacggtggcgcctacgccgagcacacgctgcgcgccaacagttcggacctggccgagatcagcctgcgccaacgcatcctgcgcaatgtcgacaacctcagcctgaaaaccaccttgttcggccaggaattggccatgccggttatcctcagcccggtcggcctgacgggcatgtacgcgcggcgtggtgaggtgcaggccgccaaggcggcggcgaacaagggcgtgccgttctgcttgtcgacggtgtcggtgtgctcgattgaagaggtggcatcgcaaagcccgcagtcgatctggttccaactgtatgtgctcaaggaccgcggctttatgcgcaacgccctggaacgcgcgcaggcggctggcgtgaccacgctggtgtttacggtggatatgcccacgccgggggcacgctaccgcgatgcgcactcgggcatgtccgggccgttcgccgcttcgcggcgcatgctgcaggccgtgaccaaaccgcaatgggccttcgatgtggggctgatgggccgcccgcacgacttgggcaatatttccaaatacctcggcaagccgacgcacctggaagactacatcggctggctggcgaacaatttcgacccatcgatcagctggaaagacctggagtggatccgcgagttctggaaaggcccgatgatcatcaaaggcattctcgacccacaggacgccaaggacgccgtgagtttcggcgcggatggcatcgtcgtctccaaccacggcggccgccagctggacggcgtgctgtccaccgcgaaagccttgccgccgattgccgaagcggtaggcgatgacctcacggtgctggtggactcgggcattcgctccgggctcgacgtggtgcgcatgctcgccctgggcgccaagggttgcctgctcgggcgcgccaacgcttatgcactggctgccgatggccagcgcggggtggaaaacctgctggatatcttcgccaaggaaatgcgtgtagccatgacgttgaccggcgtcacctcaatcgatcagattgaccacacaacgttggttcaatcagccaaataaccggcgccattcgctcacggccgtttttgcctttaaaaacggtcgttgatttataaagagttttaataagttaaacgaagtggcatgaatctcgctctaaccctatccagcaggttaagcgatgacaagacgtgtggcagggcccaggggttataaccccgggaaaagcggtttaaactgtttccaatgttttacggaactgaaggaacagtaagacgcttggcattcgccactctcatcgagcctgtaagacagttaagtgcttagaggccgtcagcttatgaaatcaccgacccagaccaacgcaattgacttcgacagtgccaaattgcaacgcctggggtttggtcaaccagcccttcgtccccgccgccccgtcaccttcaacgaactgcgccagcaactgggccagcaattgcagaccagcctggaaccggaacgcatccttggcctgttctttcgtgagatccagcgtctggtgcccttggacgccttgcagtatcgccatgaagccagcgacctgcgcctggaatttggccatcgcggccaccattcggtgagctacaccttgagccatgaaggcgagcatttgggtgagctggtattccgtcgcaatcaacgcttgatggatgacgaactgagccaattggaagcgctgctggccaccttgctctacccgatgcgcaacgccctgctctaccgcgccgccacacgcagcgcactgcgcgatccgttgaccgaaaccggcaatcgcattgccatggaccagaccctgcaacgggaaatcgacatggcacggcgacacatgagcccgctgtcgttgctgatgctggacatcgatcacttcaagaatatcaacgacacccacggccatgcggccggcgacaaggtgctgcgcgccgtggccggctcgatcaaagaccagctgcgcaacgtggacatggtgttcaggtttggcggcgaagagtttttgatcctgctgtcgaacaccggccgggatgccgccagcatggtcggcgagcgcttgcgccgggctgcacaggctcaggattattgggcggatgacaccaagattgaattgacggtgagcctgggttgctcaaccttgctggccgccgagtctgccgacagcctgctgcgccgcgctgacagcgccttgtacgtggccaagcgcgaaggccgcaaccgcttggcaatggcggggtaaacaccccgccatcacgcttggatcacgcctcgctggcgacgcgtgcctgacgctcgcgaatcgctacgggcgccgtttccttggctttctccttctccaaccgcatgcaactttccagaaacaggaacatgtagtcgtagctcttgcacacggcctggcgcagttcttcctgcagggttttgctcgggttcatccccgccagggtgcagatgatttccagggcttcccacgggtgggcgtcgtcgtactgggcatgcatcttcagccacttcatcgcgcgcttgcgatcttcctcagggaaggcggccgcatacacgccggtcgaacacaccacggcggaccactcccccgtcgccccttcgattgcgtagttggtcgcagcaatcgccacgatcaatgaatcggccgagctggtatgccagcaccagtgactcagtgcgtgcaattcaggcggtacgttctgcgcttgcagctcttcaaggctgacgccatgggcgcgggcccaatgtacccaataatcggcatggttcagttccacgcgaatattacgcatcagccagcggcgcgccatatcctccccaggatggcgggcaaacttggtcttggtcaggttttgtgccatgtacaaggcaaactgttctaccactggccagccaccgataaggtaatggcgcatggtcttggcgctgagcgtgttgtcacgcatacgctgatacagttcgtgctcgacaactcggcgcttgctctcgctacaggcctggatcaattgctgcgcccaggcggggtaacttgaggcttccataagcgggccggttctgttgaaggtgtcgatcactgtaaggctcctttttaagtgtgattgtacagaccagcagttgtttcagcggaatgtgccgggcgccttgaataacagaggctgcggccgcacaggtcgacactgcaagctatcaaaggtaaacaattgcgggcgttcaatcaggtagccctgagcgtaatccacaccaatctcaagtaaagcctgttcgatctgtggtgtttcaacaaactctgcaattgtgcgcttacccatgacgtggccgatgtgattgatcacttcgaccatggcgcggttaatcgggtcgtccagcatatcctttacgaaacttccatcgatcttcaggaagtctacaggtaaatgtttgagataggcgaacgaggacataccggcacaaaagtcatcaagtgagaaatgacaacctaacgctttgagttcattaataaaacgaatggcgctacccaaatttgcaatagcactggtttcagttatttcaaaacatatcattgccggtggaatgttataagccgcgaattgctcacgtaaaaaaccgagaaaatcgtcatcgccaatggttatacctgacagattaatcgcacacatcgccattggccggcctggccgctcgcgtaaacagttggcgataatcttgaacacgttctcgaccacccaccggtccagcgacgtcatcaggccgtagcgctcggccgccgggataaaactgtccggcagaatgatccgaccggcttcatcgtgcaggcgcagcagaatttcgatatgcccattgccgccatcggtgtgccccaaaggcgaaatttcctgcgcatacaggcaaaacctgttctcctccaaggccatgtgcaggcgctgcacccaggccatttcgccaaagcgcagagacaactccgagtcatcggcatggtagacctgcacgcggttgcggcccttttccttggccatgtaacacgccatgtcggcggcgcgcagcgatgtctccagggtggtcggcgtgttcgagatatgcaccaggccaatactgacggtggtcatgaacggtcggcctttccacacgaaatgcaggttttgcacggtatggcgcaggctctcggcgattttttccgcgaccggtgccgggcagttctccagcaggatgccaaactcgtcgccgcccaggcgggccagggtgtcaccgtcgcgcaggtccgattgcagcaacgcgcagatatgccgcagcaactcatcccctgcggcatgcccgcaggtatcgttgaccagcttgaactggtccagatcaaggaacatcaaggcatgtcgcgggttttgctggcgcgccacctgttgcagcacctgttccaggcggaactcgaattcgcgacggttggccaggcccgtcaaggcatcgtgggtcgcctgccacgacaggttggcaatgtattggcgctcccgggtcatatcgtgcagcaccagcaccgcgccactgaccttgccggcgctgcggatcggcgcgcccaccagcgtcaccgacaccgtgctgccgtccacccgctggatcagcttggaatgctcgctgccgccactgaattcgcccttgataatgtgctcgagcagcgtaaatccatcgggctcggcattttcatcgagcaggctgaataacgccgccaggggcaacccttgggcctgggccgacgtccaatgggtcagcgcctcggcggccgggttcatgtaggcgatggcgccgtcgacgtcggtggtgatcacgccgtcgccaatcgattccagggtaatctgtgcccgctctttctctgcttgcagcgcattggcgaacgcgtggcgctgggccagcaatttgtgcgtgcgcagcaacgccagggcaatcaggcccagggcggtggccaggttggtgatcaacagcagccgcaggatgactcgcgagccctcgcccaaggcatcgctgaacgccttggcggccggcgtgacgccatcgttgatagcggtgatgcgtgccttccagtcctttacatcgctgctgctgacctgattactgctgatcgcccggtgcatcgcctgggccaggtcatccaattgcaccaggtaaccatcgcccacggtccatagttcaatggctttttccaggtagctgaaatggcgaaagttgaggtacagccagatcaggctggaaacgtcatccgggtggttgccgcccttgaggatcccgtggcgcgccgcaggcaggtcgggtgtggggcggtccagcgcgatacgcaactcatgcccgccttggggcacggcgatggcttgctggtacttgaggtaggtggcggggtcgcgattatcggcgtaaagcgtcaggtagtagatggcgtctttctggcccttggaccacaggctctcgcccgccacatacccgcgcaccgctgaaagcacgtagagactgacgcagcctaacaatgcctggaacagcacaacggcgataaagggccagacaatgcccagcagccgaggcgttccgagagtccgcttttgcttcatgaagtcccttgcacatgcacagctgaatacgcacgcgaaaatccgctcctgatagcacagcctaggctaattcagcgcacttgttgcaaatgcccatagagtttggcgtacaacccgccctccgcgatcaattgctgatggtcgccatcctcggcgatatgcccgccatcgaacaccaacacgcggtcagcctgcttcaccgccgacagccggtgcgcgatgatcagtgtagtacgcccactgagaaaccgtgccagcgcctggtgcaggttgtactcggtcgccgcatcgagtgccgaggtggcctcatccagaatcaccactttcggctcagccagcaccatccgggcaatggccaggcgttggcgctggccgccggaaaaacgcacgccggagcgtccgaccacactgtccaggcccaacggcaatgccctgacggttgcgtccaactgggcgatttccagcgcctgccagcatgcctggtccgaacgcgtgcggcccatggtcaggttggcgcgcaccgtgtcattgaacaacgccgggtgttgcagcaccacggcaacgttctcacggatggtcgcaaggccgatttcctgttgggtcgcgtcgccgaaacgaatgctgccggcctgcggggtgtagagcccgagcaacagttgcaccagggtacttttgccgccgccgctggcgccgacaatcgccaccttctcacccggcgcaatggtcaggttcaactggttgagcaccagttcttcgccgtagccgaaatccagcccgcgcacctcgatacccacggtctcacgcccactgaacgggtctgcaccaccggcgtattggggctcgtcggcacgcgccagcagctcgttgatccgcgtcagcgcgccgcctgccgcgtagaacgcatattgcaggttcagcagttgctccaccggcccgatcatgaaccacaggtagctgaacactgcgagcatctggccgatggacaggtccgaaaacagcaccgtgagcatcgccgccgcgcggaaaatgtcgattccgaactgaaacaacaagccactggcgcggctggaggcgtcggttttccattgcgagtggatcgcgtagtcgcgcacttcctgagcgcgctggcccaggcgcccgaggaaaaagccctggcggttgccggcacgcacttcctggatggcgtcgagggtctcggtcaatgcctgggtgaagcgcgacgtgctgtcgttctccagcttcttgaggtgtttgacgcgcttgcccaactgcaccgtggcgtagatcaccaaagggttgaacagcaggatcaacaacgccagctgccagtgcatccacaccagaatcgccgaggtgccgaccagggtcagcatggccaccaggaaacggctgagggtttcgccgacaaacttgtccagcgtgtccaaatccgtgaccaggtgcgtggtgacggtgccactgcccaggctttcgtattcgccgagggaaatgcgcttgagccgttcgatcaggcgcacccgaatgcggtacacgatgtccttggccagccgcgcaaacaaccgcgcctgcaccacgttgaacaccagcgcaccgcaccgcaggcacagcgtcaccagcaacatcaggccgatataaccggcagccttctgccagcccaggggcaatgcgttgttcatcaccttgagcgccgcatcgccacggcccagcagcacttcgtcgaccaacagcggcaacagcaacgggatgggcacactgcacagggtcgccagcacggcgacgccattggcgatccacagggatttcttgtgccgcagggccaggcggcgaatttctgcccaggtcagtcggtcggtgcgttgaggttggtcttgcacaggcgtgtcatgcacaggtggctcgctccagccatcgggcgagcaaaggcgacagctcggacagcggctggtagccgttggtcagtagcgccagctggccattacgctcggccaacagggtcgggaaaccggcgatacccagatcctgcacccaggtgaaatcggcggctgtggcggcatgctgctcggcacggtcgaacgccccggcgaactcgatgcgcgggatgccagcctgctcggccagttcgaccaacacgctggcgagggtcacgtcgcggccctcgacataaaacgcgcgctggatcagccccaacagcttccaggcgcaatccggtgccaggctgcgcgccgtgacgatggcccgacacgcaggctcggtgtcatagacaaagccgtcgggcaacgcgccgtcacgcttgaacggctgaccggtagcctcggtgaccgcctgccagtgctcaaggatatagcgccgagtggtcggctccagcgccgcaccgctgccggtacgcaaaccacccaccaccaggtgcagctccacgcctgcggcctgggcctgctcgaccaacgcctcggccaccggagcaaagccccagcaccaggaacacatcgggtccatcacatagagcaggcgcgcgggcatgggtcaggcctcggaaggggtttgcttgtagttgaagccaatcgggtgcggcatattgcgggccttggccagctcgatctgcttctgccggtcaatcgcgctgcggcgggtcttctccggcagcttatcccagcaatgcgggcaactgatgccggccacataatgctcggacgcacggtcttcgacgctgaccggtgtacggcacgcatggcattgatcgtagtcgccttcgctcaagtcgtggcgcacggtcacgcggttgtcgaacacaaagcagtcgccctgccatttggtctcttcctggggcacctcttcgaggtacttcaggatgccgcccttgaggtgatacacctcgtcaaagccttcgctgagcatgtagctcgaggccttttcgcaacgaatgccgccggtgcagaacatggcgactttcttgtgcttggccgggtcgaagttggctttgatgtagtcgggaaattcacgaaaactggtggttttcggatcgattgcgccttcaaaggtgccgatcgacacttcgtagtcgttgcgcgtgtcgatcaacagcacttccggatcgctgatcagcgcgttccagtcctgcgggtcgacgtaggtgccgacttgtttgttcgggtcgacgccttcgacgcccagggtcacgatctcttttttgagtttgaccttggtgcggtagaacggctggtcgtcgcaatacgactctttgtggtcgatgtcgtccatgcgtgggtcgtttttcagccaggccatcaggccgtcaatgccttcgcggctaccggaaacggtgccgttgatgccttcttcggcgatcagcaaggtgcctttgatgccgttgtcgaccatcgcctgcagcagtggctcgcgcagggcgacgtaatcttcgagggtgacgaacttatacagtgccgccacgacgatcggttgagtcatgggtgttctctccaggtggctaccctcgtaaggggtgaaccggatgcaaaaaaaacgcgccggctaagcggcgcgttgcggattctaacaaatgccgggtgtcagagacacctgctcattaatcatgcccgccggcgcaggtcggcgaggccggggctgcgtcgattttcgcccattcttcaggcgtgtaggtatgcagcgccaacgcatgaaactcgctcatcaggtcacccagggtggcgtagaccgtctggtggcgcttgacgcggttaagcccctcgaactgctggctgaccagcacggccttgaagtgggtctgcaacccacggctgtgcatatggctttcgtccagcacgttcaagtgttgcgggctcaaggcggtgagcgccgtttcgatacgctgttgcatggtcattcctgcttacttcttcttggccggtgcagcggctttaggtgccagctcgttggtcatgtcttccaacagcttgttcaccaccggcacggcgctttccagcttggcttgggtcatctgggccgattgttgagtcaattgaggcattttttccaggactttcttgcccagtggcgactggtagaacgcaaccaggtccttgagctcggattcgctgaagttagtggtgtagagcttgaccatgtccggtttcagcttcggccagccgatagcctggtccagagcggcgttagccttggcctggtagctgtccagcacggactgcttggcggcaggcgccttggtttgttcgaaacgctgggcaaacatttgctgcacttgcatgtacaccggagtacccagcttgtcagcgtgggccagggtaaggaaggcttcggcactggcgttatggctggcggtatcggcaaagacttggccgctggcgcaaaccagagcaaccgcggtacagatggcacgaagacgagtcatcgagtttcctttctagcaggcgaggtgttacccccaagggcgactattctgcgcctaaaaatcgaaatgtctcaaccccaccccttattgggccgggttttgcgggacttggcccaggtgaaaagtcttttatggaaccccactggcccatcacggcctaaactgcgcaaacgaacctgaaggagtgtgcccgatgagccgtatcgaaaccgacagcctgggagaagtccaagtcccggatgacgcttactggggcgcgcagacccaacgttcgctggtgaacttcgccatcggcgagcaacgcatgcccctggcggtgctgcatgccctggcgctgatcaagaaagcggcggcgcgggtcaacgaccgcaacggcgatttgcctgccgatatcgccaggctgatcgaacaggccgccgatgaggtgctcgacggccagcatgacgaccagttcccgctggtggtgtggcagaccggcagcggcacccagagcaacatgaacgccaatgaagtgatcgccggccgcgccaacgagctgtcgggcaagacccgcggcggcaagagcccggttcaccctaacgatcatgtgaaccgctcgcagagttccaacgactgtttccctacagcgatgagcatcgcgacggtgcaagcggtgaacaaacaactgctgccggcaatcaccaacctttcgggcggcctggcggaactgtcggcacggcacatgaaactggtgaagaccggccgcacccacatgatggacgccacgccgatcaccttcggccaggaaatctcggcctttatcgcccagctcgattacgccgaacgcgcgatccgcagtgccctgcctccggtgtgcgaactggcccagggcggcaccgccgtcggcaccgggctcaactcgccccatggctttggcgaggcgattgccgccgagctggccgcgttgtcagggctgccgttcgtaaccgcaccgaacaaattcgccgccctctccggccacgagccgctggtaaccttgcacggcgcgctgaaaaccctggccgtggccttgatgaaaatcgtcaacgacctgcgcctgctgggctccggcccacgcgccgggctggccgaggtcaaattgccggccaacgaaccgggcagctcgatcatgcccggcaaggtcaaccccacccaatgcgaagcgctgtcgatgctggcctgccaggtactcggcaacgacgtgaccatcggcatcgccgccagccaagggcatttgcagctgaacgtgtacaaaccggtgatcatccacaacctgctggaatcgattcgcctgctggccgacggttgcaacaacttccaggaacactgcatcgccggccttgaacccgacgccgagcaaatggccgaacacctggaacgcgggctgatgctggtgaccgcactcaacccgcacatcggctacgacaaatcggcgcagatcgccaaaaaagcctacgccgaaggcctgacgctgcgcgaagccgcgctggagctaggcttccttaccgatgcagagttcgaccaatgggtacgcccggaaaacatgctcgaagccgggcattaagctcaggtttttgacgtgcttttgatgtgcttttgatcttgatcttgatcttgatcttgatcttgatctcgggcgccccgtcaaccacgctggccgcacgcaggcttgaatccgtgggtaacccggcaggacgccgggttagccgcgctgggccaaggatggcccatcgcggcggcccacggattcaagcctgcgtgcgggcatgccgagcctaggcgaggcaccgagtggtggggcgaggactttttgcttactttttggtccctcaaaaagtgagccgctgtaagagcggaaccctaagtagccgttaccgaagaaatggatatgtactccgactaaatatcttagccaactgacatatagccttcgcgagcaagtcgaatcgtcgcaccgccgctcccacagttggaatgtgctgtgtcagcaagataatgggcggctcggaggccgctatcgcaggcaagccagctcccacagttaaacagtgctgcatcagcaagatttgggttggccggaaggccgccatcgcaggcaagccagctcccacagttgaaccgggttcccacagttgaaccgctttacaaaatatagcttcgacgcttccgtcatcaagacgccaagcgcacccgccgagccctgagcccagccagcaacgacggcgccagcgccacggtcgccgaccccagcaccaccaccagcgcccccacataacccagcgcattgatctcctcggcctgcacaaaatccggccataaccacgccgccaacgccaccgccacaaacgtcaccaatggcgtcaacgccaacgtcgcactcacccgcgaagcctcccaatgcgccagcgcctcggcaaacgcaccgtaagccaccagcgtattcatgcagcacgccagcaacagccagccttgcagcgggctcagctgcagtgcctccaccggatgcgcccacggtgtgagcagcgcggcgcaagacagatagatcaccatcatcacctgcagcgaattccacaccgtcagcaactgcttctggcccaaggcgtaaaacacccaaatggtggtggccagcaggatcgtcagcaccccggcggtgtaagtgcccagggacgtcagcatttccaccagcctttggttgaagaacagcccaaagccgatgatcaacaccaccagccccacgccctgccccaggctgaaacgctccttgaacacaaacacgctggcgaccatcaggaatatcggccccatctgcaccaccaactgtgccgtgccggggctgagcattttcaggcccaccaggtacagcacgtagttgcccaccagcccgcacaccgccatggccaccagccagccgcccttggggccgagcactttgcggctgggcagccgacgagtgagtgccaggtagataaacaagcagctgccggccacaaccaggcgaaaccaggtgaccgtcaccgggtccatcacctgcagcacttgcttgagtttgatcggcagaatgccccacagaaacgcggtcagcagggtcaagccaaagccatagacccagcgaccggaagagatgtgcatgagtgccccgaatgcctgaggaagtggaacgggcattctagggggaccaaggggtgccttggcgagcgatattttccagaacagcacaaatcaaaggtgggagctggcttgcctgcgatagcggtgggtcagacaaaaaatctcgacagatacaccgccatcgcaggcaagccagctcccacattgcccctattccttcaacgagatttagcgcaccgcttcgaacaacccggtggcacccatgccgccgcccacgcacatggtgacgatgccatagcgcaggttgcgccgttgcaactcgcgcaccaaatgcccgacttgccgcgaaccggtcatgccaaatgggtgcccaatcgagatcgagccgccattgacgttgtatttggcgttatcaatttccaggcggttacgcgcatacaggcattgcgaggcgaaggcttcgttgagttcccacaggtcgatgtccgccacctgcaagcctttggccttgagcaacttgggcaccgaaaacaccgggccgatgcccatttcgtccggctcgcaaccggccacggtaaagccacggaaaaacgccttgggcttgaggcccagcgccagggctttttccaggctcatcaccaaggtcatcgaagcgccgtcggacagctgcgaagagttaccggccgtcaccgagccgtcttcggcgaagaccggcttcaacccctgcaagctggcaagcgtggtgtcggggcggttgcagtcgtcgcgatcgaccacgccgtccagcacctgtaccgcgccggtgttcttgtcctcgattttgtacttgaccgtcatcggcacaatttcatcgtcgaacaagccatcggcctgagcctgggcagtgcgctgctggctttgcagggcatacaggtcctgttcttcgcggctgacgttatagcggcgcgcgacaatttcggcggtctggcccatggggaagtagatacccggcacctgctctttaagcagcgggttgatcaggttgtcggtgttgacgcttttcatggtcaggctgatcgactcaaccccaccggcgacgatgatgtcgctgcagcccgaggcgatctggttggccgcgatggcaatcgcctgcaagcccgaagagcagaagcggttgagggtcataccggccgtgccggtgcccagctgtgaaagcaccgccacgttgcgcccgatgttgtagccctgggcgccctcgttagagccggcaccgacgatgcagtcctcgaccgccgccgggtcgatgccattgcgggtcagcagcgcattcacgcaatgggcggccatgtcatccggacgggtctggttgaacttgccgcgaaaggatttggccaggccggttcgcacgctgtcgacgatcactacttcacgcatgggctacctcgatcttgtcattgttggaagatgaatcgaggatagatccaggccttgccaaccgcgacgatcattcacccggcatatacaaaaacatggggtgaaaagacttgttgtggcgagcaggcttgccctgcgttgggctgcgaagcggcccccatccaggcgccgcgttctttcagttaaacctcactggcagattttggggccgcttcgcgccccaacgcagggcaagcctgctcgccacaggtgagtgccaatccgttctatttctttttcttcttatcgtgcttgtcggttttgtcgaacgcctcttccagcgcgcggttgatggtgcgcaacaccttgacccgcgcccagcgtttgtcattggcttccaccaaggtccacggcgcgatttcggtgctggtgcggtcgaccatatcgcccacggcggcccggtagtcgtcccacttgtcgcggttacgccagtcgtcttcggtgattttgaagcgcttgaacgggatttcctcgcgggcctggaagcgttccaattgggtctgcttgtcgatggcgagccagaacttgaccacgatcacacccgcgtcgcgcagctgctcttcaaagtcattgatctcgccgtaggcgcgcatccagtccgccggggtgcagaagccctcgacgcgttccaccagcacgcggccgtaccacgagcggtcaaacacggtaaacatgccgcgcgccggaatcttctgccagaaccgccacaagtacggctgggcgcgctcgtcttcgcttggcgcggcaatcggcacgatatggtattggcgcgggtcgagtgccgccgccacacgccgaatcgcgccgcccttgcccgccgcatcattgccttcgaagaccgtcaccagcgcgtgcttgcgcatgcgtttgtcgcgcatcaacccggagaaacgcgcctgctcggtaatcagctgttcctcgtaatcgtccttgtccaggcgcaaggtcatgtcgaggctgtcgagcaggctcttctggtcaaccgaggccagcaacggcgccgggttcatgccgctggccttgcccttgggcagcttcaaggcgttttgcaggctttcgagcaggatcttgcccacagtaaggctgcggtaattggcatcaacaccttcaatcacgtgccacggcgcatagtcgcggctggtgcgacgcaggatgcgctcgccaaaatgcacaaacttgtcgtaggtctcggactgttgccagtccagcgggctgatgcgccagctgtgcagcgggtcgtcggccagagccttgagccgcgccttcatctgtttcttggacaggtggaaccagaacttgaagatcagcgcgccttcatcgcagagcatcttttccaggcgttcggcaccggcgatggcctggtccaggcgtgcgtccttgatctggccgtgcacccggccttgcagcatctggctgtaccagttgccgaaaaagatgcccatgcggcctttggccggcagttgccgccagtagcgccaggccggtgggcgtgccagttcttcgtcggtctgctggtcgaaggtgcgcacctcgatcaggcgcgggtccatccattcattcagcagcttgacggtctcgcccttgcccgcgccttcgacgccgttgatcaggatgatcaccgggaagcgcttctgctgctgcaattcgtactgcacttccagcaacgcttcgcgcagggccggtacttcggcgtcgtaggtgtctttgtcgatggcgtgaccgatttcggcggattcgaacatgggcagctccgtttcaagatggatcaagactagcggattgggcaacaacacgcgggaggaaattccacccgcgcttgccatgggtcaattcatcctcgattgatcagctagaatggccgccttgtctttttcgagccgcccatgaaccccatcacccacgcccagctcgactgggatgagcaaggtcgcccgcactcgcgggtgttcgacgacgtgtatttttccgacaagtcgggccttgaagaaacccgctatgtgttcctcgaacagaaccgtttgcaggagcgctttgctgccttgccggcagttgggcgtttggtgattggcgagaccggtttcggcaccggcctgaattttctctgcgcctggcagctgttcgagcaacacgcggtggccggtgcgcgcctgcattttgtcagtgtcgaaaagtacccgctgagccacaccgacctgcagcgcgccctcgccctctggccggaactggcgcccttcgccgagcagttgctggcgcagtacatcgccatccacccaggtttccaacgcctggtgctggacaacggccgcgtgaccctgacgctgttgatcggcgacgcgcttgagcaactgccgcaactggatgcacaggtcgatgcgtggtttctggacggcttcgcgccggcgaaaaaccctgacatgtggaccgccgagctgtttgccgaactggcccgcctggccgcgcccggctctacgatcagcaccttcaccagcaccggctgggtaaggcgcctgatcaacgccgccgggttcaagatgaagcgcacgccgggcatcggccacaagtgggagatcctgcgcggtgaattcctcggttggcccgaagacgcgccacccgcggccaccgccaaaccctggttcgcgcgcccgcccgccatcgacggcgagcgccacgccatggtcatcggcggcggcctggccggttgcgccaccgccgccagcctggccgcacgcggttggcgcgtcagcctgctggagcgtcacgccgagctggcccaggaagcgtccggcaacccgcagggcgtgctgtacctcaagctgtcggcgcatggcaccgcgttgtcgcagttgatcctcagcggtttcggccacactcggcgtttgctcgaacacttgcagcgtggcgtcgattgggatggctgcggcgtgctgcaattggcattcgacgccaaagaagctcagcgccaggcgcaactggccgaggcgttccccacagaattgctgcacctgctggaccgtgaacacgcgcaaaagcaggccggtatcgacctggcccacggcggcctgtttttcccggaaggtggctgggtgcatccacctgcgctgtgccactggcaagcggcgcatccgctgatagaagtgctcacccatcaccacgcgcttgaactgcaccgggtcgaccaccagtggcaggcccgcgacggtgaccgcgtgctggcgagtgccagcgtggtggtgctttcaggtgcggccgagatcatgcgcttcgcacccagcgccgacttgccgctcaagcgcattcgcgggcaaatcacccggctggcgcaaactgcggcgagtgcgagcttggccacggtggtctgcgccgagggctatgtggcccccgcacggctgggtgaacacaccctgggcgcgagtttcgacttcaataacgaagacctcacgcccaccgtcgccgaacatgcgggcaacctcgacatgctgcgggagatttccgcagacctgctgcaacgcctgggcgccgaccacctcgcacccgagcaactgcaaggccgcgcggcgtttcgttgtaccagccctgactacctgccgatcgtcgggccgttggccgaccaaacagcgtttcaacaggcttatgcggtgcttggcaaagacgcccggcaagtaccggatacgccctgcccatggctcccgggcatgtacatcaacagcggccacggctcacgcgggctgatcaccgcgccactgtgtggagagctgctggcggcctggctgagcgacgagccgctgccggttccagcgggtgtggccgaggcctgccacccgaatcggtttgccctgcgcgccttggttcgaggtaaaccagccacacgcaaatagcgggattcaacgcatcgcggctatttgccttataacttatcggtctaaaactccacggatagcactgggtcagtttctgggtacgcgccctttgggcgtattgagtattgaccctccccaacggaaaaaccggtaaggaatttatgtgcggattagctggagaattacgtttcgatgcccaacctgccgacctggcagcgattgagcgcatcacccatcacttggcaccgcgtggccccgacgcctggggcttccacgcccaagggccgattgccttgggccaccggcgcctgaaaatcatggacctgtcggacggctcggcccaaccgatggtcgacgcccagctcgggctgtccctggccttcaacggtgcgatctacaacttcccggaattgcgcgaagagctggaagccctgggctacgccttctattccggtggcgacaccgaagtgctgctcaagggctaccacgcctggggtgaagcactgctgccaaaactcaatggcatgtttgcgtttgccatctgggagcgtgacgcccaacgcctgtttatcgcccgtgaccgtctgggcgtgaagcctttgtacctgtcgcgcaccggccagcgcctgcgctttgcctcggccttgccggcgctgctcaagggcggcgatatcaacccgatcctcgatccggtggcgctgaaccactacctgaacttccacgcagtggtgcccgcgccgcgcaccttgctggcgggcattgaaaagctgccaccggcgagctggatgcgtatcgacgcaaacggtaacaccgaacagaaaacctggtggaccctgccctacggcccccatgacgatgaaaagaacctgaccctcgaagactggaccgaccgcgtgctcgacagcacccgcgaagccgtggcgatccgccaacgtgcggccgtggatgtcggcgtgctgctttccggtggtgtcgattcgagcatgctcgtcggcctgctgcgtgaagtcggcgtgcaggacttgtccactttctccatcggttttgaagacgccggtggcgagcgcggcgacgagttccagtactcggacctgatcgccaagcactacggcacccgtcaccatcaactgcgcatcgccgaaagcgaaatcatcgagcaactgcctgcggcgttccgcgccatgagcgagccgatggtcagccatgactgcatcgccttctacctgctgtcacgggaagtggccaagcattgcaaggtggtgcaaagcggccagggcgccgacgagctgttcgccggttaccactggtacccgcaagtcgacggcgccagtgacccttatgcggcctaccgcgatgcgtttttcgaccgcagctacgacgactacgcggccaccgtcgcgccgaaatggctgaccgccaacgacgctgccggtgactttgtgcgcgaacatttcgccatgcccggcgctgatgcggcggtggacaaagccctgcgtttggacagcacggtgatgctggtggacgacccggtcaaacgcgtcgacaacatgaccatggcctggggcctggaggcacgcacgccgttcctggattaccgcctcgtcgaactctcggcgcgagtgccaggcaaattcaaactgccggacggcggcaagcaagtgttgaaagaagcggcgcgccgggtcatcccgagcgaagtcatcgaccgcaagaaaggctacttcccggtgccgggcctcaagcacttgcagggcgataccttgaactgggtgcgcgaactgctgctcgacccgagccaggatcgcggcctgttcaaccccgccatgctcgaccgcctgttgaccgacccgcagggccaactgaccccgctgcgcggctccaagctgtggcaactggcggcgctgaacctgtggctcagcgaacaaggaatctgagtgatgaaacctcttgcagcggcttacagccaacgcttgctgaagggccaggcgccgacctacgagcgcctacaagcccgcctggcggaagatggcagcccactcggcgccgaaccgattgccgtgcattgcggctggggccggttgttgatcgggcatactttcccggaccccgcgagcctggcccaggaactgttgaatgagcagcccggcgagcgtgacatcgcgctctacgtggcggcgccgcagcagatcctcgggattgacccgcagcagttgttcctcgacccgtccgacacactgcgcctgtggttcagcgattaccgccccgctacgcgcgtgtttcgcggttttcgtatccgtcgcgtgcaaaccgaggctgattgggcggcggtcaacgtgctctatcaaggccgaggcatgctgccggtcgaccccgaacgcctgacgccgcgccatcaaggcggcccggtgtattggctggccgaagatgaagacagcggcgcggtgatcggcagtgtgatgggccttaaccatcaaaaagcctttcaggacccggaaaacggttgcagcctctggtgcctggccgtcgacccgcagtgcacgcgccccggcgtcggtgaagtgctggtgcgccacctggtcgagcactttatgagccgtggcctgagctacctcgacctgtcggtgttgcacgataaccgccaggccaagagcctttacgccaaattgggctttcgtgcgctgaccacctttgcaatcaagcgcaagaacggcatcaaccagccgctgtttctcggccctgggccgcaggcggggttcaacccttacgcgcggatcattgtcgaggaagcccaccggcgcggcatcgatgtgcaggtggatgacgccgacgctggcctgtttaccctcagccatggcgggcgccgcgtgcgttgccgtgaatccctcagcgacctgaccagcgccatcagcatgacgttgtgccaggacaaaagcctgacccacaaggtgctcaaagctgccggcttgaaactgccgcagcaacagttggcgggcagcgcggatgacaacctggagtttctcgacgaacaccagcgcatcgtggtcaagccgctggacggcgagcaaggccagggcgtggcggtggatttgcagaccatcgaagacgtgcagaaggccattgaagcggcgcgccagttcgacagccgtgtgttgctggaaagctttcacgaaggcctcgacctgcgcattctggtgattggttttgaagtggtcgccgcggcgattcggcgccctgccgaggtgaccggtgacggccagcactccatcggcgcgttgatcgaagcccaaagccgtcgccgccaagctgctaccgacggcgaaagcaagatcccgctggacgccgaaacccaacgcaccctgcacgcggccggttacgactacagcagcatcctgccgcgcggcgaaaccctggccgtgcgccgcaccgccaacctgcacacgggcggctgcctggaagacgtcaccgcgattctgcacccgacactggtggacgccgccgtgcgtgccgcccgcgcgctggacattcccatggtcggcctggacctgatggtgccggccgccgaccaacccgagtatgtgtttatcgaagccaacgaacgggccggcctggccaaccatgagccgcaaccgacggcggagaagtttgtggatttgttgtttccgcatagccagccgactgcctgaccactgatcgttcccacgctcagcgtgggaatgcagcccgtgacgctctgcgtcacaagagcggacgcagagcgtcccttgaggcattcccacgctgagcgtgggaacgatcgccctcaccccatcaggagtttccatgactcgaaccatccccgaaccggacctcaactacctgcaaaaagtcctgctggaaatgctcgccattcccagccctaccgggtttaccgacaccatcgtgcgctacgtcgccgagcgcctcgaagagctgggcattccctttgaaatgacccggcgcgggacgattcgcgccaccctcaagggccagaaaaacagcccggaccgtgcggtgtccgcgcacctggacaccatcggcgccgccgtgcgtgcaatcaaggacaacggccgcctgacgctcgcccccgtcggctgctggtcaagccgttttgccgaaggcagccgcgtcagcctgtttaccgacaacggcgtgatccgtggcagcgtgctgccgttgatggcctccgggcacgcgttcaataccgccgtggatgaaatgccggtgagctgggaccacgtggaattgcgcctcgacgcttactgcgccacgcgtgccgactgcgactcgctgggcatcagcattggcgactacgtggcattcgacccgctgcccgagttcaccgaaagcgggcatatcagcgcgcgccacctggacgataaggccggtgtcgccgcgctgctcgctgcgcttaaagccatcgtcgacagcggcgaacccttgctgatcgactgccacccgctgttcaccatcaccgaggaaaccggcagtggcgccgccgccgccctgccctgggatgtgagtgagtttgtcggcatcgacatcgccccggttgcgcccggccagcactccagcgagcacgcggtcagtgtggcgatgcaggattccggcgggccgtatgactatcacctgtcccgccacttgctgcgcctggcctcggaaaacgacctgccggtgcgtcgcgacctgttccggtattacttcagcgatgcgcattcggcggtgaccgccggccacgatatccgcaccgcgttgctggcgtttggttgcgatgcgacccatggctacgagcgcacgcatatcgacagtctggctgcgttgagtcgcctgctgggcgcgtacatcctcagcccaccggtgtttgccagcgatgcgcaaccggcccagggttcgctggacaggttcagccatcagatcgagcacgaaacgcagatggagagcgacacccgcgtgccgtcggtggacagcctggtcggtcagaagtcctgaccctggcaacacctgatactggtcacgatgatcccggcgcagtagcatcgccgggattctacctctgaggcttgtatgctgattccctacgacgcacttgaagtcgacaccttgacccgcctcatcgaagacttcgtcacccgcgacggcaccgacaatggcgatgacacgcccctggaaacccgcgtactgcgcgtgcgccaggcactgaccaagggccaggcgctgatcgtcttcgaccctgaaagcgaacaatgccagttgatgctcaagcacgacgtgcccaagcatctgttcgactgaggctgttctacgggttggtttggggttgcgtggcttggcgctcgaggattttctgatacacctcggcgcggtgcacattgacccctgccggggcctggatgccgaacttcacttgggatccgttcagctcaaggatgtgcaaggcgatgtcatcgccgatagagatgatttcgcctacggcgcggcttaagaccagcatggcggttgtccttttagagtgacaggaccttgaacatgcgcgcttgaatggggggcgacaatggctcgtcgctaaatcaggccgggcctacgcaagccggtaatttgcctgacagacatgtaattgactggagggacgacgaatgtttgatcgttcccacgctttgcgtggaaacgccgccccggacgctctgcgtcccgctgcaggtgacgcggagcgtcaccggatgcattcccacgcggagcgtgggaatgatcttcaatgatcatcagcccttaacagcctgtgccttggcgcgcatcttgtccgccatcaccgtcatctcgtcatacagcaactgcgggttcttctgcttcaacgcccacgccatccgcccctgctcatggggcaaaatcataaactcgccttcagccactcgctggtagatatagtcagcaatgtcagccgccgaaatcggcgaactctccagcaacttgcccacttgcgccttcatcgccggtgtcggcccgcgaaacgaatcgagcaagttggtctggaaaaacgacgggcacactacatgcacgccgacttcctgctgtttgagttccaccagcaaactttccgacaacgccaccacgcccgccttggccacgttgtagttgctcatcgccggcccctgcatcagcgccgccatcgaggcaatattgataatccggcccctgctcttctccaacagcggcaggaacgccttgcagcccttgaccacgcccatcaggttaattgcaatctgccaatcccagtcctccaacgacaactcggcgaagaacccgcccgaggcaacgccggcattgttgacgatcacatcaacgcctcccagcttgacctcgcacgcctgggcaaacgcggtgagctggctgtaatcacgcacgtcgcagcgctggataaacccatcgccccccgcctcgcgcaccagcttgagggtttcctgcagccccggctcactgacgtccgacaaggccagctgccaaccctcgcgggcccagcgcagcgcgatttcgcgacccaggccagacccggcgccggtgatcatcatgcgattttgcataggaaagttgccttgtggttcacggaagaagtgatcggcagtgtagcgaaggtttttcctgcacccacgcaccatccaattgatgaatgcctcgggcaaaccctgaaccgggtgcgagagcgacttatagcgtaagttcaatctttttcaacgagatcactgtagttgcgaacgtattaaaagaaataagctagtttgcaaaatgctttaaaaaaccagggaattttctgcgcgccggtagagtcggagttaataaggcgtccgtatttaaatgacggcctattgtttaataaccggtctttgcagaaggcctataaggaaaaaaaccatgagcctcattctgatcattatcctgatcctgctgctggtaggcggtttgccagtcttcccgcactcacgtaactggggttatggcccgtcgggtatcctgggcgttgtcctggtggtattggtggtgctgttgttgctcggtcggatataaaacccgcacaaaaaaagaggcctcaatgaggcctctttttttatgctcggttacttagtccggcttgccgtcaatcacaccggcggtgttatccaacaggctcttggtggcggtctgcaggaacgactcaagcttctgcttaagcgccgcttcgtcgggtgactcggggatcactttgccggtcgggttagcgcccagttcgtattcccacagcttcggtggcatttccttgggcagaaccaggatgcggtctgcggtgaccagggccactgtctgatcgctgcccgatggtttgatcacgccaaaacccttttcgccttccggcaggttcagcaggtcacggccccaacactggtgcagggtgtcgccaccgaggcggcccatgatggtcggcacgatatcgatctgagtgcccacggtgtggtcacgctcgccgaacttctcctgcatgcccggtgcaatcatcagcatcggcacgttgaagcggcccaagtccatttcggtgatttgctgctcgttgccgaagccgtggtcacccacgatcacgaacagggtttccttgaagtacggctctttgcgggccttttcaaagaactggcccagggcccagtcggagtaacgcatggccgtcaaatgctcgttgaggctgccacggtcggtgactttctcgaccggcaatggcgtcggcaacgcatacggcgtgtggttggacagggtttgcagcaatgcgtagaacggcttgccgccttcgcgggctttcaactcttccaggccacggttaaacatgtcctggtcggacacgccccacgtcgggtcggagaacaccgggttgacgaagtcattacgcccgatgaagttggtcatgccctggttgctgaaaaagcctgactggttgtcccaggcgaagtcgccgttgtagacatacacgtcgtcaaacttgcgcgcgctgagcaactgcggcaggcccgacagcttgtggctgccttccggggtttgcatcaggtattcgaagcccggcaggttcgggaagcatgccatggtggcgaacatgccctggtgggtgtgggtgccgttggagaagaagcggtcgaacaacaagccttccttggacagtttgtcgaagtatggcgtgatgttgcctgggcggcccagggcgcccactgagtgaccggcgaagctttccatcaggatcacgacgacgttcttgatcggcagggtcttctcggccggtggcgtgtagtcacggcgcacggcggcggtgtcggtattcaccagcttttcttgcggcaacaccagcatgtcgcgcacggtctgggtggccagcggttggtccagggtggctttccagatgttcgaacgctcctcggagaagcgcgacttggcggcggcgatcagcgacagggtgccgttcaagcccagctggttggcgaagttcgattcagtggtgtagacatcaccccaacgcagcggcgggccctggcgcagggtgccacggatggcgaccacggcaatcagcaggcacaccacaaagacggcgatgcgcgtgtaccagggtgcaacctggcgcgtgccgatgctgccgccgctgaacgggccacgtgggcgcgtcgcacggtcagcacccttgaaggcgatgctcaggatcagcgtgcccacggcccaggccagcagataacgcaccaccgggaaaccgtaccagagcatgctcatcacggttttcgggtcttcctttacatactggaagaccaggccgttgaggcgctggtggaattcgcggtagaagtccatctccatcaagcccaggaacagggcaatgctggacaccacggtcagccacaaacggaagaacccgcgcgccgccatggcccgaacgctgaacagggccagcagcagcgggaccagcgcgtacatcacgaagcggatgtcaaagcgcgtgccgttgatgaacgcttcgaggaaggtcgaggccggcgtgtcgaggatcatctcgcggttgtagaccagcagcgccaggcgcagcagggagaacatcaccatcatgaccagtgcgcaaagcagcgtgtacgccagatgggatttgacggtcggttgcagcaggcgattagaagctcgctgctgactcagggcgtccgggtttgccatgtcgtttcaggacccattggaagtttaagttgcgaaaaaatgcagtggcgtccgtccctcgcccaggctggctggggtaggcggttaacgcggtggcgcaaatggtgcccgatcaatggcatcaacgccattaattactgaacgtgcgccgtcgccctgcctttaatgacacttgaacaagtgccttggcgcaggcgtaaaccggcggattgtcttggaaaagatgtgaaaattctgtgcagcgaatagtttcgacacaaatcttatggatgtgcctgaaaccaatgtgggagctggaatgtgtgggagccgggcttgtgtgggtggccgggcttatgtgggagccgggcttgcccgcgatgcaggcaccgcggtttttcggttacatcgcggtgatgcaatcgcaggcaagccagctcccacacaagccagctcccacatttactgtgcccactccaaatggagtgaggcaatcagacccgcacgttaccgcgtggcccggcaatcgcccagatgatcaggcccagtaccggcaacagcaggatcaatagaatccacagcaccttggcgccggtgcttgcgccgcttttgaacacgttgatgatcgcccagatatccagtaccagaatgatcaggccaatcaagctattaaaagtggaacccatggtgtcgctcctaagtgagggcatgcacttgtaggatagtcaggcctgacgggggttccgttttatttcagacatgcacggcgattcgcagcgcttccagggatggctcggccttgatgccgacttcagcacacagttccaaaacgcgcggtaagtcgttgccgtaaaccagcaccgcctggatctcgtcgtccagcaattggctgaagttcagcagcacgtagccgccgtcttccgggctcagcgcgctcatctggatctggatgcggttcagcgcagtgaggtcttcggtcttggccagctgtttgggcttgaggttgaacgccacgcccgggccgaacgacgcgacgatctgcgcaaacaggtcgccataggtgtcggcctggaacagcacagtgtctggcaggctaccgacgacgacccactcgcccagaggaatcgggaaggtgtcgtcgtagttgatatccgggttggccgccagaaaagctgccgggtcggcgtaggcctgggccgcttcctcggcaatgcgcgccacttcgtcctcgcccatgacgccggcgctgattttactgatgagttcgacgagggcggttttcatggggtgatcctgtggcgagctggttttcgagggcgcgtagcctacaccagtttgtgcaattgcgccgtcgtatccaccgcgcccatggtctgtgccgctgccagcgcagttgcgccctgcgcgtcggtggccttggggttggcaccctggctgagcaggtagtcgaccatttcggtgcggttgaacatcgctgccatcatcaacgccgtacgcccatccgaagaggccgcatcgaccggcgcaccgccttcgatcagcgccttgaccactggcaggttgcccttgaacgccgcaccggccattggcagctggtttttgtcgttggcgatttgcgggtcagccttgaattccagcagcacttttactgcgtcggcgtggccgtgataggccgcaagcatcagcaaggtgtcgccattgtggttgcgcaggttgggcggcaagcctttggtcagcagcgcggcgagcatggcggcatcgcctctgcgggccacgtcgaaaacttgctcggcaaattcggcggcttcgtcttcggtcatttgtttaggctggtctgacatgtggggctccttgtctgaatgctttataggcgcccagtgtcgcggtggagttccccactgtcatggcttttttgccaaaagcggccataggcagaatcaataacgaaagtgcccagcccgaatctgtgccaacaaatgcccggtaaccggcacatagcaatccgagcccggcagccacgcatacactggatcattgccagccttttccgggtcaaaggcctcctccttaagccgcactttctgatacttgaaggtgccagtcgtttccatcttcaccttgatgcgcaggaacagcggcaccgcatagtgcggcaattggccgtgggcgaattgcagcagttcgcgcatatccaaagaggccaaggattcgcttggcgtgatggcaaccatgccggcgcggccattggtgttttcgatctcgacaccgtaggccaccacctcagcgatctgcgggtgttgcagcaacacattctccacttcggtggtcgagacgttttcgcccttccagcggtacgtgtcgcccaaccggtcgacgaattgcgcatggccgaagccgatgctgcgcaacaaatcgccggtgttgaagtaacggtcgcccttctcgaacacgtcggtcagcaccaccttgcggtttttttccgggtcggtgtagccgtcgaacggcgacttttcgtcgatccgggccagcagcaacccctgcccgcccgtttgtactttgcgcatgaaaccatcatcgccacgaatcggctcaccggtctcatgggagtagtccaccagggcccagtgttgcaggcagaagccgatggtgttgtcgaaattcagcacattggtgaagccgatattgccgtcgctggcggcatacagttcacagatatgttcaactccatagcgttgcttgaactgcgcccaaacgccggggcgcaggccattgccgaccatcttggtcacgctgttgtccaggtcctgggcgctggcgggctggtcgagcaggtagcggcacagctcaccgacatagcccaaggtggttgccttgaacttgcgcgcgtcgtcccagaactggctcgcgctgaacttacgccgaatggcaaaccccgacgccccgacaatcgccgagccccagcacacacacaggccggtggcgtggtacagcggcaaggtgcaataaagaacgtcttgcgggcccatgtccagggcgatactgccgaagctgacggcggtcttggtccagcgcccgtgcttcatgatcccggccttgggcaaaccggtggtgccggaggtgtagatgtagaagcacgggtcgttaaagaagatgtgcccagtgctggcggggttatccaccgggtattcggcactcgccgccatcaggtcgatgtaaccctgcggcactgcgccggggtgttgatcggcgacaaaccaggtcttgtccgccgggatttgcacttgatcacgcaccactgtgtaggcagccaccagttccgcgcccaccacaatggccaccgggctcaccagattcaggctgtgcaccagcgccgcctgggtttgcgaggtgttgagcatggcgcagatgccacccagcttggccacggccagcacgtgcaacaacaattcggggcgattttcgataaacagcgcaacgacgtcacctttgccgatgccctgctcgtgcaagtgatgggcaatacggttggcgcgcccgttggcgtctcggtagctgagcacgctgtcgccatataacaacgcagcgccgtcagggttacgcagggtggcctgttcaaagtgccaacccaggccgcagggctgctcggggtcggtgacattcgcggcgcgcatgccgcgcaccacgcgcggcaatgcccgaacaatcgcgggcaccttacgcagcatcttgccccaggtgatcatgtcgtcttgctgatggctcatggaggaacgtcctttttcttattcttcgtctgatccagaaacagcgtcgggcctgtaggcaggagaccgaatgccttgcagaaaaatacgcctgaggttcttcggctgtacacgtgggatttgaaatgttttgtatcccggcccaatgcccgacaaaaatggaattgttcaccgtatcaagagtctttatcggtaagggccgccttaaacgtcgtggcccgatagcgcaaaatgcaggatgcacgatggccattcatgcaatttgcacgaaactgaaaattctaaatttttttaaactactgatttataacgactttttataaaatccaatactggcacaatcactgcacctatcactccatgcttgccaacttgagccaacggagctgatagacatgagcctgatccaagataaattcgcttctgtattctcccaatacgacgtcaccactcagccacgcccagacggcgggatcctgttgaccctgcgcaacagcgaaggcaaacaggtcaagcgttcgatttcgtatcaacagctgcacaccgctgaccaactgacttgggtgatcagcgccatccgccgcgacctggccgaacaagccagcgacctgccacagatttcgatgctgcaaagccagaatcgctttgcgctgccgacttaccattcggcgtaaatcaccccaatgaaaaagggccgcgacgccgttgagcgtcgcggcccttttttctgtggtttcagcacaatccctggcggctggcctcattcatagcctgtacgcggttggtgacttccaacttgccgtagatgttacgcagatggaatttcaccgtggcctctgacgtggcgcgaatctggctgatttcccagacggtcttgccctccgaggcccagcgcagaatttccagctcagtcggggtaagaggcttgccccccaagctcaggcgccttctgacgaccacgggcacggtatccggcgtacgacacgagtcctctcggccactcattgatctctctcctttagtcatggattccatatcacctttcggattcctgctattgacaggtgatataaacatcgaacaaggagagagttacataccgaatgggctgaaagcaggagacgctgcataaacagctacagcctacaaataactaagccaattcccacagcagatgccaacttacctgaatggaaagtttaaatatctgtgcttagtcgtccagacccgggaaaccggcagcgatgccgtcgccggtaaattcaggcactgcgcctttcgctgtattgaacaaccgcagtgtgacgaagtgcggattctcgcccatgtcgaaccaatgcggcattccggccggaatcaccagcaggtcattcttctcgcagcgtatggcatagacgtactcgcctacgtgcacgcaaaacagcccctggccggcgatgaagaaacgcacttcgtcttcgctgtaacggcgttcatcaatgtactgcgcgcgcagctcggctttttgcggatgctcgcccgtcaccctgagcacttccacggagccgtagccgagggcgtcgatctgaggctggtaggcggcgatcagttcagcgtcgctggcgcccttctcgacaggcgccggctgccagcgcgcaaaccgcacgccgtgctcggcgaggcacgcggcgatatcgtccaaatgggtcaggaccttgttcggggtatcgggcgtggcgacggggtaaacagcgacataactcattgctcggttcctttattcggctcttgcaatcgaaggccaatgataatggcggcagccagcgccgcgacgctggcgatgctgaaggtcagcgtcggccccaacaggttccagctatagccggcatacagagcgcccaacgcgccgccggtgccggccagcgcggcatacaacgcctggccctggccttgctggcgatcaccgaagctgcgttgtacaaaggcaatcgctgccgcatgaaagctgccgaaggtggccgcatgcatcacttgcgcgagcagcagcacccagaaaaattcggcgaatgagcccagcagcagccagcgtatggcggccaacaggaaactcgccagcaatacccgacgcaccgaaaaacgcgtgaggatgcggctcatggccaggaacatcagcacttccgcgaccacgcccaaggcccagagcatgccgatcacgccgcggctgtaacccaggtgttcgaggtgcagggtgaggaaggtgtaatacgggccatggctcatttgcatcagcgccacacaggcataaaacgccagtacaccggggctgcgcaattgcttgaggaaaccgtcaccggccaggcgattgccgtggctcaccggttgcgcagtcggcacccacaggctggcggcgatgatgccggccatgatcaccacgaccaccaccgggtaaatgtccaggctcagccagtcgaacaggcgccccatgatcaccacggtaaggatgaacccgatggagccccacaggcggatctggctgtagcgcgaggtctgtttgtgcaggtgcgccagggtgatcacttcaaactgcggcaacacggcgtgccagaagaacgcgtgcaatgccatcaccagggccagccaggcgtaggtcttgctgatgaagatcagcgaaaagctggcaagggtgcacaccgcgccaaagcgcacgatggccaggcgccggccggtgtagtcgccgagccagccccacaggttcggcgccacgcagcgcatcaacatggggatggcgaccagctcgccgatgcgcgcgctggagaaccccaagtggtcgaagtacagcgccaggaacggcgcggtcgccccgagcagggcgaagtagaacaggtagaagctggagaggcgccagtacgggagcgctggggtcatggtgtgaggggctgcggcgcatccctcgccacacttcgtcacagctggcccagtaccggcgtagtcacgcgtacatcggcgttttgcccacggttacgcagcaggtggtccatcaacacgatggccatcatcgcctcggcaatcggcgtggcacggatgcccacgcatgggtcgtggcggcccttggtgatcacatccaccgggttgccgtgcacatcaatcgaacggcccggcgtggtgatgctcgacgtcgccttgagcgccaggtgcgcaacaatgggttggcccgaggaaataccgccaaggatgccgcccgcgttattgctgagaaaaccttccggggtcagttcatcgcgatgctcggtgccgcgctgggacacacaggcgaaaccggcgccgatctccacgcccttcaccgcgttgatgctcatcagcgcgtgggccagttcggcgtcgagacggtcgaagatcggctcgcccaaaccgggtttgacgccttcggcaaccacggtgatcctggcgccgacggagtcctgatcgcggcgcaactggtccatgtaggcttccagttccggcactttgtccgggtcagggctgaagaacgcgttgtcgtcgacgctgtcccaggtcttgaacgggatttcgatcgggccgagctggctcatgtagccacgcaccacgatgccctgggtggccaggtatttcttggcgatggcgccagcagctacgcgcatcgcggtttcgcgcgccgagctgcggccaccgccacggtagtcgcgttcgccgtatttgtggtggtaggtgtaatcggcgtgggccgggcggaacaggtccttgatcgccgagtagtccttggacttctggtcagtgttgcgaatcagcaggccgatggcgcaaccggtggtgcggccttcgaacacgccggagaggatctcgacttcgtcgggctcctggcgctgggtggtgtgacggctggtgccgggcttgcggcggtcgaggtcacgctgcaggtcgtccagggacagctcgaggcctggcgggcagccgtcgacaatggcgaccaacgccgggccatggctttcgcccgcggtggtgacagtgaacagcttgccgaaggtattgccggacatgcagggcgctccgtgaaatcagttgaatcaagtcaaccgtaataacttaaggcggccagtatacgcaggctaaccgagtagttcatcctcgaaaccttaccggtagacgtctgtccaaccggcaccttcctgatgatggcgcgatgatgctgcgagttctacttttgacccttaccctgttttccagccttggcttcgccgcctcccctgtcgttctgcaacggccgatcagcctggacaccggcagcggcgagctgtttggctcacttttgctgcctaaatccgacaagcccgtgccggtggtgttgatcatcgccggctccggccccaccgaccgtaacggcaacagtgccgacggcgcacgcaacgacagcctcaagcgcctggcctgggtgctggcccggcataacattgccagcgtgcgctacgacaagcgcggcgtggccgccagcctcgcggccacccccgacgaacgcaacctgacgctggacgcctacgtggccgacgccgtggcctggggcaagctgctcaaggccgacagccgcatgggcccgctgattgtgctgggccatagcgaaggcgcgctggtagccgccctcgccgcgccgcaactggacccggccggggtgatttcgctgtccggcagcgcgcggccggttgatcaggtgatccgccagcaactggccgaccacctgccgccggccctgttgctgcgcagcaatgagatcctcgaccgcctcaaggccggccaggtggatgccgatgtgccgaccccgctggaaggcatttttcgaccgagcgtgcagccgtacctgatcagcctgtttcgcgccgacccgtccgccgcctttgccaagctgcgcatgccggcactgatcatccagggcaccaacgatattcaggtgggcgtcgccgatgcccggcaactgaaaaatgccaagcctgatgcccatttgacggtgatcgaaggcatgaaccacgtgatgcgtatcgtgcccaaggacgtgaaagaacaattggcctcctacaacgacccgaaactgccgctggccgccgagctgggtgagcgcatcgtgcgctttatcgacggacttcaaccccgttaagcgattaattacctccagtcctgtgaaatacggccgataagcccagggtcgacagtaaaaagactgtcggcccgcagggcttggacaggatcgcgccgcatgacaaccacagaagctacaccagaatctatcgccgacacgcaggcggaaaaaaccgaggccgtcgaggcggcggccctgccgtgggcggacgttcaggccgaacatttcaagatgctgcgccttgcgcccctggcgactgaccgcgctaccggcgcgcggccgttgcggtttgtgcagttcggttatgccgagcgccacgacaaacaccacagcctgttgcgcatggtcatccagttgccgggccagcgggtgcgccgcgagcagaaccacctggatatctgggtcgatcacgataaacaccgcgtgcacttcggcccaggcaacagcctggaaatcgaaccggccaaccgtggcatcgggcgcttcctcgtcgcccaaggcgcggcgtgggcgaaaaagaagtggtcacactaccgcgtcgacggcgtggacttggccaacaaggatgcactcaacgaagccacgcgcctgcgccgcgatcacttcttgcgtatccagggttttgatgtggcctatgccgacgtgcagcacctcaaaggcaacgtgcagccgggcaaagtcagcgaagtgctcgacagctggaacaccgagaaggtgcagttcgtggagatacttgaagccgcgcaaatgctgcagcaggccgagcacaacctggccgagcaggaagtgaagctgcgcaaggaagaagaaaaggtcaccaagttcaagcgtgaggacagcgggttgcgctttaccatcacctgtttggtggcgtttacggtgtttcaggcggggttgttgatctggattgcaacgcaccgctgatcgctggctgcaatgcaatcaaatgtgggagctggcttgcctgcgattgcggtgggccagctagcatttctgctactgatacaccgctatcgcaggcaagccagctcccacactgaccgcgatcctggcgttagaccttggcggcaaacaccgcctgatgcgcccggcactgctcagccgtcagcatgaacacgccatgcccaccgcgctggaactccagccaggcaaagtcgacttccgggtacagcgcctcgacgtgcacctggctgttgccgacttcgacgatcaacaagcctttctcggtcaggtggtctgccgcttcagccagcatccgtcgcaccaggttcaagccatcatcgccgcaggccaggcccagctccggctcgtgctggtattcgtccggcatgtcggcaaaatcttcagcgtctacatacggcgggttcgacacgatcaggtcaaaacgctggccgggcaggccgtcgaagccatcgccctgcacggtgtaaacgcgctcgtcgacgccatggcgctcaatgttctggttagccacttccagcgcttcgaaggacaagtcccccagcaccacttcggcgtcctggaactcataggcacaggcgataccgatgcaaccggagccggtgcacaggtcgagaatgcgcgccggcggttgcgccaaccacggttcaaaacggttttcgatcagttcgccaatcggtgaacgcgggatcaacacacgctcgtcgacaataaacgacatgccgcagaaccaggcttccttcaacaagtaagcggtgggcacgcgctcgtggatacggcggtgcagcagacgctgcacgtgggagatttcctcttcttcgaggttgcagtccaggtagctgtcggcaatttcccaaggcaagtgcaaggcgccgagcactaattgccgggcttcgtcccaggcgttgtcggtgccgtgcccgaaaaacaggtcttccccatggaaacggctgacagcccatcggatgtggtcgcgcagtgtgcgcaggcgggatgtgatcacgggggcaagctcctggaaaaaacgactggcgattctaacagccttcgcctgtcccttcgatgtacgaaaactctccgccatccgtcggaattcatccaatttgccatcattgagttaaacaagccgacctcttgacatggctgcacgtcaacaacggcgtaccttacgatggtagcgattcacagaaccgctcagccagtggacaatgtcacaaaagcccccctcacaggagccccagaatgtccgttccaaagacgatgtttcaactcagcggtcgcggttacgcagcagccaacctgaaccatgcgaccctcgtgatcatcgacgcccagaaggaatacctcagtggcccactcgccctgtccggcatggacgcggcggtcgacaatatcaagcaactggtcgcggcagcgcgcaacgccgggcggccgatcgtgcatgttcgccacctgggcaccgtcggcggcctgttcgacccgcagggtgagcgcggcgaattcattcctggccttgagcccctcggcgacgagaccatcatcggcaagctgctgcccagcgcgttccatggcacgggcctggaaaaacacctgcaagaccttggctcactggacctgatcgtctgcggcttcatgagccactccagcgtcagcaccaccgtgcgtgcggccaagaacctgggctttcgctgcaccctggtggaagacgcctgcgccactcgcgacctgccgtacaaaggcgggatcctgagcgccgagcacgtgcagcaaaccgaaatggccatcatggccgacaacttcgccaccctggcgttgagcaaagatctgatctgatcgcccttctgatgagcggcgcggcaatgttcattgccccgctcatccgcaaagccctttcatttggcgcatttacctctccacccggaacaacctgtgtatcttccggtcgaagggccgataccctggaggaaaggtcggaatgaagatatccgatggttttgacgctcgtcgcttgcgccccaagggcccgagcaactggcgtctgcgcctggtggccggctttgccgcgctgctggccattgtaggtttgctgttggctggcgctggtggtgccggtttgtttggtcattcgccggcactcggcgaactgaatgccagcccgggtggctcggctatcctgttagtcatcgggttgttagtgctgtggctgggcgtgtggttgtggcgtcgcagccgtcggcggatgcgccaaccgttgtcgctgaacatcgcgtcgcacctgatgaaaaagcacgactgatggcgcttggatagcgtttcctgcgccctggccgccgcgatttaggtaaactgcccgcccttcgcggaggctgacatgcaagacgacgatttttccctgttcaaaaacgagctgcgcggcgtcaagccgatcaagcacgaccgcgccgacaccggcaaacccaaggccgaccgcgctcagatcgccaagctgcgccaggccgcgaccgtgcgtaccgacgccaccaccgtggatggcctgtcggaccagttcgtgatcgatgtaggcccggaagacgagctgatgtgggcccgcgacggcgtgcaggaaagccagatgcgcaagctcaagatcggccagatcccgttcgaaggcagccttgacctgcacggcatgaccgtcgaaaaagcccgcgaaaccctgtgggccttcttcgccgaagccaccaaattcgaaatccgctgcgtgcgcgtcacccatggcaaggccgtgcggttggacggcaagcggccgatgatcaagagccacgtcaatacctggctgcgccagcatgcccaggtcctcggctttacctcctgccaggcccgccacggcggcgccggtgcggtgtatgtgatgctcaagcgcaccatgatggaggggcgcgacgagtaacaagtgccatcgtcaggcttgcagcgatgtgtccgccaccgtaaccttgcgctttgcgaaaatcccacaggtagtttcatgtccctggaacagaattacaccgcgatcctcggccaactcggcgaggacgtttcccgcgagggcctgctcgacacgccaaagcgtgccgccaaggcgatgcagtacctttgccgtggctatgaacagacactcgaagaagtcaccaacggtgccttattcagctctgacaacagcgaaatggtgctggtgaaggacatcgagctgtactcgctgtgcgaacaccacttgctgccatttatcggtaaggcgcatgtcgcgtatatcccgagcggcaaagtgctgggcctgtcgaaggtcgcacggattgtcgacatgtatgcgcgccgcctgcagatccaggaaaacctcagccgccagatcgccgatgccgtgatgcaggtgaccggtgctctgggcgttgcggtggtgatcgaagccaagcacatgtgcatgatgatgcgcggtgtggaaaaacagaattcgtcgatgattacgtcggtgatgctgggtgagttccgcgagaacgcggctacccgcagcgaattcctcagcctgatcaagtaacaggctgcgtaggaaaagaccggcgttcatcgccggttttttttcgcctgcagaattaaggtaagctgcgaccccttcttcatgggcaagaggttttcagccatgttcgtcaaagcacttcgagtgggcctcggccaaatcatcatcgcgggcgacttccttacccgcccacgcaaaaagcagcgccccgccgaacaacaggcgcaagtgaacgcggcagccaaggagctgaccctgtatcagttccacgcctgcccgttctgcgttaagacacgccgcacgctgcaccgcctgaatgtgccggtggcgctgaaggacgcgaagaacaacgcgcaagaccgccagaccctgctggagcaaggtggcaagatcaaagtgccgtgcctgcgcatcgaagaaaatggccagaccacctggatgtatgattccaaggtgatcatcgactatctggacaagcggttcgccgcggtctgataaacaccgcggtcaatgtgggagctggcttgctgtggcgagggagcttgctcccgcacgacagcgcagctggagccggctttttgggggcgcttcgcaccccagcgcaagcaagcttgctcgccacagcaagccagctcccacattagttcggcattgccaattcgatagccagcaacgccgaacccaggcacttgccatgcgcatccagcgccagcgagcgggtcacgccgccgcgcaggatccccggcaacacgaagttcagcgcctgcacgctcggcaattcatagcgccgcaccggccctgcgcccggctcacgcagcccggcaaagaactgcgccacgcgctcggcggtcagttgctcgcacagcagcgggtaatcctcggcgcgataggcaatgatcgaaatgttcgaggtgtcgcccttatcgccggtacgcgagtgggccagtgtgtgcagtttcatgcttcgatcctcgggttgaccgcgctacgcgccagcaataacgacgccaccgccaccacttgccgcacactcttgctcgcaccgccgccgcccgacgggccgttggtgtagagggtttccacttcattgccgacccgcaccgcctcgctgcgctcttcacagcgggcggccacgcgcaggcgcacttcccagggctcgacggtgctgcgtgggccgtgcagcgagtccatgccaatcaactcggcgcgcacgtcctgcatctttacgcccatcagttccaggcgcttgagtaccacagcacgcgccaactctgcccgtgcgacagcgcccgggccaccgtaggacatctgcccttcgccgatccaaccgtccagataaccgacgctgactttcagttgctcaggccgtgcgcggccctcggcaccgctggcgcgcacgcgatcaacgtcctcctcgacaaaactcacgtgggaaaagtcggcggttacgtccggcgtcaggtaggccgccgggtcgtgaacttcataaatcaactgctcagtgcaggtcgcaccgctgacgcgtccgcccgagcctgcgaccttggtgatcacagcgtcgccgtcagcattgacctcggccagcgggaagcccaggcgtgccaaatcttctacgtccttgaaccccggatcggcaaaatagccaccgctgacctgccccgcgcattccagcaaatgccccaccagagtgccgcgtcccaggcgctgccagtcatccgtcgaccaaccgaactcaaacatctgcggcgccaggaacagcgacgggtcggccacgcgcccggtaatcactacatcggcgtcggcgcgcaagccatcaaggatgccgtcgacgcccaaataggcgttcgcggaaatcagccgttcgcccaacgacgccagggtctggccgttatccagcatttgctcgggctgcaacacatccagcacgtcatcgcccaccacggccacgacgttgaggttcagccccaactcatgggcaacccgccgcacttcactggccgccgccaccgggttggccgcgcccatattggtgatgacccgcagacgccgccgcccctcatgccgcccgacaaagggcaatacgcggcgcatgcgctcactcagcagcgggtcgtaaccgccctgtggatcgctgatacgtgcttgttgtgccagggcaatcgtgcgttcagccaggcattcgaacaccaggtaatcgaggtcaccctgttcggccaactccacagcaggctcgatacggtcacctgaatagccggcgccggaaccgatgcgcaaggttttcatctcaaatcactcccaacagcaacgcggtcagggtcatcaacaccgacgcggcaaacagaaaagggatggtgaagcgctggtgatcggccagttcgaccttgcacaggcccaccaacaggaaggttgcgggggtcagcgggctgaccgggaagccggtggtgtgcacgccgagcaacgaggcctgggccacttgcagcgggtcgacgcccagggccttgccgacttcggcgatcaccggcatcacgccgaaatagtaggaatcggggtcgaacagcaggctcaacggcatggaaataaagcccaccaccgccgggatcaacttgccatggcccgccggaatctgcgccaccgccacttcggccatggccttgagcatgccggtgccttgcatgatgccggtgaacactccagcggcaagcaggatgctggccatggtcagggcagtcttggcatgggcgtcgatgcgcgcacgctgggcgtcgacgttcgggtagttgatgcacagcgccaccacggtgccgagcatgaacatcaccaccggatcgacccagccagcaatcatcaccaccatcaccagtacggtgagaatcaggttgagccagaacaggcgtgggcgacgcagcaggatgtcagcgtcactgagcacccgttgcggcacggcatccaccgtggaacccgcgcccaggcccaggcgtttttcttcacgatggcccagccaccaggcacaggcgaaaacaaacaccaggccgacgatctgcaccgggatcagcggctggaacagctccgccaccggcacatgcagcgccgccgaggagcgcaataccgggccggtccacggcaggaagttaaccccggcggccattgcgcagacgcaggcgaggatgcgtttgtcgatgcccagccgcgtgtacaacggcagcatcgccggcaccgtgacgaggaacgtcactgcgccggagccatccaggtgcaccagcaacgccagggtcgcggtgccgacgacaatgcgggtaggacgcgtgcctaccgtgcgcaggatgcggtcgatgatcgggtcgagcatgccggcgtcggtcatgatcccgaaaaacagaatcgcaaacacaaacatgcctaccacaggggcgacgttcttgatgccggtaatgatgaaggcgctggtttgcaggccgaaaccgccgagcagcgcggcgatgatcggcaaggcgatcagcgccaccagcggcgacaggcgtttgctcatgacggcagcgagcaggcacaggatggtaatgacacccagggtagcgagcatgggttactccagagcggccttggtggccggttattgttttccctggagtattggaagcgggttagtctttgtaaattggaatattcagacgccagcgttcggaaaaacaaaatgaagaattcgatgcagcatattcaagcgttcctcgcggtggcccgcaccggcagtttcaccaaggccgccaacgagttgcacttgtcaccgtcggccctgacggtgcaggtgcagcagcttgaagactggctcggcgtcgccctgctcgaccgcagcccacgccatgtcagcctcaccgccgccggccaggacgcacgtggcccgatggaaaaactgctgctggacctggacaacattgtcaccggctctcgcgacctggcggcactgcgtcgcggcgtggtcagcatcgccgccctgccatcggtatgcgccggcgccctgcccccggcgctgcgcctgtttcgcgagcgctttgccggcatcgaagtgcgcttgcatgacttggtggcccaccgcattcatgccgaggtccgcgaaggcctggtggatttcggcatcggcgtgcgtgcccgactgagccacgggctggagtttttaccggtgttgaatgatcgattgtgcgcattcctgccgctggagcatccactcgcccaccatcgtcaactgaccctggagcaactggcggagcagccgatcattctgaccgggcgcgacagcagtgtgcgcgagcaagtggatgcgctgtttgatcagacgcggctgaccctgaacgcgggcatgcaagccaattacatgtcgacggtgttggccctggtgcgccaggggcttggcatcagtgtgttgccggaatcggcggcggacagcctggaggggttgaagcgcatcaacatcgatcatcccggagtgaaccgggagatcgggttgatcagtcgcagcggcatgggcctgagcccggcggcgcagcgttgtttcgagctgctgagtgacgaactatctgacacaacatcacgctaaagtcggacacggtcaatgtgggagctggcttgcctgcgatgcaggcaactcggtctgtcaggttgacccaggtgatgccatcgcaggcaagcctgctcccacacaagctcactcccacagtttgatctgtgtttaatccagcatcggcacatgttttggatggctggccacgcgcttcaaccacgcctgcacggccgggtaaggcgtgaggtcaaaaccaccttcatgggccacatgggtgtaggcatacagcgcgatgtcggcaatcgaatattgctcgcccaccagatacggcgtggcttgcaactgacgttccatgaccctcaaggccttgtagccgcctttgtgggtggttttgtattcctccaggcgatcttccggcatgttcaggtagaactggataaaccgcgctaccgcgatatacggctcatggctgtactgctcgaaaaactgccattgcagcacttgcgtacgcaggcgcggctcgctcggcaggaactcgctgccatcggcaaggaagttgaggatcgcgttggactcccacaggcaagtgccgtcttccagctccagcaccgggatcttgccgttggggttcttggccaggaattcggcggtctgggtgtcgccgttaaggatgtcgacatcgatccattgatacgggatgcccagcaggctgagcatcaatttgaccttgtagcagttgcccgacttgtaatcgccataaaccttgtacatggggctccccttatgccgcttgcgcgagctgtgcttgccgaaccaccgcggccaggcgtttgagaccttcgtccagacgggccgggtcgatatggctgaaattgaggcgcaacgagccgtggtgctggtcgggctcggaaaagaacggttcaccgggcatgaacgcgacgtcctgatctaacgcttgcgccaacaaggtgcgggtgtcgagcggctgtttcaaggtcagccagaagaataatccaccctggggcacttgccagtcggccagctcgccgaaatggcgcgccaatgccgcctggaatgcatcgcggcgctcgcggtaaaagctgcgtagctcggtcagatgctgctgatacttctctgtgccgatccactgcatggcctgccactggccgatgcggttggtgtgcaggtctgccgattgcttgagcttgagcaagtgcgggaacagatccgggctggcaatcagatagccgacgcgcaagcccggcagcagggtcttggagaccgtgccggtgtagatccagctggcttttttcaggcgcccggcgatgggctgcgcactgccgccgtcgaaggtcagttcgcggtaaggttcgtcttcgatcaacgtcacgccgaactcatcgagcaaagccgcgacggccgcgcgcttggcttcgctgtagcgcacggccgaggggttttggaaagtcgggatcaggtagatgaacgccgggcggtggcgttcgaggctggcgcgcaaggtggccaggttcgggccgtcgacttccagttgcacggtcaggcagtcggcgccaaacagttggaagatctgcaatgctgcgaggtaggtcgggccttccagcaggactttggtgcctttgtcgatatacagcttggccgccaggtccagggtttgctgggagccgctgaccaccagcacctggctggcctggcacggtacgcccaaggcgcgggcctcggcggccagcaattcgcgcaactgtggctcgccttcgctcatgccgtattggccgatgttaagcggcatgccctcccagttcagcgcgggcagcatggcttcggccggcaggccaccggcgaacgacatcacttccgggcgctgggccgccgcgaggatttcacggatcaaggagcttttgaggcgcgtaacacgttcagagaaggccataaggtcaccggtagcgaagcctgtgggaaatacgtcaaactggttgaccgaaattacgacgacttgagtagatacgtcaatatgcttgaccttaaaaaccagagcagccagcaacaagccatggaagccttcttcttcggctatcaggccttcaccgccaaagccgatgaaatgcttgagcgccgtgggctgagccgggtgcaccagcgcatcgtgttttttatcgcgcgctaccccgccttgagcgtgaaggaactgctggagttgctcggcgtgagcaagcaggcgctgaacatcccgctgcggcaattgcaggaaatgcacttggtcgaaagcatcgcgtccgagaccgacaaacgtaagcgcctgctggaactgagcgaagaaggccagcgtttcgagcagtcgctgcgccgcgagcaggtgaagctgctgcaacgggcgttcagcgaagccggcgaagacgcggtgaccggctggctggcggtgaaccaggcgctggccgggcagccttgatgccggtaagtgcggctgtggcaggcaggcttgatgtggcgagcaggcttgccctggcgaacaggcttgctgtggcgagcaggcttgccctgcgttggggcgcgaagcggcccttgtgaagtcaccgcgttttttcagtcaaatctgactggcaggttttggggctgcttcgcagcccaacgcggggcaagcccgctcgccacagcaagcccgctcgccacaacatccacactcacctttcatccactttcgcccgcacaatcgaaaacattatttgctttatttgtatacaaaagcataattcgcttcgtgcgagttcctgacctattggtcaacaaaacccgccagtacctcaaagcgctgatgcccacctgtgtgaccggcgctggaaataacaataaaactcttgaggagtactcgctgtggaaagccgcaaatccgaagcccctacgctggatctatccccgccaagcctcacccccgcaaaacacggctggctggaacgcctgttcaaactgagcgcgcatggcaccacagtgaagaccgagctgatcgccggcctcaccaccttcatcaccatggcctacatcatcttcgtcaaccccaacatcatggccgacgccggcatcgaccacggcgcggcgtttgtcgccacgtgcattgccgctgcgctgggctgcctgttgatgggcctgtacgccaactggcctgtaggcctggcgccgggcatgggcctgaacgcgtttttcacctacaccgtggtcggcaccatgggctatcactgggaaacggcgctgggtgcggtgttcatctccggcgtgctgttcatgggcctgaccttgtcgcgggtgcgtgaatggctgctcaacagcatcccggtgagcctgcgtcatgccatgggcgcgggtgtcggtttgttcctcggggtgatcggcctgaaaaccgccggcatcatcgtcgacagcccggccacgctgatcaaactcggttccctgcacgagcccgcgcccctgctggcggcggtgtgctttttgctgattgcgatcctcagctaccaccgcgtattcggcgcgatcctcatcagcatcatcgccgtgaccctggctggctggggtttggacctggtgcactacaacggcattctctccaccccaccgagcctggccccgacgtggatggccatggacataaaaggtgtattcaatgtcagcatgataagcgtggtatttgcgtttctttttgtgcacatgtttgataccgccggtacactgatgggcgttgcccagcgcgccgggctggtggacgctgacggcaagatccataacctgtcgcgtgcattaaaggccgacagtgcgtcgagcgtgttcggtgccatggtcggtgtaccgcccgtgaccagctatgtggaaagtgctgccggtgtggccgctggcggtcgcaccgggttgaccgcggtgaccgtgggcgtgctgtttgtggccgcgatgttttttgcgccgctggccggcatgattccggcctatgccactgcgggtgcgctgatttacgtggcaatgctgatgatggcgagcatggcccacatcaattgggatgaagccaccgacagcattccggcgattgttaccgcgatcatgatgccgctgacgttctcggtcgccgacggcatcgccctgggctttatcacttatgtggcgctcaaggccggcaccggcaagtaccgcgaaatttccatcagcctgtgggtgctgtgtgtgatttttatcgcgaaattcatatttctataacaaggagcaaatgatgaacctggatacctggctgctgttcagtggtgctgcattgatcgtgatcctgattccagggccactgtcactgctgatgatcagcaacagcctcaactacggcttgcgccgctcctacccggcgtttctgggcggggtgtttgcgtcgatctgcttgttgagtgcttcggctttgggtctgggtgcattgttgctggcctcggaacagctgttcagtgccttgaaaatcgtcggcgcggcctacctgttctacctcgcctggcagagctggcagcaatcgcgccaaccgagccagggcgcggtggtgccggcagctgccgcaacgccgcggtttcgtacgctgtttggccgggcgtttgtgttgggcgccagcaaccccaaggacatcctgtttttcgccgccttcctgccgcagtttctcaacagccagcagccgttcctgccacagttgctggtgatgatcgccacctggaccgtgctcgacctgctgtgcaaactcacttacggcctgggcgcccatggcgctgcgcggtatctgcgcagcggcaagggccagagctggttcaaccgggtcagcgccacactgtttggcggcgcggcgacggcggcgttgctcaaggggtaaacggggcgattttggcaaaatacacactggccggttcgtcataacgaaccgaccattggatacccgccaccatcctgaccaaccgctgttccctcctggcgttgtcaatggcaataaactccaacgaatagggtgtcgccgcgctgatacggtcctgcaaccaggcgtcggaaagctgcggcgcaaccctggagcgtaggctgacggtgcgattatccacccagtgggtcagcacgaaatagaccctgtcggtgtgtggatgagtgcagtagaaatccatccccgataccccaccctggcgtcttgcgatgcctttgacggtaaacccatgatgctcgagcacacgcctgacggcggactgagcggcctgagagcgcaaggtagggaccccgacgtcgcgcctgagcaacgaggaattgaggtgatcgggcgggctgaaatccagtcgcacaaagcccggcgccagcccatcaatcccaatattggcactgcccgcacccggctcagccaccggcctgagcattttgaacaaatcgaccatacgccccggcgtttgcggtgccagccaatgatcgagggtggctctgatattgagcaaatgcgtggccgttatcctggacccggtgtctgccagttcagtcaggcgctcgccgacaaatcgccggctgttcacggtcaagtcgggaaaggccctgcccacagtgatgtccaagggctcattgaacagcggttgacggggcgtccacagcccattggcgccgagagtcgcgggcaccggctgctcggcgtcagcaatacccagccaacgctccatgtccacgtaggctctgaagtgaaggtcgtggtttttcatgataaacacgacccgctccgaagaggcgttggtgccctggggcagcagccggtaatagtagtgctgctgccccagttgcaatacctcataaggcggataacccggccccgctggcattcggtagattctgcgcgaaggtgccacctcggtcagcggctcaccgtgccacaccgtccagttttgccaggcgctgccggccaccggcgatgcatgcaaggccgcttccacccgcgcatgcgatggcggtgcccaatcactcgcgctgcgggtcggggcccaaggttgaaacacccctgaagacggccccgccacgggtgcatcggcccccaacagccattcgcggggatgctcaatcttcaagatcagctccccctcgccctcgcctggtgtttttttcagccgcaggcccccttcgttcgggcgctgatacaccgggtaaacctcatcaccctcgaccagtaactgctggccattcttcacataccgccccttgcctcccggcccctgcaactcaacggcgccctccaagccacccgatgatctgaagcgttccagcagattaaggggtctgctcggcgccactttcagccctgcacgcgcaaagccttgatgacgatgcacgggagccagggacgcccgagcagcgctggcgcccttggggcctggggcaaaagtcagcagcacatcgacaaaggagagcaccgtcaaaaacgccacatccaccgcgtcatgggcagagccgctgaaatgatagcgccgcgcggcgagcagcatttcatagaggctggcaccaatgcccagcaccgggacaaacgacagtaacccccgaatcgttgcgtcaaactgctcgcccaaacgctgttcgcggtattcctgcaacgcctgggcggactgggactgtgcttgagtacgccgttgcaggtcgaacacctgggcatgggccagcaacgccattgcattgccgccggacgtgggcacagcggccaaccaggcttggggcagcagcgcaatctgctccttgatctgggcctcgacgctgtcctgggcgactgccggcaccttatgccgaaccgtgaaaaactcggcgacccagctcaccacgcgctccatcgctacgatgcccagccggcccgaaaaacgccgcctggggctcaccccgaggtcttcaccggggtaacggtcaagcgcctgagactcccagccgggcgccacctggcgcgccagcactttcaggttatcgggtaatgcgcccagtcggttcaaggcgcgctcggcctcgaccaggctggcgtacccgacaatcacccggcttgccagtgccgtaggccaatacaccacacacagccccgaaggcttgtcatgaatcaacagcaccccggtgatgtggcgatcctgctccagggtcacgcccaccagacgcagcaccgccagttgcacgtcgaacccatcggcctgcaagtcaccggccgagcgtgcggccatcgcaaagctaaacaggcgctgggcctcttcgctcaggccttcttgcaccgccgaatacagctgcatctcggcgcgttgctgcaaggcccgatagaccagcgcctgggacaggccgctggacgcacctgaagtgggcaccggcgggtaaaaagcctgcagaacgtgcttgtcgtactcgccccccacatccagcgacgcgatcattttgatcaggtagcccacgctcaaacggtctttccagtgcgggtccagccagcgcgcacggttcaagcgccagcgcgtccagggcgccttggggtcgaggttgtgcagcgccaattgcaacaggctgaaggtcgtacgctgggggctgacgacttttttataatcacgatcgcccaccgcacactggctcgaccagccacacagctgagcactcacatcatcaggcaaatcgagcaagggtttgtcgatatccaactgcgggtaaaacccgtcttcgctcaatcgtgcaatcagcgcatcgcgggcaaacgcctcaaggtccggcaagtcttgccatagcttgttttccaccgcccaggcgttcgccagataacggcgtgacaactgcttgtagtgtttgcgctggcccgtcgaggcgatgccgagccacacaggcagctttttcgcctgcctggccgcctcctgcagcaggttgacgttggccagggccagtgttcgcgcatcattggcgggtatttgcaggcactcgaacaactcttgagccagcagcatggcgcttaacggcgggtcacttacctcgctgaacagtttttcgccctggtcgatacgtttttgcagcgccaggtaatgctgcaacagattgaggaacaggtccttgagtacattgcgctcgatcagcgtgtagctcacctgcaggggcgtgcccttgggcagcgcgctgatcgcagcccgcagctgcgcacgctggtgacgcccgatgcagcgccacagcatggacccgtcgcgacttttcaggctggcctgcaggccatcggcgaaggcgttcaggctgtcgaaaggcacgagcccgccttgctgccccaccacgtataacaccaccgggtgccggccggccggttgcgcccgagccgcgttggttgtcaccaacaccgcgccgagcaatgggtacaactcagccgcctcgccgcccaccgcgacctgcaacacacaggtatccgtaggttgctgaccgagcacccacgactcactcagcgccgcattcacccgttgcagatgcgcgggggtcatcaggttcaagcgctgttgcatctgggcctcgtagagcagtgcccgacgctgtgcaccccccaacaatgagccgcgactgagcgccccctggggtttttccagccagaacgccttttgcaacaggcgctcgtgtgggccatgcgcccacttgcgcgccgtctccacctgttcctgccattggcgctcaaggtctaaaacctcttggaaggccgcgctgtcgttggcaatgtccgtcgtatccagcaaggcgacaaggcctttttcatagcgtttgagcagcgcttcgcgagtgttcaacgcaagccccgacgccaggctgccgaacgcaatttcgccggcccgacgccgctggtcccactccagcaaagtgttcagggtgctgcccaagcgggcaaaccccaccaggcgcgagcggcccttttggatgtacttgagtaaccgttttacatccggcgcggctgactggcccgccccttgaatgcccaccgccgcggggttgatcgacaatgcacacgccagctcgttatcccactgcgcctccagtaactcggtggcgctggcgagcaacgcatcctcttgacgcgggccaatgagttgaagggtaaacgcgctcggcgtagcgctcggcgtgtcacacagttcatgccagcggcgcagcggcaggcactgccacaaaacgcggctcagcgggccgttgaccagcgccggcaggtcgcattgcagtcggtgccaggaactgaactcgtaaaactcacgcgaaaggcccggtaggtaaatcacatggggcgtatcccccaccacgccctcacggtaaatatgcaaggcccccgggatcggcaccagtgcctggttcgtgccgggccacgcgaccctgctcacctgaatgcatgcccattccccaccggcccgccgacgcgcatcggcgcccggcagttccatcagctggcgcagcatggcgaagccgttgtcggtcagttggtacaaacgatgcgcgagcagcgcattctcggcgaacactgacttgcgcaattgcgcccagtgttgcttgcgggtcagccaggagccttgcgccagttgctgccaatacgcgcgcatggcggcgtcaagccgaccgagcaacgccaggccgttgacccgctccagtgcttcacgggcggtaaacggcaatgggcgggaaggatcgtccttaacgctcaatgccgtgaactggttaatgttgagcggcacgtagggctggatgagcaagcccaatgcgcgctcggtcaggctgtcgatccgctggacgagagccggtggccgaggttcgctgaacagcacggtgtccgggtccaggccaaaggcttcgcgtaacgcgccgcgcaaaatccccagcactctgggcgcacgcccgatcaggccactgagcgcttttgctgctttgctgccccgcgtctgggcttcgtacaggcgattgatttcagcactgggctgcatgacggcgttgagccggcgggtcaacagcacgcgaatggccgcgtcgcgatccgcgctcgaggtgttcggatcatcgaaatcaagtgtgtcggcccaggtggcttcagcggccaacccagcggtggtgtcggtactcatggcggactcttccgtagcgaaagagccgagcctaggcaccccgaccgtgaagggtgcgttacatagttgggcggcctgtcgccacgccacaggcgaaaaaaagcccgcagtgtgggcgggcgaaaaaccaacgaagagctttgggggtgtgaagcgaggtgacgactcagctaccgcgatatgtggagtagctgtaaggcgaaatcagtagcgggacatggtagtgatcctgctcggcgctgatgccgaagcgcagtaccacgacgtcgagaaacgcaggttccggcagttgcacaccacgggcgcggtagtaatcaccggcgctgaattgcagctggtaaacgccgctgcggtagtcgtcgccttgcagcaacggcgcgtcgcagcggccgtcgctattggtggtggcggtggcaaccagttccagctgcgcaccttcgacgcggtacagttcaaccgtgattgcgctgccggggcagccatgtgcggcgtccaaaacgtgtgtggtcaagcgtcccatggcgtctgcgcgcctcccgaagtcagtagataagaagaccgcactttttcagggcatcaaaaagccggcgatggctgattaagacactttttaaaaaaattgtacacaataaaaatcacaaacctttggatcaccccagccacgttaactgccggggcgtttatcaggtaatccttgctttttaacgaccttttgtcctttagctgaccaagtaggcaagtttcttgctaagtcttattcccagggttctgcagaaaaaatgcagaaatgtaggcttacaaagttggcgataagttgtatacaatcactcatcgctgtgacgccacccagtcttttcactgcccggccgccacacacaccgctaccacgaacaagaaggaagactgcagtgagcgctgactacccacgcgacctgatcggttacggcagtaaccctcctcacccccactggccgggcaacgcacgcattgcgctgtctttcgtactcaactacgaagaaggcggcgagcgcaacatattgcacggcgacaaagagtccgaagcctttctttcggaaatggtctcggcccagccgctgcaaggcgagcgcaacatgagcatggagtcgctgtacgaatacggcagccgtgccggtgtatggcgcatcctcaggctgtttaaagagttcgacattccgctgaccatcttcgccgtggccatggccgcgcagcgccacccgaatgtgatccgtgcgatggtcgctgccggccatgagatctgcagccacggctaccgctggatcgactaccagtacatggacgaggcccaggagcgcgagcacatgctcgaagccatccgcatcctcaccgagctgaccggcgaacgcccactgggctggtacaccgggcgcaccggccccaacacacgcaggctggtgatggaggaaggtggcttcctctacgactgcgacacctacgacgacgacctgccttactgggaacccaacaaccccaccggcaagccgcacctggtgatcccttacaccctggacaccaacgacatgcgcttcacccaggtgcagggtttcaacaagggcgatgactttttcgagtacctcaaggacgccttcgacgtgctgtatgccgaaggcgccgacgcaccgaagatgctttccatcggcctgcattgccgcctgatcggccgccctgcgcgcctcgccgccctgaagcgttttatcgaatacgccaagggccatgaacaagtctggtttacccgccgcgtcgacattgcccgtcactggcacgaaacccacccgtacacgggagcggcgaaatgactgcgttccacaccttgaaaccgtcgaccctgagccgcgatgcgtttgtcgccgccttcgccgatatctacgaacattcgccatgggtggccgaaaaggccttcgacctgggccaggatgcgtcgatcgaccaggtcgaaaccctgcaccagcgcatgagcgacatcctgttgagcgctgatcacgccagccagctggcactgatcaatgctcacccggacctggcgggcaaagctgccgtccagggccaactcacccaagccagcaccgatgagcaagccggcgcggggattcaccaatgctcgagcgaggagttttctcgcttcaccgagctgaacgatgcctacaaggccaagttcaagtttcccttcatcatggcggtaaaaggcagcaaccggcatcaaattctcgccgcgtttgaaacgcgcattcacaactcggtagacgccgagttcaaatgcgccctggccgagatcaacaaaatcgcgttgttccgtttactgactctttaagcagacctggcccgagcggttcatgaacgcccagggtctggcgagcatcccaagccactctatttaaggcagacaagaagaatgaaagcttacgccgtacctttcgagaaattcgtcaacctggccgacgcgcgtctgggcaccaagatcctttcggtgaccgatgactggttcgctgacgccaaccgcctgttccagccgaccccggccgtgtggaaggagggcgttttcgatgacaacggcaagtggatggacggctgggagtcgcgtcgcaagcgcttcgaaggctacgacagtgcggtgatccgcctgggcgtaccgggctcgatcaaaggcgtggacatcgacacttcattcttcaccggcaactacccgccgtcggcctccctggaagcctgcttcctggcctcgggcgaccctgatgaaaacacccagtgggtggaagtgctgtcggccgtcgagctgcaaggcaacagccaccactaccacgagatcagcaacgataaggcgttcagccacctgcgcttcaacatctacccggatggcggcgtggcccgcttgcgtgtgtacggcgtgccgttccgcgactggtcctcggtgggtgacaacgaacaggtcgacctggctgccgcactcaatggtggtcgcgccctggcctgttccgatgaacacttcggccgcatgagcaacatcctcaacccgggccgtggcatcaacatgggcgacggttgggaaaccgcacggcgtcgcacgccgggcaatgactgggtgatcgtcgcgctgggccaccccggcgagatcgaaaaaatcatcgtcgacaccctgcacttcaagggcaactacccggacacttgctcgatccagggcgcgttcgtgaagggcggcaccgacagccagatcgaaacccaatcgctgttctggcgcgaactgctgccggcacagaaactggaaatgcacgccgaacatacgtttgccgagcagatcaaggcgctggggccgattacccatatccgcttgaacgtgttcccggatggtggtgtgagccgtttgcgcgttctcggtaaggtcgcgaaataacacccgatcgttcccacgctccgcgtgggaattcataccgtgacgctctgcgtcacaacagcggacgcagagcgtccagggcggcgttcccacgcagagcgtgggaacgatccacagaactcggataagagacagccatgcgcacactgatgatcgaacccctgaccaaagaagccttcgcccctttcggagacgttatcgaaaccgagggcagcgatcacttcatgatcaacaacgggtcgaccatgcgctttcacaagctggcaacggtagaaaccgcacagcctgaagacaacgcgatcatcagcatcttccgcgccgacgcgctggctatgccgctgaccgtgtgcatgctggagagacacccgctgggcagccaggccttcataccgctgctcggcaacccctttctgatcgtggtcgcgccacttggcgatgcacctgtatcgggcttggtccgcgccttcgttaccaacggcaggcagggcattaattaccatcgcggcgtctggcaccacccggtgctgacgatcgaaaagcgggatgacttcctggtggttgatcgcagtggcacaggcaataactgcgatgagcattttttcaaagaggatgagcggttgatcctcgccccccaccaataagagaaggtctgatcacccgacaacaagggtgacaggcgagaggtaaagactgtggaagcacatttgatggaatggctgaacctgagcgtgcgctgggttcacatgatcactggcgtcgcctggatcggcgcttcgttctacttcgtctggctggaaaacaacctcaatcgcgtcaaccccaaggacggcctggccggtgacttgtgggcgatccacggtggtggtatctaccacctggaaaaatacaaactggccccaccgaccatgccggacaacctgcactggttcaaatgggaagcctatttcacctggatgtcgggcatcgcgctgctgtgcgtggtgttctacgccaacccgaccttgtacctgctggccccgggcagcagcctcagtggccccgaaggcgtactgctgggcctcggctcactgttcgtcggctggttcatctactccttcctctgcgactcggccctgggcaaacgccctgccctgctcggtttgatcctgttcgtgctgttgattgccgccgcgtacggcttcagcaaagtgttcagcggccgtggcgcctacctgcacgtgggtgcggtgatcggtaccatcatggtcggtaacgtgttccgcatcatcatgccggcgcagcgtgcgctggtggcggcgatcgccgagaaccgcacgccggacccggccctgccggccaaggggttgctgcgctcacggcacaacaactacttcaccttgccggtgctgttcatcatgatcagcaaccacttcccgagcacctacggcagccaatacaactggctgatcctggccggtatcgcggtggcggcggtgttggtgcgtcactacttcaacacccgtcataacagccagaagtatgcgtggaccttgccggcgggcgcgttggcgatgatttgcctggcctacgtgaccggcccgaaaccagtggcgactgcaccggacgtggccaaggcaccggcggccatcgagtaccagccgttgccggaaaccgcgctgggtggtggcctcaaacccgccgcgccagccgccccggcagcacctgctgcggcacctgcgcccgcccaggcgtcgattgatttcgacaaggtgcacggggtgatccaggaacgctgcgcagtgtgccattcggccaagcccaccagcccgctgttcagcaccgcgccggccggcgtgatgttcgacaccccggcgcagatccagcagcaggccgcgcgcattcaagcacaggccgtggccagccagatcatgccgctgggcaacatcacccagatgacccagcaggagcgggatttgattggcacctggatcaatcagggagcacgcaccaactgatagcctgctctagatcaaatgtgggaagagcttgtgtgggagctggcttgcctgcgatcgcatcacctcggtagacctgattcaccgaggtgcttgcatcgcaggcaagccagctcccacacaggccagctcccacatttgagatcagcgttgctctgatgatcgcgtttcaaatggcaattgaatgccaaacaacacaaaaataaaaagatccgaggtgttgcatgtcccagttagaaccgcagactcctgccgtgcccgcgatggtgcggctgcccctcttgcaactgattctggtaggcctgcaacacgtcttgctgatgtacggcggcgccgtcgccgtgcccctgattattggccaggccgcgggcctcggccgtgaagaaatcgcctttctgatcaacgccgacctgctggtggcgggcatcgccaccatggtgcagtcgttcggcatcggcccggtgggcattcgcatgccggtgatgatgggcgccagtttcgccgccgtcggcagcatggtcgccatggccggcatgcccggtatcggcttgcagggcatctttggtgcgacgatcgccgccggtttcttcggcctgctgatcgcgccgttcatgtccaagatcgtgcgctttttcccacccttggtcaccggcaccgtcatcaccgccatcggcctgtcgctgtttccggtggccgtgaactgggccggtggcggcagcgctgccgccacctttggctcgccggtttacctggcgattgccgcgctggtgttgggcaccatcctgctgatcaaccgttttatgcgcggcttctgggtgaatatctcggtgctgatcggcatggccctcggctacggtttgtgtggcatgctcggcatggttgacctcagcggcctggcccaagcgccgtgggtgcaggtggtgacgccgctgcactttggcatgcccaagttcgagttggcgcccatcctctcgatgtgcctggtggtggtgattatcttcgtcgagtccaccggcatgttcctcgccctgggcaagatcaccggccaagaggtcacgccaaagatgctgcgccgtggcttgctgtgtgatgccggcgcgtcgttttttgccggttttttcaacaccttcacccattcctcgttcgcgcagaatatcggcctggtgcagatgaccggcgtgcgctgccgttcggtgacgatcatggccggcgtgtttttgattgtgctcagcctgttgcccaaagccgccttcctggtggcgtcgattccaccggcggtgcttggcggcgcggcgattgccatgttcggcatggtcgcggccaccggcatcaagatcctccaggaagccgacatcgccgaccgccgcaaccagttgctggtagcggtgagcatcggtatgggcctgatcccggtggtgcgtccggagttcttcgcgcaactgccgctatggatgagcccgattacccacagtgggatcgccatggccaccctcagcgcgttgtcgctgaatgtactgttcaacatcctcggcggggctgaacgacccgtcgtcgcctctacacactgatgcgttcctgctcttaacaaaaataataacgaacaggtaactccctcatgcacgccattcacctggggcaggccacaagccgcgccccattcttgccccacgcgctctctaacagcgcacttgagccaaggcctgagagccagtattctccgcgcccgctcgaatcgactcaaaaaaaaacagcgaatgtaaaagctgactgcagggccaacttatcctggccccgtgtctgcggccaacgtgcactaaaaaacctgcgtaatcgactgcatcaagtgcagccgaaggcgttttattggctttttaaacaccttggcgcagctcttgctaaaagcattaaagctgaccaaacagacgatttttgcagcgaaccaaaaggcgccacaccagagcgcctgcgtagaaaaacaaccataaaactttgactcgggagcaaccgaatgaaacctatgttgaaaggcctgatgctggcgggatccctgctggccggtggccaagccatggccggcgacttgttgcagtggcagaacaacagcctgacttacctgtggggcaagaacttcaccgtcaacccgcagatccagcaaaccgtcaccttcgaacatgccgacgcgtggaagtacggcgacaacttcctgttcgtcgaccgcatcttttacaacggcaaggaagatggcaacgtcggccctagtacttactacggcgagttcagcccgcgtttgtcgttcggcaagattttcgacaaagacctgtcattcggcccaatcaaagatgtgttgctggcgttcacttacgagttcggcgaaggcgataacgagtcgtacttgctgggcccgggctttgacttgaacatccccggtttcgactacttccagttgaacttctaccaacgccagaccgaaggcaatcggccgggtgacggcgtctggcagatcaccccggtctggtcgtacaccattccggtgggcaactccaacgtgttgatcgacggtttcatggactgggtggtggacaacgacaagaacgcccgtggcacttatcacgccaacctgcacttcaacccgcaggttaaatatgacctgggcaaggcgctgcactggagcgaaaaacagttgtatgtgggttttgaatacgactactggaagaacaagtacgggattgaagattccggcgcgttcaagactaaccaggacaccgcgagcttcctggtcaagtaccacttctaaaggttaaccgcgatcccctgtgggagctggcttgcctgcgatagcgatgtgtcagccactacatttggcacagatataccgctatcgcaggcaagccagctcccacatgtttagatcggtgacaggcctaagaatctggacaattcctcgcgcttggccaacgcatccttcctgcccaactcaatcaactcgctgcaataccccgcctcgaacagcaggtaactcaacacccctgccccactggtcttggtcgctcccggcccacgcaggaacaggcgcaacgccgccggtaactcctggcgatggcgcgcggcgatctcgtcgatcggctggctcggcgcaatcaccagcacctccaccggcgccaacccctgtatcgccgcgtccgccggcaagacatgactgaactggttcaaacgctcaagcaattcgatatcactttccaggctgtcgatgaaggtgctgttgagcatgtgcccaccaatctgcgccagggtcggttcctggccggtgtacgtgcgttgcgtcgcaggttcattgccgcgtgggttgccgcttacgcccaccaccagcacgcggctggcgcccaggtgcaacgccgggctgatcggcgcggactggcgcactgcgccatcgccgaaaaactcctggtcgagcttgaccggcgcgaacagcaagggaatggccgagctggccagcaggtgttcaaccgtgagttgggtcggcatgccgatgcgccgatggcgcagccaggcattgatggtgccgccaccttgataaaacgttaccgcttgcccggactcataaccgaaggccgtgaccgcgacggcatgcaggtggttgttgcggatggccgcgtcgatcccgtccaggtgcagtttgtctttgagcagcgcgcgcagcggcgtgctgtcgagtaacgccaccggcacctgggcgcccaggccgagcaggctgtggatcaggaaacgactggcctggcggatcacgccgggccagtcgctgcgcaacaccaggtggctgcgaaagccctgccagaacgccgtgaggcgctcgatggcggctttgaaatcagtcgccccgctggccaggctcaccgcattgatcgcccctgccgacgtgccgacgatcaccggaaaagggttcggcgcccccgctggcagcaactcggcaatcgccgccaaaacgcccacctgatacgccgctcgcgccccgccgccggaaagaatcaagcctgtgaccggttcagctgggcgcattgcatcactccatgtggcgaacagtaggtgttatcgacggcgcttttcgtacagcttaggctcacccggcggccggctcttgaagcgccgatgggtccacaggtattgctcggggcattcccgtaccgaggcttcgacccactggttgatgcgcaggcagtcgatctcatcggtttcgccggggaagtcggtcaacggcgggtggatcaccagccggtaaccactgccgtcagccaggcgctcctgggtgaacggcaccaccagcgccttgcccaggcgtgcgaacttgctggtggcagtgacggtggcggcctgaatgccgaacagcggcacgaagacgctttgcttggcgccgtagtcctggtccggcgcataccagatggcacggccggcgcgcagcagcttgagcatgccgcgcacgtcttcgcgctcgatggccagggagtcaaggttatgccgctcgcggccacggcgctggatgaagtcgaacagcgggttgccgtgctcgcggtacatgccatcgatggtgtgtttctggccgagcaacgccgcgccaatttccagggtggtgaaatgcagggccatgaggatcacgcccttgccatccaactgcgcctgcttgaggtgctcaagcccttcgacatgcgccaggcgcgccaggcgcgggcgcgaccaccaccagctcatggccatttcaaagaaggcgatgccggtggaggcgaagttttccttgagcagcctcttgcgctccttggcggatttttccgggaagcacagttccagattgcgtgcggcgatgcggcgacgttcgccggccacgcggtacatgcccgcgcctaataagcgaccaatggtcaacagcgcgcggtacggcaactgagtgatcagccacagcaggccgagtcccagccatagcagccaaaaacgcgggtgaaaaaatacagctcgaaaacgcgggcgatccattacagattccggtaaagacagggccgcgcattctacaacgttcgactcggcttgcggcccgtggatgttctcgttataagtctcgacacttttcgtgacaagccgcttttgccgaccatgagccaaaccgaaccgctagaccaagatcccgtgttccagctgaaaggcagcatgctcgccatcaccgtgctggaactggcccgcaatgacctcgacgccctggaccgccaactggccgccaaggtcgccctggcgccgaactttttcaacaatgccccgctggtgctggccctggacaaactcccggccggccagggcgccattgatttgcctggcctgatgcgcgtctgccgctcgcatggtttgcgcaccctggcgattcgcgccagccgtatcgaagacattgctgcggcgatcgccattgagttgccagtattgccaccgtccggtgcccgcgagcgtccgctcgacccgaccgaaggtgaagtgaagaaaaaaccggaaaaaccgccggagcccaccgtcaagcctacaaagatcatcacctctcccgtacgcggcgggcagcagatttacgcccagggcggcgacctggtggtgatcgccccggtcagccccggtgcggaacttctcgccgatggcaatatccatgtatacggcccgatgcgcggacgtgccctcgccggcatcaagggtgataccaaggcgcgtattttttgccagcagttgaccgctgagctagtgtccatcgcaggccagtacaaggtttcagaagatttgcgccgtgatccgctgtggggggccggggtacaagtcagcctgtcgggcgatgtgttgaacatcatccgtctttaacggatactgccgcattttccaagcatctctagactctgatagcaaagcgaaaccggcaagacttgcgtaggaataattggaagttggcgtttccccatggaaaccacatctttttcctacaaaggctgtccgcctgcggcgagttccaagagatgtttttcagggactgaaaagtcctttttccttaggggtgaaacaccttggccaagattctcgtggttacatccggcaagggtggtgtgggtaagaccaccaccagcgccgctatcggtaccggcctcgctctgcgcggccacaagacagttatcgtcgacttcgacgtcggtttgcgtaacctcgacctgatcatgggctgcgaacgccgcgtggtgtacgacttcgtcaacgtggtaaacggcgaagccaacctgcaacaggccctgatcaaggacaagcgtcttgagaacctgtatgtactggccgccagccagacccgcgacaaagacgcgctgaccaaagaaggcgtaggcaaagttctcgccgagctgaaagaaaccttcgaatacgtggtgtgcgactccccggccggtattgaaaccggtgctcacctggcgatgtacttcgccgatgaagccatcgtggtgaccaacccggaagtgtcctcggtacgtgactcggaccgcatgctcggcctgttggccagcaagtccaagcgcgccgaagaaggccaggacccgatcaaggagcacctgctgctcacccgttacaacccggagcgcgtcagcaatggcgaaatgctcggtgttgaagacgtgaaggaaatcctcgcagtgaccctgctgggcgtgattccagaatcccaggcggtcctcaaggcgtccaaccaaggtgttccggtgattcttgacgaccagagcgacgccggccaggcgtacagcgatgcggttgatcgcttgctgggcaagaccgtggaacatcgcttcctcgatgttaagaagaagggattcttcgagcgtatctttggaggcaactaaacaatgaaatttctcgacttctttcgcgccaacaaaaagccaagtaccgcgtcggtagcgaaagagcgtctacagatcatcgtggcgcacgaacgcggccaacgcagcaccccggactacctgccagccttgcagaaggaactggtcgaggtgatccgcaagtacgtcaatatcggcaacgatgacgtgcatgtcgcccttgaaaacgacggcagctgctcgattctggaactcaatatcaccctgcctgatcgttaatcgaaaaggcggctgccacggcggctcggtcaccttgatcccttttggggaaccgggtgggcgagccgccgttggcgtttgttacgaggctgtttaatgccgctgtccaatatccatatcctgtatcaggacgccgccgtcctggtggtgaacaagccgaccctgctgctctcggtgcctggccgcgccgatgacaacaaggattgcctgatcacccgcctgcaggaaaacggctaccccgaagcccgcattgtccatcgcctggactgggaaacctcggggatcatcctgctcgcgcgggacgccgacacccaccgcgaactgtcgcggcagtttcacgaccgcgaaaccgaaaaggcctacaccgccttggcctggggccagccggcactggacagcggcagcatcgacctgcccctgcgctacgacccgccgaccaaaccccggcatgtggtcgaccacgagttcggcaagcacgcgctgaccttctggaaggtattggaacgttgcggcgattggtgccgcgtcgagctgacgccgatcaccgggcgttcacaccagttgcgcgtgcacatgctgtcgatcggccacccactgctcggtgatggcctgtacgcccatgagcaagccctggccgcgtggccgcgcttgtgcctgcatgcgagcatgttgagctttacccacccgcaaagtggcgagcgtttgcgctttgagtgccctgcccccttttaatctacacaccaggctaatgtgggagctggcttgccagctcccacattagcctggtgtagttttcaacagcgcagcttcacttcaaatgtggagccaatacggtaaactccgcgcattgctgtctggagctatttatgcgcgaagcgttgaatcaaggcctgatcgacttcctcaaggcctcccctactccttttcatgccactgccgccctcgcccagcgcctggaagcggccggttaccaacgcctcgacgagcgcgaaacctgggccaccgaggccaacgggcgctactacgtcacccgcaacgactcctcaatcatcgccttcaagctcggccgccactcgccgctgctgggcgggattcgtctggtcggcgcccacactgacagcccgtgcctgcgcgtcaagccgcagccggagctgcaacgccagggtttctggcagttgggtgtggaagtctatggcggtgcgctgctggcgccgtggttcgaccgcgacctgtcgctggccggccgcgtgaccttccgccgcgacggcaaggtcgagagccagttgatcgacttcaagctgccgattgcgatcatccccaacctggccattcacctgaaccgtgaagccaaccagggttgggcgatcaatgcccagaccgaactgccgccgatcctcgcgcaatttgccggtgacgagcgcgtggatttccgcgccgtgctcaccgaacagctggcacgcgagcatggtttgaacgccgacgtggtgctcgactacgagctgagcttctacgacacgcaaagcgcggcggtgattggcctcaatggcgacttcatcgccggggcgcgcctcgacaacctgctgtcgtgctacgccgggctgcaagccttgctcaccagcgaaaccgacgaaacctgcgtgctggtgtgcaatgaccacgaggaagtcggctcctgctccgcgtgcggcgctgacggcccgatgctggaacagaccctgcgccgcctgttgccggaaggtgatgaattcgtacgcaccattcagaaatcactgttggtgtctgccgacaatgcccacggcgtgcaccccaactacgccgagaaacacgacgccaaccacggcccgaaactcaacgccggcccggtgatcaaggtcaacagcaaccagcgctacgccaccaacagcgaaaccgccgggttcttccgccacctgtgcatggcccaggaagtaccggtgcagagctttgtggtgcgcagcgacatgggctgcggctcgaccatcggcccgatcaccgccagccacctgggcgtgcgcaccgtggacatcggcctgccgacgtttgccatgcactcgatccgcgaactgtgcggcagccatgacctggcgcatttggtgaaggtgctgggcgcgttctatgcgagccgtgatctgccctgagaccggggcgcggccatcgcgggcaagcccgctcccacattggaatgtgtttccctgtgggagcgggcttgcccgcgatagccatttcagtcgcacacaaagctgtctgacttacatcaacccacgtttgcgcaatccggcctagacttgtcactattcccactccgacaaggccgtcgccccatgatctccatgtcctccttccacgccatgctcatccccatcatcatcggcatgatcctgctcgcgaccggtttcaactttcgcgacaagccgctgggcgtgtttggcatgtggatcggcatgctgctgatcctgggcacggtggtttacaaaatcctcgccaaactggcggaatgacaaatgcactcgcattgggcataacggcctcgtacactcggtcaattcgtcgttttcaaggttgaccgcctcgtgctctcgcgtctttttgccctgccccgctacgtcctgattaccctgctgatgctgctgccgctcgcacctgcccacgccgtgagcttgcccggcctgctcggcggcgccaacaagacccaaccccaggccgatgtgccgctggggcagtcgttggatgaggtgatcaaaaccctggagaacgatcagcagcgcacccagctgttgagcgatttaaagaagctgcgcgaagccacgcaaaaggctcaacccgccaccgaacaaggcgtgctcggtttgatcggcagtacgctgtccggccttgagcagcagttctccggcgccgacagctcgctgggccgctggtccaacgaggtcgacctggccaaggatgaactcgctgcgctgatgctgccggccagcgaatggctgccgatcattttcggctttgccgtgatcctggccgtgtggagcctgctggccgccgcgctgatctggctcagccaccgtctacgcgaacgtttcggcctgcccgaagaactgccgcaacacccgcgcacctgggacatgttgcgcttcgccctgcgcaagttggggccgtggctgatcgccctggtgatcaccgtttacctgagctacgccctgccttcgtccctgggcaaatccctggcgatggtgctggcttacgcgctggtggtcggcacctgtttctcggcaatctgtgtgatcgccttctccgtactcgacggcccgcaccgccaccgagcgctgtatatcctgcgtcaccaagccttccgcccgctgtggtggatcggcagtttcgccgcctttggcgaagccctgagcgacccacggctggtaacggccctgggccagcatctggcccacacggcggcgacggtcgccaatgtgatggcggcgctgtccaccggcgtgtttatcctgcgtttccgccggccgatcgcgcacctgatccgcaaccagccgctgtcgcggcgccttacgcgccgtgccctcaccgataccctgtcgatcatcggcaccttctggtacttgccggcattgttgctggtgggcatttcactgttcgccaccttcctgtccgccggcgacaccagcaccgccttgcgccagtcattgttgtgcacggtgttgctggtgttgtgcatggtcatcaacggcctggtacgccgccatgcgctcaagccacaacgcgggcacaagcgccacgcgctgtactccgatcgcctgaaaagcttcgtgtataccctggctcacttagtggtgtggctggtgtttatcgaactcggcctgcgcgtatggggcctgtcgatgattcgctttaccgaaggcgacggccatgaaatcagcgtcaagctgtttggccttggcggcacgctgttgttcgcctggctgatctggatcctcagcgacaccgccatccaccacgccctgacccgctcgcgcaaaggcctggcgaatgcgcgcgcacagacgatgatgccgttgatccgcaacgtgctgttcgtgaccatctttatcatcgccgccatcgtggcgctggcgaacatgggcatgaacgttacgccgctgctggccggtgccggtgtgatcggtatcgccatcggttttggtgcacagtcgctggtggcggacttgatcaccggcctgttcatcatcatcgaagactcgctggccatcgacgactacgtggatgtcggcggtcacctcggcaccgtcgaaggcctgactatccgtaccgtgcgcctgcgcgacatcgacggcatcgtgcacaccattccgttcagcgaaatcaagagcatcaagaactactcccgcgagttcggctacgcgatcttccgcgtggcgatcccctacaacatggaaatcgacgacgcgatcaaactgatgcgcgatgtcggccagaaaatgcgcaacgacccactgcaacgccgcaacatctggtcgccgctggagattcagggcgtggaaagctttgagtccggcagtgcgatcctgcgggcgcggttcaaaaccgcgccgatcaagcagtgggaagtgtcgcgggcgttcaacctggcgctcaagcgtcagctggatgaagccgggctcgacctggcgacgccgcgcttgagtgtgcaggtggtcaccgccggcaccgtgcaggagaaagaaccacaacaataaagagggagaggtacttatgcgtttgaacggtctgacacacccatgggttttcggcatgctctgcgggctcgccagcagcgcagtgattgccgccagcagcggccaggagagcgcccgggaggaaatcgccgcccaggcaaaaagccttgaaccggcgttactggaaacccgccgcgatatccacgcccaccccgaactgggcaacaccgaaacccgcaccgccgaactggttgccaagcaattgcgcgagctgggccttgaggtaaaaaccggcgtggcgcgcaccggcgtcgtcgcgatcttgaagggcgccctgcccggcccgaccgtggcccttcgcgcggacatggatgcactgccggtcaaggaagtcgccgacctgccgttcgcctccaaggccaaaggcacttacctgggcaaggaagtcgacgtgatgcacgcctgcggccacgacgcccacaccgcgatcctgctgagcacggcaaaaatcctcaccggcatgcgcgaccgcctgcccggcaccgtggtgttttatttccagccggccgaagaaggcccgagcgactttatccccgacggcaaaaacacctggggcgcgaagatgatggtgcaggaaggcgtgatgaaagcgcccaagccagacgccgtattcggcctgcatgtgtgggccggtgtaccggccgggcagatcgcctatcgccccggcccgaccctggccagctccgatgacctgcgcatcaaaatcctcggcaagcagacccacgccggccgcccttgggacggcatcgacccgatcaccgtcggcgcgcagaccattgtcggcctgcaaaccgtggtcagccgccgcaccgacatctcgtcatttccgtcggtggtgagcatcggcaccatcaatggcggcacccgctacaacatcatccccgagtcggtggacatgagcggcaccattcgctcctacgactacggcattcgccagaagctgcacgcggacgtgcgccagaccgtggagaaaatcgcggaaagtggcggcgccaaggctgaagtcacgatcatcgagaagtacgacccgaccatcaacaacccggcgctcaccgagaaaatgctgccgagcctgcgctgggcggccaaggatgatgtggtgcaaggcccgctggtgggcggtgccgaggacttctcgttctatgccaaggaagcgccggggctgtttgtgtttctgggggtgacaccgagggatcaggacatgagcaaggcggcgccgaaccataatccggggttcttcgtggatgaatcggcgttggtggtgggggtcagaacgttggcgtcgttggcgaccgattacctgtacaccaacacaccgcagtagagcttcatgtgggagcgggctcgcccgcgatagcggtgtatcagtcaccgaatagttagactgatacgccctcatcgcgggcaagcccgctcccacattgggtttgcggtatttcagccggccagcgcagcgccgtccatcttctggcgcaggctcaacgggcgcatatccgtccagacttcctcgatgtaagccaggcactctttcttcatgccgctcttgcccacggtgcgccagccttccggcacggccttgtagtcaggccagatggaatactgttcttcgtggttgaccactacctgaaacaggatgtcgtcgcggtcaaatactgaggtcattgctgttctccatcgcttatagggctggctgcgcaccacgcgcagcgctgatatctgtagaaacgtaccaagcgtgcgaaaaattagaggctggcgaccgctgccgccaaggcgcgtccgaagatctcggccacctgatcgatttgggcggcggtgatgaccagcggaggcaagaagcgcacgacgctgccatgccgcccgcccaactccaggatcaggccacgcttgaggcattcgcgctgcaccagcggcgccagttgacgatgcaccggtgggtggccctggctatcgggcgcgccgttcgggtccaccagttccacgccgagcatcagcccgcgcccacgaatatcccccaactgcgggaagtcgcgctgcaggatgcgcaggtgctcaccgagacgctcgcccatggcggcggcatgcccggccaggtcgtgctccttgaggtagcgcatcaccgccgaacccgccgccatcgccatctggttgccgcggaacgtgccggcatgcgcgcccggcaaccacgtgtcgagccagtcgcgatacaccaccaccgccaacggcaagctgccgccgatggccttggacatcaccaccacatccggaatgatgccggcgtgttcgaaggcaaacattttgccggtgcgaccgaaaccactctggatttcatcgacgatcaacgccacgcccgcctgttcggtgatgcgccgcagaccgcgcagccagtcgagatcggcggggatcacaccgccctcgccctgcaccacttcaacaatcaccgccgccggcaacaacaccccggcttcggggtcattgagcaggttttccaggtaatgcaggttaacccgcacaccttccgcgccgcccaggccgaaggggcaacggtagtcgtagggatacggcaggaattgcacgccattgccgagcaaggcgcccaagggtttttttggccccaggctgcccatcaggctcagcgcgccttggctcatgccgtgataaccgccctgaaaggacaacaccgtgctgcgaccggtggcggtgcgcaccagcttcaacgcggcttcgacggcgtccgtgccggtagggccgcagaactggattttcgcttcccgcgccaacgcagcgggcaacaggccaaacaggtcttgtacgaactggtctttgaccggggtggtcaggtcgagggtgtgcagcggcagttcgtcgctgagcacttgttgaatggcttggatcaccaccgggtggttgtggcccaacgccaacgtgccggcgccggccaggcagtcgatgaaactgcggccctccacgtcctccacgtagatacccttggcgcgtttgagcgccaggggaatgcgccgagggtaactgcgagcgttggattcctgctggcgctggcgggccagcaacggggtttcttcgaactggtagagcgtttccacgggtgccgggctggcgtgcaccggggcgtcttcgatacggctggtagcgactgacatctctcgatccctcaatacgcgggtggggtgaccaaactgccgatccgcgcatgtgcggatttcatgttctggagacgcaccagcggttgggggatttaggcttgttgtggtttttgattgatcgttcccgcgctccgctgatcgttcccacgctccgcgtgggaatgcatcccgtgacgctccgcgtcaccagacattcacttacagcggtacgcggagcgtccgtggcgccattcccacgcagagcgtgggaacgatcagcgataccgctcattcaacgcatacaaaatcgcacacgtctccccatccagaaccccggaataatcgcggctgcgaaagtgcatctgaaacgcccgcgtgcgcagcgcaaacgcctggcgattctgcgccggcttatacccatagcgctgaaaggcgcgctccacctcgacctccggcggcaacccaaggcaaaaccggcgctgatacatcgcccgcgtcgactcatcaaaccaggccccgatcccggcctcgaacaaacatcgccaaggcaaccgcggtcccggatcactcttgcgccagtacgccacatccgaatgcccgagaatgtccgtcggccctagctgtgggtagcgcccaagcaggtcgcgaaccaacgccaccaacacatctatttgctcctcagcgtacgcaggaaaggtaaacaccccgccatcatcgcgggccaaattgaccatctcgatgccaatggatcggctattaagattatcccgcccagcccaatggctcaccccggcatgccaggcgcgcttatcctcgtccaccagacgaaacgcgcgcaattcgtcatagcccatggcgcgatagccggggtcatcaggatcgggcagcagatagtgagcgctgacaccgtcttgcgtcagcgtacgcaatgatgaggcaaagggcgccgcggtgtagtgcaggatcacctgccgcacggtctcgccgttgcgttgattgaaatccctggccgggaaactgctatcgataaccaacataagaaccgtccttttcagtacaggccgagtcattcagcccgttcaagcgcaaaaaaattaccgccatcctgaagcgctgaacttcaaaaaggcggtaactatttggcccatgaaaagagggatcagtgtcgcagcggcatgcccaggtctacccgcaggccatccggctggctgtcgaacttcaacgagcaggagcagcgttgcacgatagcctgcacaatcgccaaacccagcccgcagccctcgctgctgccattgcgccagaagcgttgggtcaggtattgcaggtcctcactggaaatctgcttgccatggtcacgcacgcggaacaccaccgtatcggcggtagtgaatacattcagttccacgcgggtatcactcggcgtgtgccgcagggcgttatccaacaggttgcgcagggctgccaccgccagagccaccggcatttccaccggggtttcagtcaggttggtcgacaggatcaaatcgatacgccgattgtcaccggcgttggcatcctggatcgccagccgcgccacctgttcggcgctggattgcaggccgtcatcaaacgacaggctgccctccacccgcgccagcaacagcaattgctccagggtccggtgcaggcggtcggcgccctcttcggcgtgggccagggattggtcgcgggccgcgccgtcggtcatgcgcgccacttgcaggtgggtcttgatcgccgtcagcgggctgcgcaactcatgggccgcgtcaccggtgaggcggcgctcacgttcgatggtcttggcgatgcgctgcaacagctggttctgggtgtcgagcagtggcttaagctcgctgggcaacgggtgaatctgcaggggttcgagggaatcggcactgcggcgcatcagtgcgtcacgcatgcggttgagcggcaacaggctctggccgatgcccagccacagcaggcacaggcaacccagcaaggccacgcccaccggcaccgacgccgccagcaggatcgacaggttcagcgcctcacgctccacctggcgatcggccgtggtgatcagcaaatcaccgcgcgacagggtgaagctgcgccagcccacgccgtcgataatctggtcacgaaagccgcttttgcgcgactccaggccctcgtccggggtcatgtggctgcgcgcgagaatttccccgcgcaaagagctgacctggcaagccatgccgcccggtacgttgagttgctcggtgcgcaaatgcgtcatgccgccggccacgctggccaggcccggcatctgctcggtcagcccggccaccatgcgtgccgacgccaccaggcgctggtcgagcgagaacatcatctggttgcgcagatcgttgagcatccaggccgccgccagcagccagatcagcacaaaagcggcgcccagcttgaacgtcaggcgcaggcgcagactcatcacgacgcgttgtctccctcatccaccgcgccgccgtccgccgtgcccaggcgataaccaaggccgcgcacggtctcgacgatgccattgcccaatttgcgccgcaggtgatggatatgcacgttgagggcgttgctttccagttcgtcgttaaaaccgtagacgctgtccttgagctgctcgctggacagcacccggcccttgttatgcaacagcgcttgcaacaaggcttgttcgcgacgggaaaggtccaccggctcgcccgccagaaaggtttcgcgactgctcgggtcataggccagccggccgtgttcgatcaggttgacccggcgccccgccacgcgccgcagcagggtttgcaggcgggcggcgagttcgcgcaggtcgaagggtttgagcaggtagtcgtcggcgccggcttgcaggccgtcgacgcggttggtcaccgaatcgcgcgcggtgaggatcagcaccgggatttccaggccttggctgcgttgttgctgcagcagcttgaggccatcttcgtcgggcaaaccgaggtcgagcaccatgatgtcgaacgtagctgccttgagcatcgcccgcgcagcggctgcggtcgccacgcgctcgacggtaaagccctgagcgccgaggccggccacgatgccgctggcgatcagttcgtcgtcttcacagaccagtacgtgcatggttaacccttcatgaaagatggggagaattaaaggtgccgaggattaagcgccgattatgccgcgaaaagacgcgcgccctgcgcttcccttcactttagaatagccaccggttaatcatcggttaatcagcgccacacattgtgtgcctaacttgcaacgaactaaggctcgtccatgcggtatttgtttacctttctgctggtgtttttcgcggggttggcccaggcagcgccgggcaatccattcgaaaccaaacctgacttcctgccggtgggcaaggctttcacctttacctccgagcgtcttgaaagcggcgagacccagctgtattggcagattgccgacggctattacctctaccagcagcgcatgaagttcgacggcctggccgaaaaaccggtattgccccagggcgaagcccatagcgatgaattcttcggcgagcagcaagtgtatcgccaaggcctggaagtgaagattccggccggtgccaccggccagatcaagctcggctggcagggctgtgcggatgccggcctgtgctacccgccgcagtcgatcaccgtggacctgggtggcaaccccgccgttgccgccaccacccaagcccaggaccaaagcctggccagcggcctgcagcaacgcagcctgggctggagcctgctggtgttcttcggcctgggcctgctgctggcattcgcgccttgctcgctgccgatgctgccgatcctcgccggcctggtggtgggcagtggcgccagcccgcggcgtggtttcgccctggccagcagctacgtggtgtgcatggccctggtgtatgcggcgctcggcgtgttggccgcgttgctcggcggcaacctcgctgcactgttgcaaacgccgtggattctcggcagctttgccgcgctgtttgtgctactcgcgctgccgatgttcggcttcttcgaattgcaattgccggccttcctgcgcgaccgtctggacaacgtcagccgtcagcaaagcggcggcagcctggtgggcgccggcattctcggtgcactgtccggtttgctggtggggccgtgcatgaccgcgccgctggccggcgcgctgctgtatatcgcccaaagcggcaatgcgctgcacggcggcttgatcctgtttgcgatgggcatcggcatcggtatcccgctgttgctgctggtgacggtgggcaaccgcttcctgcctaaaccgggcacctggatgaatgtgctcaagggcgtcttcggcttcctgttcctcggcaccgcggtgctgatgattcgcccggtagtgggtgaaaacctgtggattggcctttggggtgcattggcgctggtgatggcctattgcggctggagcctggcccgcgagtacgggctggccgccaaggtctttggcgccggttccctggtgctgggcctgtggggcgcggtgctggtggtgggtgcggccgggggcagcgacaatttatggcagccgttgaaggtctacagcggtgagcgcattggcgcagcccccagcgcccacgacgccttcatgaccatcaacgaccccgccgtgctgcaaagccagctcgacagcgccaaggcccagggccaatgggtactggtggattactacgccgactggtgcgtgtcgtgcaagatcatggaaaaacaagtgttcggcaaacccgaagtcatggacgccctcaaagacgtgcgcctgctgcgcctggatgtcactgccgacaacgccgccagccgtgaactgctcggccgctacaaggtgccggggccaccgagctttgtgtggatcggcccggacggtgaagagcgccgcgcccaacgcatcaccggcgaagtggatgccgccgacttcctgcaacgctggacgcaaacccgagacgcacgctgatgctgaccctgaccatcggcaccttcgccattgccctgaaccacatcctgctgatcagcgcgctgattctcgccactgtggtgggctggcgcgtggccaaacgtggtggagaaaaccccgagtcggtgctgttcagcctgttcctgttggccatgttggttgcgcgcgtcagctttgtgttgatgtactggggcgattacagccacgacccgctgcagatggtcgacctgcgcgacggcggtttcctcgcctggccgggcgtgatcgcgctggtgctcggcgccctgttgtacggctggcgccgcccggcattgcgtaaacccctgagcgccggggtgatgaccggcctggtgttctgggggctgaccagcttgtccttgagcctctacgacaaaggcgcgcaactgccggacatcaccttgcgcaacgccaatggcgacgtggtgcaactggccgattacaaaggtgggccgctggtgatcaacctctgggccacctggtgcccaccgtgccggcgcgaaatgccggtgctggagcgcgcgcagcaccagcgccccgacgtgaccttcctgttcgtcaaccaggccgaaagcatgcaaagcgtcagcaccttcctcgcgacccaaggcctgaccctcgacaatgtgctgtttgacgccagcggccgcctcggccaggccgtgggctccatggccttgccgaccactctgttctaccaagccgatgggcgcctgatcaacagccacctcggtgagctgtcccaagccagcctggcccgcgccatggaacccttcgacaccgccacgacaaggaaaccgacatgccaagcctccgccacctgctgaccctgctgccgctgacgctcgcggccaccctggcccaggccgaagactggccggcgccgatcaaacagatcgaagccaaaggcgccaagatcctcggcaagttcgacgcgcccagcggtctcaccggctacgccgcgcaataccagaaccgcggcatggccctgtacctgaccgccgacggcaaaagcgtgattgccggcaacctgtacgacgccgaggggaaagacctgagcagcgcgcccctggaaaaactggtgtacgcgccgatggccaaggaagtctgggccaagatggaacacagcaactggattcaggatggcgataaaaacgccccacgcaccgtttacctgttcagcgaccccaactgcccttactgcaacatgttctgggaacaggcacgcccgtgggtaaaagccggcaaggtgcagttgcgccacatcatggtcggcatcatccgcgaagacagccccggcaaatccgccgccctgtttgccgccaaagacccgcagaaagccctggaagaacacgaagccgccggcaaaggcagcaagttgcaggcgctggacaagatcccggcggatatcgaagccaagctcgatgccaatatgaaattgatggaagagctggaattgtcggcgacgccggcaattttctacctggacgacaagggcggcctgcagcaacaacaaggtgcgccgtcgccggataagctggcgaagattctggggccgaagtaatcggatgcagatttgcgctagacgcagaaaatccgatgcccaaacaggcatcggattttatttcatgaagccaattatcagatcataaacatagctgtttgagatcaggcacgtctgcccgatgtctctttaggctacagccgattggcgatgtcgagatccgcctcatcctcaccgaggccagagcgaagagtgcctgcgatcaacggcccataacggcggctgaattcccagttgtagggcacgcggtctttgctgaccccgttgtcccaattcaccgaccaggtcatcaggcccttgatcggcaaccctttgtcgtacaaacgcttgaaagcattggtcacggctgcggggttgatcacataaccggtggcggctgcgtcgacgttggccggcagaccaatgacgaacttgtccgccgggattttggtaaaccctcgcgttccgctcaccagactttcggtcaggtaaaacaggaaatcctctttcatcgcgtcgttgttctgggcaatccaggcaccgttgccgttgttaacctcctgcacccagatcccgtcgcccccctggttgtaatactgcggggcgatgaagtcgtaatagccttccagcgcctggatgtaaccgacgtatttaccggcggaggtcaggtaaggaaactccggcgccatgctgatgatgaagtgtttgccttcaccggcgtaatggtccttgaccagtttcaacgcggcgggcaggacagtcttgttgtcggcgaaatcaatcgcgctctgctcaagatcgatgtccaggccatcaaagccataggtttccaccaggcggataatctcgttggccagtggctgttcgttgcctttatgcaactcgatgtgcgcatcggcgccgccgagggaaatcagcaccgccctgccctggctgttcagcacgcccacctggcggcggaactcggcgtcggaaaggttgtaaggcttgaacgttgggataccgttacctttcatgaaagccacggccaccacgttgtactcacccggcacgtccaccaggttcatattggcgaattggccacgctggtagccgtcgctcgcgccggcaggccagttgtgccagaagcccatgaggatctttttgccggcgatgctcggcatcagcgaggcgacatcgttcagtggcgatttcagtgaggtgaagtcattatttgtcatgttctaatccttcagaacgtatgggttgaacggcgcgggcttatttgaagtccacgtcgaaggcttgataaaaggcgttgccggtgttggcgacgatccacatcaatacgatcacgtgccggccctttttgttggccggcagtttcacttcatgattgaccttggccttcagttcgcctgcatggctgtagtacggcacctgggcatagaagtcttcggcgaacggctgggtttccagttgtgcacgggtgatgcgctgtttcggatcccagccatccttggtgatcagccagcgatagccacgggtggtgtgcgccgcggtgtattcccaggtgaccttgaaggtctgacccgggtcgacattgagcagcggccaggtgaaggcgcggttgagcttcctggccatttcctcatctgtgaagttgatgcagtcacgggcatcggtcttgccgccgctgaggatgaagccgtcggctggtggggtgacgctgtcactgtcggtttgataaggcgccgggaacgggccggcaaccagtgccggaaaattcttgccgccttccatttcattgacctgccaggtacccagcaggccgagatccacggcgactgcgccacggctggaaggggatgtgacacgaccatggcgaagaggtgtttgggtttgtggtttattcatttctaactccatttagattgattaagaactctcctttcctgaaggagagaacctcaaactaacggagttgctttttttttccacaggcccgtttttcactcatttgcgtcccatcaggcaataacccccaaaacactgtatataaaaacagtattatggaaatcacctacgccacacaaggtcaatatcctacaaacaaaggcggtaataagcacaatttctcacaccgccagttgttccaggtttgcttaaagcccctccagctccgccatcaaatcactcaaccgatcgaccttctcggcgctgatctcattcgccgccaggccctcgatatactcagccaattccgccaccgtgctgcactcgaacatcgcccgcagcggtacatcgcgttgcagggttttctgcacgcgggaggcaatctgcgtggccagtaacgagtgcccgcccagctcgaagaagttgtcctgcacacccaccctttcgactttcagcacctcggcccagatggcagtcaaggtggtttccagctcgttgcgcggcgccaggtaatcctggctatgcaactggccaatctccagggccggcagggccttgcggtcgagcttgccgttggcattcagcggcaaccggtctagccataaccagtgcagcggcaccatgtattccggcagctcggcccgcaggcgttgcttgatgcggtccaggcgatcactcgggttcaggctctcatctgccgccaccaggtagccgaccaaatgcttgccgttgacgccctcctgcacgccgacggctgcgtcgcgcacttccggttgttcgtgcaggcgcgcctcgatttcacccagctcgatgcggtagccgcgaatcttcacctgatggtcgatacgccccacatattccaacaccccatcgctgcgtcggcgtgccaggtcgccggtgcggtacaggcgctcgcccggcgcgccgaacgggttcggcacaaacacttgcgccgtgcgcagtgggtcgctgacataaccacggcccacacctgtacccgccacgcataactcgccgacggcaccttgcggcaccagctccagcgcaccatcgaccacgtacaagcggttgttgtcggtcggtatgccaatcggcaggtaagtgccacgggtcgaggccaggtcgacacggaagaacgccacgtcgtccgaacattccgccgggccataagcgttgaccaggccaatctgcgggtaacgctgcagccactggtgcgccagttccggcggcattgcttcacctgtcggcagcatccagcgcaggccatccaggctcatgcgctcctgggccaacatgccctggatcagcgacggcacgctttccagcacggttatgccctgggcctgcacatgcgccagcaagccctggggatcatgggcgatggtgttcggcacaatatctacccgcgcgccaaacagcggcgcggcgaggaactgccacacggaaatatcgaaactttgcgacgcggtctgggcgaccacatccgtcgggctcaggtccaggtacggcactttgctcaactggttattgagcatgccgcgctgttcgaccatcacgcctttgggcaggccggtggagcccgaggtgtagatcacgtaggcgaggttgtccgggccgctgtagacacccgggttttccccacggctcggcacttcctcccacaccaacagctggcagtcggtgccttgcagcaactcaatcgcctgctcgcggcacgcctcggtgcacaccagcaacggcgtgcggctcaagtcgatgatgcggctcaggcgttggctcggcaggcctgggtccagcggcaagtaaccggcaccggccttgaagctgccgatgatcatgccgagcagatccaggttacgttcagccagcaacgccaccggttgatcaaggccgacacccgccgcaatcagcgcgtggccgagaccattactgcgccggttcaattcctcatagctccattgctgttccaggcaactggcggcgatgcgctgcggatacgcggccacttgcgcctcaaacagctcgatatagctgcgctccagcgggtaggcgtgctcgctctggttgcagccgtcgagcaggaattcacgttcctgcgcgccaatcaatggcaggtcggccatgtcgccatggaagccctgcaccagcgccagcagcaggcgcttgaactcgccgagcatgccttgcacggtggtttcgtcgaaataacgctggtcgtaggacaggtgcaaaccgaggtcatcgcccgggtagcacacggcggtcagcgggaagttggtgtgggtgcggccggagtccgaagtggcgttcaggctttgcgcgcggtccagcaccgagacttccaccggcgcgttctcgaacacgaacaggctgtcgaacagcggctggcccttgggcaattcgctgtgttcctggatggtcaccagcggcaggtattcgtactcgcgcagctgcatgttgctgtcaagcaggccgctcaaccattggcgcacgctgcaacgctggtggtcttccggcaatttcacccgcagcgcgatgctgttgatgaacaggccgacggtgcgctgcatctcgggcatttccaccgggcgcccggcgacggtgacgccgaacagcacatcacggtccccgctcaagcgccgcagcaccaacgcccatgccgcctgggcaaaggtgttgacggtcagttgatgagcctgcgccaactcacgcagttgcgcaccgtcgcgggcatccaggcgggtgtagcagtcgcccaccaccatgccgccgctgtgacctgcgtgttcacgcaggaacggccggtcgctcgggatcggcgtggtgcgttcgaaaccttgcaggttctgctgccaccactggcgcgcttcggcgaggttctggcgttgcagccaggcgatgtagtcgcggtagcgcggcggcgtggccaactgcgcttcgcggccttcgcccaacgccatgtaaatatcaaagaaatcattcatcagcagcgaacggcaccaggcatcgatgaggatgtggtggttgctcatcatgaaccagtaacgcgcttcgccgacgcggatcaggcgcaggtgaaacggcgcctggttgagcagatcaaaaccggcctcgcgctcggccttgagcaaggcttgcaggcgcggctcctgttcactttccgggtcggcactccagtccaggtacccaatcggcgtactgcccggtttgtggatgacttgcagcatgtcttcgccgacgttccagcagaacgacgcacgcaaggcttcatggcgggcgatgactgcctgccaggcctgggcgaaacgctcggggtccagcgcactgttgatgcggtagcggtcctgcatgtagtaaaggccggtgcccggctccagcaaggtgtgcagcagcaggccttcctgcatcggcgtcagcgggtagacgtcctcgatggcgctggccgcaatcggcaggctgtcgagttgtgactgcgtcaggtgcgccagcgggaagtcggacggcgtgaggccgccggcatcgtccttgaggcaatgcgcaatcaggctgtgcagttcggcgagataggcatcggccagctcgcggatggtctgctgatcgtggcgttcgcggctgaatgtccagcgcagcaccagttcgccgccgtacacctggctgtcgacgctcaaagcgttgggcagcggtgcatccgggtcatgggccaggcccgccgactcatccagcgggtggaacagcgcatcggcgccgaagctctggtcgaactggccaaggtagttgaaggtgatctcggcgctcggcagtgcggccatggtttgccggcccaggtcgtccgccaggtaacgcagcacgccatagcccaagcctttgtgcggcacgccgcgcagttgctccttgatcgccttgatcgagtcgccctgcccggcttgcggtgtcaggcgcaacgggtaagcactggtgaaccagccgacgctgcgagtcaggtcgatgtcatcgaacagcgcttcacggccatggccttccaactggatcaacgccgagtcgtggccactccagcggcacagcacgcgggccaacgcggtcagcagcaggtcgttgacctgggtgcgataggcgcttggcgcctgttgcagcaactggcgtgtgtgctcggcatccaggcgtacgctgacggtgtcggcatcgcggttgcgcagcgcgccgtgcgggcgatccaccggcaagttcacctgcggcccggccagctggtcttgccacacactcaactcttcacgcagcgactcgctgctcgcataggcttgcaagcgcgccgcccaatcgcgcaacgcgctggtcttggccggcaggctgaccgactggccgtcgctcaactgacggtagaccgcttgcaaatcctcaagcagtacgcgccacgacacgccatccaccaccaggtgatgaatcgcgatcagcaggcgttgctggccttgcgggccgtccaccagcaaggcgcgcagcagcgggcctcgtgcgaggtcgaggctgcgttgggtgtcggtgaacagcgcggtgcagtcctgcatatcgcgcacctgcgcctgcatcagcacaccgccttggggcacggccaaatgctcggcatgccattgcgcatcgcgcggggtgaagctcaggcgcagcgcgtcgtggtgctccagcacggccagcaacgcttgctccaggcgatgcgggtcgagcagttgcagcggtttgagcagcaacgcctggttccagtgttggcgattcggaatatccgtatcgaagaaccaatgctgaatcggcgtcagccccgagctgcccgtcagcacgccttgctcggcgatgacctgctcggtacgtgtggccacgccggccagggtctgtacggtctggtgctggaacaggtcgcgcgggctgaaatgaatcccggcctggcgcgcacggctgaccacctggatcgacaggatcgagtcgccgcccagttcaaagaagttatcgtccaggccgacttgctgcacgttcaacaccgcgcaccagatcgcggccagggtgtgctccagctcgttgcgcggcgccacgtactgttggcgattggcctcggggtcgggctgcggcaaggcacggcggtcgagtttgccgttggcggtcagcggcatgctgtccagtacaatcaggtgcgcgggcaccatgtagtccggcagttgcgccttgaggtgcgccttgatcgagtcacgcaacgagccgtggtcggcgtcgctgaccaggtaggccaccaactgtttaccacttggcgaatccagcgccagcaccaccgcctcacgcaccgctgggtgctccagcaggcgggtttcgatttcacccagctcaatgcggaaaccgcgaatcttcacttgatggtcgatacgccccaggtactccaccaggccgtcggcgcgttggcgcaccaggtcgccggtgcggtacaaacgcccgccatcggcggcaaacgggtcggcgacgaaacgctctgcggtcatgcccggccgttcgtggtaaccctgggccagacccgcgccgccgacgtacaactcgccagtcgcgccttgcggcaccagcgccaggtcggcgtcgagaatgtaggccacgcgggcgccgataatgcggccgatcggcacactggcggcgccctcttccagctgctgcggcgccaggctggccagcggcatgaccacggtttcggtcgggccataggcgttgaaaaacacctcgggctggaacgcggcgcggatacgctgcaagtgttcgccggtcagcgcctcaccaccggtgatgcacatgcgcaccggcaaggtctgctgctgggtcgccagccattgcgccaactgactgccatagctcggggtaaagccaaggatgttgatgcgatgggcgcgaatcagcgcgcagatttcttcggcatcccactggccttgggcgcgcaacaccacctgcgcaccgctgagcagcggcaccagcaggcgctcggtggcggcgtcgaagttgatcgaataaaagtgcagttcgcagtcgtccgggcgcatgccgaagcgctcgatcaccgcctggcaatgcatggcgatttcaccgtgggacaccaccacgcctttgggcttgccggtggaacctgaggtgtagatcaagtacgcctgatgctgcggcaggctgataaagggcaactcgtcggccgggtaattggcgagcaccggcaggtcatcttccaggcaccagcaggccaccgtcgccggcaattcgccgagggcttcaaacatcgccgcatcgctgagcagcaggccaatgccgctgtcttcgatcatgtagtgcaagcggtccagcgggtattccgggtccagcggtacataggcaccaccagctttaaggatcgccagcaggccaacgaccatttccagcgaacgcggcagcgccaggccgacgcgcacctgcgggccgacgccgcgctcgcgcagcatccaggccaggcggttggcgcgggcgtccagctcgcggtaggtcagcgttgctcctgcaaacgtcagcgccggcgcatcggcacgcttgctcgcctgctgactgaacagctgatgaatacactgatcgaggcgatgctcgcccgcttccacaccgaggctgtcctgcaacgcgcgctgctcgacggcgctcagcaacggcagttcgctgaggcgctgctgcgggttggcgatcaatgcttccagcagattgcgccaatgctcggccatgcgcgcaatgcgcggttcatcgaacaggtcggtgctgtaggtcaggcagcaacccaggcggtggtcgaggtcggtgacttccaggttgaggtcgaatttggtcgcgcgcgcatcattggccaggtactcgacggtcatgccggccagttggcggctctgctggaattcccagcgctgcacgttgcacatcacttggaacagcgggttgtacgccgcactgcgtggcggttgcagggcttccaccaaatgatcgaacggcaggtcttgatgggactggccttcgatcacggtgtggcgcacctgctcgaacagctcagccacattcatctgcccggtgagctggcaacgcagcacctgggtgttgaggaaggcaccgatcagcccttcgctttccgggcgaatccgattggccactggcgcgccgatgcgcaggtcggtctggccgctgtagcggtagagcaacaccgccagggtcgcggtcatggtcatgaacagggtcaggccgcgctcggcattgaaggcgcgcacgcgagcggccagttcgtcgctcaggtcgaaacggtacaactcgccctggtggctttgcaccggcggccgtgggcggtcgccgggcagttcgagcaacgggtgctcatagccaagctgcgcgatccagtagtccagttgacgttggcgctcaccggcctccagccactggcgctgccacacgctgtagtcgaggtactgcaccggcaacggcgccagcggcgagtcgcgttcgtcgataaaggcttcgtacaacgcgctgagttcacgggcgaagatatccatcgcccagccttcggtgacgatatggtgcagggtcaacaccaggtagtgttcctgatcaaaggccttgaccaggcaggcgcgcagcagtggcccggtttccagattgaaaggcgtgtgcgcctcgtggtcggccagctgtcgcagacgcaactgacgctcggcttcattcagcgccgaaaaatcctgccagtccatgcgcaggccggtttgcttggcgaccttttgccgggccacgccgtcgatgctcgggaaggtggtgcgcagggtttcgtggcgcatgatcaaggcttgcaacgccgcctcgaaacgtcccacatccagcacgccacgcaggcgcgccataccgccgacgttgtaggccgggctgtccggttccatctgccagaggaaccacatgcgctgctgcgaataagacagcggcaccggcgcgttgcggtcaaccctggcgatggcggtttgttggttgcgctggcccgaggcctggatcagcccgacttgctcggcaaacgcacccagctcgctggcttcgaacaaggtgcgcagcggcagctcgacgtcacaggcctgacgggtgcgggagatgatttgcgtggccagcaacgagtggccgccgagggcgaaaaaatcgtcgcccaggccaatgcgtggcaggccgagcacctcgcgccagatcgccgctatctgctgctgcaacggcgtttcgggctcgatgtgctcgcgggtttgccacaccggctccggcagcgcgcgccggtccagcttaccgctggggctcaggggcatggcgtcgaggcgcatcagttgcgcgggcaccatgtactccggcagctcggcggccagggcggattttacctgctgttcgaaaaggtcggtgccggcggtgtagtagccgatcaactgctgatcacgcaccagcaccacggcttgggcgatgccgtccagggccagcatgcgggcttcgatttcttgcggctcgacacggaagccgcgcagtttgacctgctgatcgaggcgaccgaggtattcgagcacaccgtcagcgctccagcgcacgcggtcgccggtgcgatacagacgtgcgcccgcctcgcccagcgggtcggcgacgaagcgttcggcggtcagcccggcacggccgaggtaaccgcgcgccaggccgatgccgccaatgcacagttcgcccggcacgccggccggcagtgggttgaggtgttcgtccagcacgcggcaaatcacattgcccagcgggcggccaatcggcgaacgctcgccgtcctcagccttgcagtgccagtgggtgacgttgattgcggtttcggtcgggccgtaacggttgtgcagttgcaccgccggcagttgcgccaatacgcggttacgcaattcggcgggcaaggcttcgccaccggagaacagccgacgcaggctggtgcattcggccaccaacggctcatcgataaacagctgcaacagcggcggcacaaagtgcaacgtggtcacgccgtgttcctgcaccaactgcgcgatgcggtgcgggtcgcgatgctcgccggggcctgccagcaccaggcggcaaccgctgatcaagggccagaagcactcccacaccgacacgtcgaaactgatcggcgccttttgcatcagcacatcggtgtggttgagttgataggtggcttgcatccactgcaagcgctcggccagcgccgcgtgggtattgccgacgcctttgggctggccggtggaaccggaggtgtagatcacgtaggcgaggttgtcgccatgcaaatgcaagcccggtgcctgggtcggccagctgtcgaggtgcaggctgtccatggcgatcacgcacacgccttcgggcgccggtaacagttccagcagcgcggtctgggtcagcagcaggtgcacgccgctgtcctggagcatgtaggccaggcggtcggcggggtaatccgggtccagcggcacataggcgccaccagccttgatgattgcgagcaagccgatcaacagttgcggcgagcgctcggcggcgatggccacgcacacgtccgggccgacgcccttgtcgcgcaggtaatgggccaggcggttggcctgggtgtgcaactgggcgaagctcaggctgccgccctgccagaccagcgcggtatcatccgaggtgtggtggctgagcagttcgggcaaccactgttgggctggcgtgcacggcgcctcgctccacggctgctgttcgtcggtttgcatcagtttgaggtcgccgatggcctgttgcggttgctcgcacacggcgtgcagcaggctgatgtagtgctcggccaggcgttgaatagtggcgctgtcgaacacttcgtcggcgtagtcgaacgccaggctcagacgcccgctgcggtcttcttcgctgtgcagttgcaggtcgaacttggcttcgcggctgtgccacggcagctcatcggcgagcatccccggcaggcggcgcaaggcactcaaatcgcgctgctggtggttgaacatgacctggaacaggccttgctcgcgggcgtgcgggaaggcttcgagcaattgttcgaacggcaggtcctgatgggcctgggcgcccaacgcggtctggcgggttgcggccagcagttggttgaatggcaggcggccgtccaactcggcgcgcagcaccagggtgttgatgaagaagccgatcaggccttgggtttcctggcgcgggcggttggcatttggcacgccgatgcggatatcgcgctggccgctgtagcggtagagcaggctttggaaggccgcgagcagcagcatgaacggtgtggattcattcgcctgcgcggtctggcgaatcgctgcgctgagccctgcgtccaggcgcacgctatggcgcgaggcgctgttgcgttgctgggccgagcgcgggtggtcggtggccaggctcagggtcggatgttcgtcgcccaactgcgctttccagtacgccagttgccgctggccttcgccctcggccagccattggcgctgccagctgccgtagtcggcgtattgcaacgccagtggcggcagcgccaatgtttggccctggctcgcggcggcgtacaggcgcgagaattcgtcgataaggatattcagcgaccaaccgtcggcgatgatgtggtgcagcgtcaccagcaactggtgctcttcatcgccaaggcgcaccagggtcacccacagcagcgggcctttttccaggtcgaactgggtgcgcgcttcgtcctcgcggatctgttgcgcgcgcacttcacgctcggcggcaggcaggtcgctgaggtcgatgacttgcaggtcgaattcaacgttggcgtccacacgctggaaggcctggccgtcgcgctcgtagaagcgggtgcgcagggcttcgtggcgctggatcagttgctggaagctggcgcgcaccgcgtcttcgtccagctcgccgcgcaagcgcagggcgccggggatggtgtaggcgctgctgtgcgggtccaactgccaggtgatccacaggcggttttgcgccagcgattgcggcaagtcatcctggcgcgacagtgcgtggatcgcgccctgagcgacgccgccgtcttgctgcaattgcgcgacgttggcggcaaaagtcgccagcgtcggcgcctcgaacagcatgcgcaggttcagctccaggcccagggtttcgcgcaggcgcgcaaccacttgggtggcggtgatggagttaccgccgagcaggaaaaagtggtcatcggcggcgacggttgcgacctgcagctgctcgcaccaaatcgccgcgatctggctttgcagttccgattccaacccaacatcgctcgtgtgcgcttgcagatcggggaactgcgcatagctgtcgaggctgccgtcggcgtggcgaaggccgcacgcggcgcgctgcaccttgccgctggaggtcttcggcaaggcgcccgggttgagcaataccaccacgctcggcgcttgctgatacgcctcggccacggcctggcggatggctttgatcagcgcttcgggcggcaggattttctgcacgctgcggctgatttcggcggcaatgccgatgccttccaggccctggtcattgactgcaaaggcggcgacgcggcccttgcgcaccacttccacttcgcgctcgacggtctgctcgatgtcctggggatacaggttatggccgcgcacgatcagcaggtctttcaagcgcccggtgatgtacacctcgccgtcacggataaagcccaagtcgccggtgcgcagccaggtgcggccggcgtgttgtacgaaggttttggcggtggcttcggggttgcgccagtagccatgggcgatgctcgggccgctggcccacagttcgccgacgcggttatccgccagctcgctgagcgtgtgcggatccgcgatcaacacggcgtgttccggctggcgggtgccgcagctcatgatcgcactgccctgccccggctcggcgcgattggcggccagcgcttgttcatccacacgcagggccgggatgccttggccacgggtgccgccagcgacaaacagggtcgcctcggccaggccgtaagaggcaaagaaattattcgaggtgaaaccgcaggccgcgaacttctcggcgaagcgttccagggtgtcgaggcggatcggctcggagcccgaataggccacgcgccaggtgctcaagtccaggcgctccagggccgactcactgacccgctcgctgcacaggcggtaggcgaaatccgggccgccgctgatggtgccgccgtattcgctgatcgcttcaagccagcgcaatggccgaccgaggaagtacgccggcgacatcaacacacacggcacaccgctgaaaatcggctgcagcaggccgccgatcaagcccatgtcgtggtacagcggcagccagctgacgatcacgtcatcggggttcaagtcgatgccaaaaccacgacggatcagcacttcgttggccaccaggttgccgtggctgacttgcacgcctttgggcaaggcagtggagccggaggtgtattgcaggaaggcgatgtcgtcggcgtgcagttcgggttcgacccagccctctgcgagttgcgcatcgagggtgtcgacgctcagcaccggcggcgcattgtcgatttgcgccaggccgtcggcgaggctggcgatgctcagcagcaggcgcggttcggcatcggcaatgatcgacagcaggcgctcctgatgatgccgacgcgtggattcgggcggatacgccggcactgcgatgatcccggcgtacaggcaaccaaagaacgccgcgacgtagtccgggccgctggggaacaacagcacagcacgctcgcccagcgccgcattggcctgcaaggcggcggcgatggtgcgggcgcgctggtcgaggtcacggtagctgagcacaacgttgtgctcggcggattcggcgaggaagcgcagcgccacctggtccggcgtctgcgcggcacgacgttgaagggactggaccagagtgcggggaagttcgaaggcgtccatcatggggttcctgcctgaaatcggcttacgggaaaatcgagaattagagagcgttcagccggcgaccagttgccgcgccgcgccattgcgccaacgggccaggtgctcatcggcgtaacgccgcaggcaacgcagcacagcgctttcgtgctgtacgagaaagaagtggtgaccgtcgaacatgtccagggaaaagccgctggcagtgtcggcctgccagtcgagcaactgctcggcacgcacgctgtcttgtttgccgccgaatacgtggatcggcatgctcagcggctcgcgctggccataggtgaagctgccgcagagcagaaagtcggcgcgcaggatcggcagcatcaactgcatcaactcagggttggccagggcttcctcggcggtgccctgcagctcgcgcaggcgggcgatcagttgtgcgtcggtcttttcgacggcgtattcgctgacatcacggcgcgccgggccagccgtgccggacgcgaataacgccagcggcgcgggcacaccgcgctcgtgcagggcgtgggccaattcgaatgccaacaggccgccgaggctgtggccgaacaaggcgtaggggccgttcaggtcatggctgatttcatccgccagctgtgctgccaaggccttgatgtcgcgctgcaacggctcatccatgcgcatgccgcgccccggcaattccagcggacacacctgcaaccaatccggcaaagcccgacgccaacgtgcatacaccatggcactggcgcccgaatagggcaggcaaaacaggcgcagtcgggttgaggcacccatcaaacgaggcctacaaactgaaacacgctgtatgcacgatacaaacccatgtcgtcctcctgcgggcgctgatccttggccgtttgttaacggacctgtcacccatgagaacggacggtgcgggcaaataattagtcgcaggggatgtaggagaagtggttcacaccttgtaggaaggcataagattagttcgtcttctcatttgacaatcattatcattaagcataatttgttgcccgatgtgtaggaggcctcagcaaggacgccctcccctaacctcttttgcaacaaggtgatttccatgacggaacaagtatccacaggcaggtgcgactcaccccttctccaggcattcgtcgacaatcgtttgattctggtgaagatcgcggcgcgcattaccggctgccgctcgcgtgccgaagacgtggtgcaggatgcctacttccggctgcaatcggcgccgacgatcacctcatcgttcaaggcccaattgagttatctgttccagatcgtgcgcaacctggcgatcgatcactaccgcaagcaagccctggagctcaaatattccgggacggaggaggaaggtttgaatgtggtgattcatggcgcatcaccggaaacttcccatatcaacttcaacaccctggaaaacatcgccgacgccctgacggagctgccgcagcgcacccgctacgcgttcgagatgtatcgcctgcacggcgtgccgcaaaaggacatcgccaaggaactcggcgtgtcgccgacgttggtcaacttcatgattcgggatgcgctggtgcattgccgcaaggtgtcgggcagccacagcgatacgttcgcgcggcgagtctgatgtggtgaaagagcctgttgtggcaagcgggcttgttgtggcgagcgggcttgccccgcgttgggctgcgcagcagccctgaaagcagacactgcgatctaactgaaagtgcgcggtggcttttttggggctgcttcgcagcccaacgcagggcaagcctgctcgccacagcaagcctgctcgccacaacaagcctgctctccacaacaagcctgatccgcggtcagtgcaccgccgtcacatcaatccgatacggctcgaaaatcttcaacatctgcccgttatcgcgcaggcgcttgagcaactgggcaaacgcctccccggtaatcggcgccttgggccgcagtaacgcgtagtggtgatacacctggtcaattcgctccgagaccaggaactgcccggccaggtccgcattgcgcaccatgaaatcactcaagtacgaacgcgtgaccagcgcgatatcggcccgcccgcgcgcgaccatcagcaagttgctgtcatgggagtaggtcaacgtggcgttgaagtgctcgaccatgtacttggggtcggggttgaagttggcgaaggcgtagtgataaccgctgaacacggccagacgcttgcccttgaggtcggcgaaataaccctggtcgcgcccggcctcacgctgggcgacgaagatttccgcgtcttccaggcccatgtcgacgctggtgtggggaatgtcctgccaaccccagtccgggttttcgaagatcgccatgtcgacgcggccttgctcgaaatcgcggaagcgccgggggatggaggttggcaccagcacaaactggtagtcgctttgcgaggcgttcagggcctccaccagttgcggcagtaagccggtgtcggcgccttgctcagggcgtacggtgtagggcggaaaatgcgcggcgccgattctcaccaattgcgcagccgaagccggcatccaccctgcggtgcccagtgcccataaagttagtcctgcagccagccgccatggcgaaaacattgaggcacgcaccgtttaatactctgatggcgataagctaggcgtttttgtcaggtgagacaactttccgtcggtaaattaacggcttgcgccttaatcagccttcagcaccatcagcagggcttcttcggccaattgctccagggtcaggctgccttgggcacggaaccaggtggtggtccaggacaacgcgccggtgaggaagcggcgggtgataaacacatcgccgcgaatatagcccgcagccttggcctcgcccagcacctgcaaccagatttcctcatacacatcacgcagcgccagcacctgggcctggccgtcggccgacaacgaacgccattcgtagaccagcaccgccatggcttcgccgctgccgcccatgatcgactgcaattcacagcgaatcagcgccagcacgcgctctcgcacgctgctcgcttcttcaagtgaagcgcgcatcattgcggtgttgtagtggatggtttcctccatcaccgcgcgcaggatctcgtccttgctcttgaagtgatgaaagatgctgccggactgaatgcccaccgcgctggccaagtcacgcacggtggtgcgttcaaagcccttgttgcgaaacaggtgagctgcggtttgcagcaatttgccccgggcactgtcggggtcggtcaattggccggcatcgaccatggtgcgcatgacccgcagggctttctgctcatccatgcctctctccttcacgtgtgctgacgtcttgggcggcaatttaggccgtggccgccaaccaagcaagcgcttgggcaaaacttgtgtgcagagtttacaaaccaagcgcttgcttggtagtctcgacaccagccattcgaggaaggatttctcatgagcaagacggttcgtatcggctgcgccagcgccttctggggtgatacctgcacggctgccgcccaattggtgcacggcggcgcgctggattacctggtgttcgactatttggcggaagtcaccatgtcgatcctcgccggtgcgcggatgaaagatccccaggccggctacgccacggacttcgtcgacgtgctcacgccgttgctgggcgacatccagcgccaaggcatccgcgtgatcagcaatgccggcggcatccacccgcaggcctgcgccgccgcgctgcaagcagcctgcgacaaggcgagcatcccgctgaaaatcgccgtactgctcggcgacgacctgcaaccgcagctcaaacacctgcacggcgtcagcgacatgttcaacggcgcgccgctgccgccgatgtgcgtgtccgccaacgcctacctcggcgcacccggcattgccaaggcacttgagctgggcgccgacatcgtcatcaccggccgcgtggtcgacagcgccgtggtcagcgcggccttggtgcatgaattcaactggtcatggcaggactatgaccgcctcgcccaggccgcattggccgggcatatcatcgaatgcggcgcgcaatgcacgggcggcaacttcaccgattggcgcgacgtgccggactacgagcacatcggttttcccatcgtcgacgtcagcgccgacggccagttcaccgtcaacaaggtcgacggcagcggcgggctgatcagcgaactcagcgtcgccgaacagctgctgtatgaaatcggcgacccgcgcgcctacctgttgcccgatgtgatctgcgatttcagccaggtcaaattgcagcaacaaggcaaacacagcgtgcgcctgcacggcgccaagggtttgccgcccaccgaccagtacaaggtcagcgccacctacccggacggtttccgctgcaccgccagttgcctgatcgccgggattgacgccgtggccaaggccgagcgcgtcagccaggccatcatcaacaagacctcggagctgttcagccaacgcggctgggcgccttacaccgaggtgaacatcgaattgctcggcagcgaagccacctacggcgcccacgcccagcgcccggattgccgcgaagtggtggtgaaactcgcggtgcggcatccgagcaaacaggcgctggtgctgttcgcccgcgagatcgcccaggcggcgaccggcatggcgcccggcttgaccggcatcgtcggcgggcggccgacggtgtatccgctgattcggctgttttcattcctgatcgataaatcttcctgcgagccggtggtcgacttccaaggccagcgtcacgccattgaactgcccaccgctacgccaccggtcaccccggccgcgccgattgacccgcccaagccccaaggccgcgccgacgccagcgtgccgctggtgaaactggccgtggcgcgctccggcgacaagggcaaccacagcaacatcggcgtgatcgcccgccatcccgactatttgccgtggatcgccgaagtgctgaccccggaagtgatcgtcgactggatgagccacgtgctcgaccccctccgcggccgcgtcgaacgctggtacttgcccggcagccacagcctgaatttcctgctggaaaacgccttgggcggtggcggtatcgccagcctgcgcatcgacccgcaaggtaaagccttcgcccagcaattgctggaaatccccatcgccgtgccgcaacacatcgccgatcaactcacataaaggagcgttgccgtggccttcgactcaatcttcaaagccgacctgttccaggggcaaaccgtgatcgtcaccggtggcggcagtggcattggccgctgcaccgcgcatgagctggcggccctcggcgcccgtgtgattctggtgggacgcaagccggaaaagctgcaaaaggtggcggcggagattgccgaagacggcggcacggcacactggcaagcctgcgacattcgcgatgaagaggcggtgaaggcgctggttacacagatcatccacgcacacgggccgatccacggcctggtgaataacgccggcggccaatacccgtcgcccctggcctcgatcaatcaaaagggctttgaaaccgtgctgcgcaccaacctggtcggcggtttcctggtggcacgggaagtgttcaaccagtcgatgagcaaacacggcggcgccatcgtcaacatgcttgcggacatgtggggcggcatgcccggcatgggccactcgggcgcggcgcgttcgggcatggacaatttcaccaagaccgccgccttcgaatggggttacgccggcgtgcgcgtcaacgccgtggcgccgggctggattgcctccagcggcatggacacctacgaaggcgcgttcaaggcggtgatcccgaccttgcgcgaacacgtgccgctcaagcgtatcggcactgaatcggaagtcagcgcggccatcgtgtttctgctcagccccgctgccgccttcatcagcggcagcaccttgcgaatcgacggcgccgccagcctgggcagccgcgcctggcccttgcaaaaaccgcagtcgccgggcgagccgttcaatggtttccaccgcgcgtacttgcccgatgtgctcaaggcggagcactgaaccatgccggtaattgaaagtttgatcgacgcgcactccgcgcccttcgcccagaaccgcgaagccatgctggccagcatccagcagctgcgccaactcgaacacgccctgctcgccaaggcccaggaggccaaagccaagttcgacaaacgcggccaactgctgccccgcgaacgcctcaacctgctgctcgaccctggcgcgccgtttttggaattggcgagcctggctggctacaaactccacgacgacaaagacggcagcgcagccggtggcggcttgatcgccggcatcggttacgtcagcggcgtgcgcatgctggtggtggccaataacagcgcgatcaagggcggcacgatttcccccaccggcttgaaaaaatccctgcgcctgcaacagatcgccatggaaaacaaactaccggtggtgaccctcgccgaaagcggcggcgccaacctcaactatgccgccgagattttcgtcgaaggcgcgcgcagctttgccaaccaggcgcgcatgtcggccatgggcttgccgcaaattaccgtggtgcacggctcggccacggcgggcggcgcctatcagccggggttgtcggattacgtggtggtggtgcgcggcaaggccaagctgttcctcgccgggccgccgctgctcaaggccgctaccggcgaagtggcgaccgacgaagaactgggcggcgccgagatgcacgcgcaaaccgccggcacggccgagtacctggcggaaaacgatgccgacggcgtgcgcatcgtgcgtgaaatcgtcagcctgttgccctgggatgagcgcctgccgactgcgccggaacgcgattacaaagagccgctgtatcccatcgaagagctgctggggctgatccccgacgacccgaaaaaaccctacgacgtgcgcgaaatcctcgcgcgcctggccgacggctccaacttcctcgaattcaagggcgagttcgatgcccacaccgtctgcggccatgtgcagattcaaggccgcgccgtcggcgtgatcggcaacaacggcccgatcacacccaaaggcgcgagcaaggccgcgcagtttatccagctgtgcgaccagagccgcacgccgctgctgttcctgcacaacaccaccgggttcatggtcggcaccgagtcggagcaacagggtgtgatcaagcacggcgcgaagatgatccaggcggtggccaatgcccgcgtgcctaaactcacgattgtggtcggcggctcctatggcgccggcaactatgcgatgtgcggccgtgggctggacccgcgctttatcttcgcctggcccaacagccgcacggcagtgatgggcggcgcgcaagcgggcaaggtgctgcgcatcgtcaccgaggccaagcaattgaaggatggtttggtgcccgaccccaaggtgctcgacatgctcgaacaggtcaccgcgcagaagctcgacagccagtccaccgccttgtacggcagcgcgaatctatgggacgacgggctgattgacccacgcgatacccgcacgttgctcggcttgctgctggatatctgccatgcggccgaggtgcggcagttacaacccaacagcttcggcatagcgcgctgatcgttcccacgctccgcatggtaatgcagccaaggacgctccgcgtcccaacagggagaacaacaacaatgatcttcacccaggaacaccaggaactgcgccgcaccgtccgcgccttcgtcgaccgtgagatcaacccacacgtcgatgaatgggaaaaagccgggcgttttcccatccacgagatcttccgcaaggccggcgacctcggcctgctgggcatttccaagccggagaaattcggcggcatgggcctggactacagctattccgtcgtcgccgccgaagagttcggcaccattcgctgtggcggtatccccatgtccatcggcgtgcagaccgacatgtgcacccccgccctcgcccgcttcggcagcgatgaactgcgcgacgagttcctgcgcccggccatcagcggcgagcaagtgggctgcatcggcgtctcggaaaccggcgccggctccgacgtggccgggctgaaaacccatgcgcgcaaggacggcgacgactatgtgatcaacggcagcaaaatgtggatcaccaactcgcccagcgccgacttcatctgcttgctggccaacacctccgacgacaagccgcacatcaacaagtcgctgatcatggtgccgatgaacacgcccggcatcagcgtcagcccgccgctggaaaaactcggcatgcacagctccgagaccgcccaggtgttcttcgacggcgtacgcgtgccgcagcgcaatcgcatcggccacgaaggcgcggggttcatgatgcagatgctgcagttccaggaagaacgcctgttcggcgccgccaacatgatcaagggcctggagtactgcatcgacagcaccatcgactactgcaaggagcgccagaccttcggcaaggcgctgatcgacaaccaggtcatccactttcgcctggccgaattggccactgaaatcgaatgcctgcgtgcgctggtctaccaggccaccgagcaatacatcaaaggccaggacgtgacgcgcctggcctccatggccaagctcaaggccgggcgcctgggccgcgaagtcagcgacagctgcctgcaatactggggtggcatgggcttcatgtgggacaacccggtggcccgcgcctaccgcgacgtgcggctggtgtcgattggcggcggtgccgacgaaatcatgctgggcatcatctgcaaactgatgggcacgctgccggggaaaaaatcatgaacaccttgctgctcgaaccgcataacggcgtgctgcacatcaccctcaaccgcccggccagccgcaatgccatgagcctggagatggtcaacgaactgcgggcggttttggcgcagctcgacagccaggtgcgtgcgctggtgatcagcggcgccggcgggcacttctgcgccggggcggatgtgaaggacatgatcaccgcgggcgaccagttgcaggccttgaaccgcgcatttggcaccttgctgcaagaagtcgaggccgtgccgcaggtggtgatcgtggtgctgcaaggcgcggtgctgggcggcgggttcgggttggcgtgtgtgagtgatattgcgattgccgatcatcaggcgaagttcggtttgccggaaaccagcctcgggttgttgccggcgcagattgcgccgtttgtggtcaagcggatcggcttgacccaggcacggcggatggcgctgacggcggcgcggtttgatggggttgaggcgcagcggctgggcgtggtgcattttgtcgaggccgatgcgcaggcgttggcggagcgtttggatgaggtgctggggcaagtattgcgctgtgcgccgggggcaaatgggcggactaaagcgctgttgctcgccagtgttgatgagccgctcgagcaggtattggatcgaggggcgcagtggtttgccgaggcggtgacgggagtggaagggattgaggggactcaggcttttgtgcagaagcgtaagccaggttggtgcagatgacgccttcgcgagcaagcccgctcccaccttctccctgtgggagctggcttgcctgcgatggggccagaacattcacccagtgtgccaagggataaacccatgtccaatttcagcaaaatcctgatcgccaaccgcggtgaaatcgcctgccgtatccagcgcaccgcccaagccctgggctaccgcaccgtggcggtctacagctacgccgacgcccaggccctgcatgtgcaaatggccgacgaggccgtcaacatcggcccggcgcccgtcaaccagtcgtacctgaacatcccggccatcctcgaagccgcgcttaaaaccggcgccgacgccatccaccccggttacgggtttctctccgaaaaccccgacttcgccctggcctgccaacacgcggggctcaccttcatcggccctggccccgacgcgatcaagctgatgggcagcaaacgcctgtccaaactcgccatgctcgacgctggcgtgccgtgcatcgccggctaccaaggcagcgcccaggacgacgctactttgcaacaggaggccgagcgcatcggctacccgctgatgatcaaggccagtgctggcggtggcggtcgcggtatgcgcctggtgcacggcagcggccacctgctcgaccaactgcgcaccgctcgttccgaggccatgaacgccttcggaagtgacgaactgatcctcgaacaggcgctgatcgcgccgcgccatgtcgaaatccaagtgtttggcgacagccacggcaacctcatctacttgggcgaacgcgactgttcactccagcgccgccatcaaaaagtcatcgaggaagcgccctgcccggtgatgacagccgagctgcgccaggccatgggcgaagccgcgctcaaggccgggcgcgccgtcaactacgtcggcgccggcaccgtggaatttttgctcgaccgcagtggccgcttctatttcctggaaatgaacacccgcctgcaagtcgaacatcccgtgaccgagctgattaccggtctcgacctggtggcctggcaactgcacatcgccgccggccaaccgctgccgctgacacaggccgacgtaacgctgagtggccacgccatggaagtgcgtctgtacgccgaggacccggcccagggctttctgccgcaaaccggagacgtgctgcgctgggagctcgccgctggcgtgcgggttgaccatggcgtacttgaaggccagcgcatcagcccattttatgacgccatgcttggcaagatcatcgcccacggcgccacccgcgaagaggcgcgacgcaaactgctgcgggcggtggaagatactgtgttgctgggcgtgaccaccaaccagcgcttgctggccgacctgctcaagcacccggactttatcgccggcgatttcagcaccggattcatcaccgaacacttcaatgaaatcccgcgccaggcagcaacgaacgaacagatcgccttggccgccgcgctgttttatcaccacagcgccaacgctcaccgccaggctttagccggttggcgcaacaccgccagcacggcgtggacctaccgcctggagattaacgaggcggtccacgaggttgccgtcagcgttctggcaaacgaccatttgcaggccaacggcatcgatatcagccacctcagcagcgacggccgctgggcgaccgtgatcatcaacggtatccgccgccgcagcgcctatcacctcgacgacacccagctctggctgcccggcgtaaaggtcatcaaccgcacccagcaagtcgccagccgccaggccgaggttgccagcggcagcgtcaaggcgccgatggacggtgcgattgtcgatgtacgggtgagcaccggtgagcgcgtcaccagaggtcaattgctgctggtacttgaagcgatgaaaatggagcacccgttgacggccggcatcgatggagtgatcacaggcgtgcaggtgagcgccggcgatcaggtgcgtaatcgccaggtgttgctggagattgaaaaggcctaggcggaactacgaggcttggctacgctctatccccatcaggaagggaagagtacgggaacctgcgcaatgcctcattggctgattattgaccttgaagccacaacggatgaaggcggctggcccgtgacggagatggaagtcatcgagatcggcgcgagcctggtcaaccgccagggccgcgagctggatcacttccagcgctttgtgcggccgctgcgtcggccgttgctgacgcccttctgccggcaactcacgcatatcacccaggccaacatcgacggcgcgacagcgatgaccgaggtgtggccgttgttcgaacgctggttgggccagcaccaagcacgcctggaaggctgggccagctggggtgactacgatcgccagcagcttgagcttgaatggcaacgccatggcctggccagcgcgcttgcgcacacgccgcatgtgaacctcaagcagcgtttcgccaaggcccggcgcctggacaagccgctggggctcaacggcgccctgcaattggcggggatgcagtttcatggccagcaacaccgggcgctggaagatgcgcgcaacaccgcacgcctgttgccgttgattctgccggtctaggcagctcccctgggcttgggcatactggccaacctttccagacccttttccgaggattcacccatgtttaaagtcaacgaatacttcgacggcaccgtcaagtcgatcgctttcggcaccgcagaaggtccggcgaccatcggcgtaatggctccgggtgaatacgaattcggcaccgcccaacgtgaaatcatgcacgtggtgtctggctcgctgagcgtaaaactgccggacgtcagcgagtgggaaaccttcgctgccggcagccaattcaacgtgccggccaacagcaagttccagctgaaggtcgccgtagacaccgcttacctgtgcgaataccgcggctaagcgttcgccggtcaaaaaaaatgcccgtctcgcaggagacgggcattttttatggggggtgcacattactcaagaatggtcaccggcatgccgacttccaggcgcccgacgccatcgttgaccaggttctggccgaacatcgcgccgttctccgtcttgcggtacgcatcgagcgtggcgaaaggttcgcggtcagcactgcgctcgccggtggcggggtcgatggtggtgagaatgcagcgtgaacatgccttgaccacgcggaactcgacatcgccaatacgcaggcgcttccatccgtcttcggcgaatgcgtcagcgccttcgatcaccagattgggacgaaaacgcaacatttccatgggccggcccacctgccgggacagatcgtccagggagccctggccgatcagcaacagcgggtaaccgtcggcaaacgccacttggtcatcatcattgccgaaaccggcctcggtggtacgcgcgcgcgcaagcggcatctgcaccagccgcgtgggcttgccgataaactcgctgacccaggcagcggcggcatcaccggcgtccggcacacgcagggtgtcacgccagatggtcacaccgcgcaactcggcgtcattgccgggcaggggcacgtccagcgtcgcgtgaccgggggaactcagggtcaagccgccggcactgttccacaatgccgacaactggctcatcttcgccactgcgcgctgcgtcagaaatcgcccactggcttcgtccaccaacatccagcgtcgatcccccgccagcccgagtttatccaggtcgatctgctgcaaggtctcggccttgccggacttcaaggggtaacggtacaacgcgctgagacgaagcatgggcctgcattcctgagaaacaaagtgtcaccctaaagtcaggcgggcacttcgtccagcatcaggcgttgacgcaccacgtccaccagcttgtcgggctggaatttggacaggaagttatcgcagccaaccttcttcaccatcgagtcgttgaagctgcccgacagcgaggtgtgcagcaccacgtagagcccacgcaggcgcgggtcgttgcggatttcggtggtcaggcggtagccgtccatctcgggcatttcggcgtcggtgaagatcatcagcagtttgtcggtcatcacctggccgctgtcggcccaggccttgagcatgttcagtgccttgaggccgtcgctggcaatgtgcatcttcacgccgagctgccccagggtgtcgcgcagctgcgacagcgccacattggagtcgtccaccagcagcacttcgcgaccacgggcgcgctccagcaccgggtcttcgagtttttcccgcgagaccttggcgttgtacggcacgatttcggcgaggactttttccacgtcgatgatttccaccaactggtcatcgaccttgctgatcgccgtgaggtaatgctggcgcccggcactggccggtggcggcaggatggcttcccagttcatgttgacgatgcggtctacgccgcccaccaaaaacgcctgcaccgaacggttatactcggtgacgataatcgtgctgttggggcctggcaccagcgggcgcatgccgatggcctgggacaggtcgatcaccggcagggtctggccacgcaggttgaccacgccgcacacgaacgggtggcgctggggcatcagcgtcagcttgggcagttgcaggacctcctgcaccttgaacacgttgatcgcgaacaactgccgcccggccaggcgaaacataagaatctccaggcgattctcacccaccagttgcgtgcgttgatctaccgtgtcgagaatgccggccattaaaagctcctgatgtgggattgtgctgctcacttaaggcttgttatcggcggcaagcgccagaccttgaccccggtaaaatgccacgtaaattcattgatgtcacactgacatcatgctttactgcaacggcctctccaaatggcactacagcaacgttgcgcgacattcaaatcgacgcgaggttccgctgtgtaagggattcccctatgaacaatcaggcccaacctgatattcgcgatatctaatagccattaatgtgacgccattctcattgcatgaatggagtcaggcttttgtttgccatcccaagccctcggcccacgggtcttccagagactcacgtggcggcaactgaagttgtgcgatcgcccaggatagtgcggcgtatgcgcggcatttgcgatcattcaagtatcggtcctactgaaatttcagaacggggctacagatttcagtcatatttcagcggtagttttacgccattcacccggtgcggcatctcatcacccgaccttatgttgcggagacttgcatgatgaataacgcaaacgaatggcaaaccgctcttccggagttcttgcttgaagccgagacgctcctggccaagtcggaagagtgcttgaaccacttgcacttgattcgcaacgacagcgatgccatcgactgcatgaaaatcagcctgagcaaactggctgaaaaggccgaaggcctggccctgcaggcgatcagcgaattctcccggcatattcaatacctgattgcgaatgccgcaagccccatggaactgcatgaccaggccttgaatgccctgcatgactgcctgacattactggcttggcaactggagctgattgacacccgcaccggggagttggcgctggatgaaagcgaacaaactaaattgattgcgaccgtcaccttgcagatcccacaaaaagacttcggttataaaccgcagcagcgtgtgcatcacacgtcttgagtgttgagcaggtcgtgttcaatcggtgagttatctaaaaacgacaccgatatatcaattagccatcaacgctctaactctacaaacccacttaattaatacaactgccacctctttgaactctgggactccttaatgtcaggattagggcccagggcgtttgtgcgtggttaataagcagtggagtgatgcgccaggcgaccaacggtaatagtggtggtactatgccccgctcgaagtgactcaacttcactatgtacaaaaaaatgtttcggcaccgcattccaaacagagccctgtcagccgccatgaccggtcttcccgcagcgaaccttgattggctccatccgctatgtacgccagcctgaagtcactcatcgcaagatccgtgtcccgcagtaatgcccgtcggatcgttctcgccctgtgcctttgctctttgctggtcagtttgtgggcctacacccgttcggcaccgttgccattactgatcctgctgctcaacctggccatcttgctggtggtgggcctgcaacagtggagttcgcgcaaatcgatcaaattccagccacaggaattggccgatcgcctgctgcaagtccaggaaaacgaacgccatcgcctcagccgcgaattgcatgacgacattggccaactgcttaccgccgccaaactgcagagcgaatggctcaagcgccgcttgccggacgacctgcaaagccaatgcacggtgctgtgcaacaccctgaatgaaaccctggccaaggtgcgcgatgtgtcggccattcttaacccaaggcagctggccagcctgggtttagaggcaagcctgcgcgcgcacctgctcaagaccctggaaaacaccccgatccactggagcctggaatgccagcagcggctgaccggtatcccggaagaaatggccgtggcggcctttcgcatcacccaggaagcggtgaccaacatgcttcgtcatgcccaggcgcacaacttgctggtacgcctgcaacgcctgcccgagggcctgtcgctgatgatctgcgatgacggcctgggcttctcgcctgccatcaacccaggcctggaaggccaacggggcatggccggtatgtccgagcggatagatcagttgggcggcaccttgtccgtcaacagccagccaggcaaaggaacgaagatcgacgcgcttttcccctgggcgccgcgcgccctcgaacgggccagttcccctaaggttctcgagtgatctgcaatttactcttggtggatgaccacgcactgatacgggccggcgtacgcgcgctgatccaggacatgcccggctataccgtgatcggcgaggccagcgatggcgcgcagctgctggaaaaattcagcgccctgcagccggatatcgtgctgctggacctgtcgatgaaacaactgggcggcctggacgcgttagagcaactcaaagcggcctacccaaaaagcaaagtgttgatcctgtcgatgcacaccgacccggagctgatcatgcgcgcgctggaagccggcgcccacggctacctgctcaaggacaccaccgccaacgagctggaacacgccctgctggccttgcgcaacaacgagcgctacctgagcccggcgattgcccacacggtgatcaatcaggcgctgatccgcagccagggcccgacctctcccgccgcccacagccacaacctcacggcgcgccagctggaaatcctgcggttgatcgtgcgcggcaagtccacccgcgaaatcgcccacggcctgggcctgagcatcaagaccgtggaagcccaccgctcgcagatcatgaaacgcctgcagattttcgatgtggcgggcctggtgttattcgccgttcgcgagcagatcatcagcctggacgactagcggcgagttcagcggcaagtgcacgcgcagggctttgggcagcgcggaaaaacgcaggtcatcgcccttcaacggctcgccatcgaggttgatgtacagcccttcggccaccttgatttcgacccatggcaggcgcgcgcgcacaaacatattgtccaggccccagccgtcgctcatcagcgtcatcagcgtgccgaccacctcctgaggcgccggcaggatgctgatatcgagcaagccatcgtcggccagcgcgccggggcacagcacatgcccaccgcccgcctggcgaccgttgccgatgcccagcgcaagcaaatcgcccttccaatggaaacctgggccttccagctcgccataggccgccttcaattcgctgaaacgcgacagaccggtgaacaggtaagcagcgccaccgagcacttttttcaggtcttcggaggtgttggccgtcacctggctgccaaaaccgccggtggccatattgaggaacatttgcccacccgcctggccgaggtcgatagccttgggcggcacatccagcaacgccagtgccttggccggctcaagcggcacgccggcggcgcgggcgaagtcattggcggtacccagtggcatcagcaccaggctggcgtcggtcttggccaaggccatggcctcggccacgtcgcgcaaggtgccgtcgccgcccccggcgatcaggtgggtgtaaccgtcggccaaggcctcgtcgaccaggcgccgggcgtcgccgccctcccacgtcacccgcaccgccagctcccagccttgttcacgccgggcctgcacggccgcgcgcacgtcctcgttgagggcttgcttgccgtgcaggatcaacagtgccttgtgggtgctcatcgggggaaatctcctggttcaaaggtgcttgaaggatgtggacctttggggaggagaaaaaagccatcgaagtcgtaaattatttggcaggcaaggaattaaccatcgcaaggccgccatgcatgatcgttcccacgctctgcgtgggaatgccgcattggacgctccgcgtcttgcctcttaagtcgtgacgcggagcgtcacagggtgcatgcccacgcggagcgtgggcacgatcaactcagggagacagccgtcagctcttgtgcaacttgctcatcaactgcgcttcagcctgggtcagcccacacgactgcgtgagctcatccacggtcgcgcccatgcccaccagttttgccgcctgggcaaatgacaggctcgacgggtcgcgctgttcgatctgcgccagcttgtccggcaacggcccgaggatcgcgcgcagttcgtgcacctcgtccccgacctttaccgcactctgctggaagtgatccacgcgcttgaccaggtcgaggatgcgccggtcacgcacggcatcacgctcagcctgttgcagggccaattcccgttgctggcgcatgtagcgcagcaggaatgccaccgtcccggcccacaacagggccaggacaatcaccgccgcctcaaagaacaatcagatgctctccagttccgaccattcttcttcgctcatcatcttgtccagctcaaccagaatcagcagttcaccgttcttgttgcacacgccctggataaacttggcggattcttcgttgcccacgttcggcgcggtttccacttccgattggcgcaggtaaaccacttcagccacgctgtcgaccatgatcccgaccacttgcttgtcggcttcgatgatgacgatacgggtgttgtcgttgacttcggtcggcaccaggccaaaacgctggcgggtatcgatcaccgtcaccacgttgccgcgcaggttgatgatgcccagcacgtagcttggcgcacccggcaccggggcgatctcggtgtagcgcagcacttcctgcacgcgcatcacgttgatgccgtaggactcattgtccagcttgaaggttacccattgcaggattggatcatcgaccaaaccttgtgcggatgctgacttgttcatttctcggaccccttcaaatgccgctcaacacggcgtgtgtacttcgctgaccgcactcgcatgcggaccttattgttcaatcaactgcgtttgttctgtggcatcgcttttacggcgccgctggcgatcaactcagccagttcggcgacgtcgagcaacgcgcacatgtgttcaatcacggtgcccgccagccatggccgttgaccacggtggctgcgccatttgatttcattcgggtccaggcgcaacgagcggctgacttgatgcaccgccagcccccactcgtagccctgcaccgagatcacgtactgcaaaccctggcggaaatcatcgcggtaacggtcgggcatcacccaacgcgcggtgtccagcaccttgaggttgccggcctggctgggcaggatgccgaggaaccattccggttgcccgaacagtggcgtcagctcctggccttccagcgaataaatcgagcccaggcacaccagcggcaccgccaaggtcaacccggcgacgtcgaacaacaggcattcgaacggctcggcggcccatgacgggcggccatcaccggtgaccggcggcggcgtgatgctgggcggcaggtgcacttccaccacaggctcgaccaccaccggcgccaccaccaccggcgcaatcggcacaaccacaggcaccacgtgcgcgtcgcgggcttgttcttcaagcaccgccagctggaattcatccaacgtgctgtcaggttctgcaacggcaggttcaagaaccagaagcggttccggcagttcttcttccgtcgcttcctgcagcaaggcatccaggtaggattccagtgccagttgcggccgggtcttgagttcaacgggacggttcatcacgccacctgcgccacaagttgctgcgacagcaggtgcttgagcagcgcgcggtaggccagcacgccacggcttttgccgtcgaactgcgaaggcgtcagcccggcacggctggcgtcacgcaggcgcgtgtccaccgggatgtagccgttccaaatggtgtccgggtaggcatcgcgcaatacccgcaaagtacccagggacgcttgggtacggcggtcgaacaaggtcggcacgatgctgaacggcagcgcctgcttgcgcgagcggttgatcatcgccaaggtgctgaccatgcgttccaggcctttgaccgccaggtgctcggtctgcaccgggatcaccagttgctggctggccgccaaggcgttgaccatcagcacgccgagcagcggcgggctgtcgataatggcgtagtcgaagtcctgccacagttgcgccagggtcttggcgatgaccagacccaggccgctctgccccggcgactggcgctcaagggtggccagggcggtgctggacggcagcagtgagatgctttcgttactggtgggcagcaacagttgcccaggcaagtcggcaggcacgctgcctttgtgcaggaacaagtcgtagcagctgtgctccagcgcatccgggtcgtagccgaaatagctggtcatcgagccatgcgggtccaggtcgaccacgaccacacgcttgcccgcctcggccagcaagccggctaaggcgatggaggtggtggtcttgccgactccacctttttgattggcaactgcccagactctcattcggttggttcctcccggcaggcgttggcgcgaccgagacagtgcataaaattagtgagccggtgacggagaattgacggcgctctgacgaaccggcggcttaacggttggcggtgcagtttgtgtgccagcccgcttgagtgccgcatccggtgtggcattggccgtgccggtgccggtcaggctacggcgtacatccaggttgcgcgaaaccaccaacaccacacggcggttgcgcgcgcggccttcggcggtggcgttattggccaccggctggaattcaccatagcccaccgacgccagccggccagggttcacgccctgcatcgcgagcatgcgcacgatgctcgcggcacgcgccgaggacagttcccagttggtcgggtactgcgcggtggcaatcgggaaattgtcggtaaagccttccacgtggatcgggttttcaaacggcttgaggatcgccgccaccttgtcgatgatggtgaaggcctggtcgctcggcatcgcgtcggcgctggcgaacagcaggctggaattcagctcgatctccacccacagctcattgccgcgcacggtcatctggttggatttgatcaggtcgccaaacgcggcactgatgtcatcggcaatgcttttcagtgggtcgctggtgccgcccacgccggcggcggtttcatcgctgtcgttgaccagcggcttggccggggtgacggtcttgggccgttcttcaccgataggaatcggcttgagggcacggtcggcgtcgttgaacacaccgatcagcgcctgggaaatcaccttgtacttgccttcgttgatcgacgagatggagtacatgaccacgaaaaacgcgaacagcaaggtaatgaagtcggcgtaggacaccagccagcgttcatggttgacgtgctcttcaggctcgcggcggcgacggctcacaggcagttacctctctgaacacggcactgacggcggttgtggttgtggttgtggcgagcgagcttgctcgcgctggggcgcgaagcggccccactccaggcaacgcgtttgttcaggcaaattgcggtgtctggttttggggctgcttcgcagcccagcgcgagcaagctcgctcgccacaacaagccgggctgccacaggaagctcgctcgccacataaagttcactggccacaggtcacagtgcatgcgcatcaatccatgaagccctggagcttcaattcgatggagcgcgggttctcaccctcggcaatcgacaagaggccttccagcaacatttcgcggtaacgcgattggcgcatggcgatcgacttgagcttgctggccaccggcagcaacaccaggttggcactcgccacgccgtagatggtggcgacaaacgccacggcaatgccgctgcccaactgcgacgggtcggccaggttgcccatcacgtggatcaggcccatcaccgcaccgatgatgccgatggtcggcgcgtagccgcccatgctttcaaagactttggcggcgttgatgtcgcggctttcctgggtgtagaagtccacttcgaggatgctgcggatcgcttccggttcggcgccgtccaccagcaattgcaggcctttgcgcgcgtagctgtcgggctcggcatcggccacgccttccaggcccagcaggccttccttgcgggcggtgaggctccagttgaccacgcggtcgatgccgcctggcaggtcgacgcgcggcgggaaaataatccacaccagaatctgcatggcacgcttgaacgaactcagcggcgactgcaacaacgcggcgcccacggtgccgccaatcacaatcaatgctgccgggccgttggccaaggcgccgaggtggccgccttcgaggtagttgccgccgataatcgcgacaaacgccatggtgatgccaatcaggctcaagacatccatcagaggcaggcctccaccagatgtttaccgatgtcgtccaggctgtagacggcgtcggccaggtccgccttgacgatggccatgggcatgccatagatcacgcagctggcttcgtcctgcgcccagatcgcgctgccgccctgcttgagcaggcgcgcgccttcacggccgtcggcgcccatgccggtgagcaccaccgccagaactttgtcgccgtaggacttggccgccgagccgaaagtgatgtccacgcacggcttgtaattcaaacgttcgtcacccggcaggattttgatcgcgccacggccatccaccatcatctgcttgccacccggcgccagcagcgccaggccaggacgcaggatgtcgccatcctcggcttccttgacggtgatgcggcacagcttgtccaaacgctcggcgaaggccttggtgaaggccgccggcatgtgctggatcagcacaatcggtgccgggaagttggccggcaattgcgtcaacacgcgctgcagcgccaccgggccgccggtagacgtgccgatagcgaccagtttgtaggctttgcgcttgggcgcaggcgaatgcgcgctcggtgcagcggcacgtacggctggcgccgcagggcgtgccacgggcgcaggcgccgggcgtgcaaatgacgacgtcggcgcagcaggcgctgccgccggtgcaggcgctggcgcactgaacaggctgcgacggttactgcgcgaaatgctgtgcaccttctcgcacagcatctgcttgaccttctcggggttgcgcgagatgtcttcgaaattcttcggcaaaaagtccaccgcaccggcgtccagcgcgtccagggtgacccgggcgccttcgtgcgtcagcgaggagaacatcaacaccggagtcgggcagcgctgcatgatgtgccgaaccgccgtgatgccatccatcatcggcatctcgtagtccatggtgatcacgtcgggcttcaacgcaatggcttgatcaatcgcttctttgccgttggtggccgtaccgaccacctggatcgttggatcggcggaaagaatttccgagacgcggcggcggaagaaacccgaatcgtccaccaccaggaccttgactgccataaacactccgttaggcggggcgggcattaccgcccaagccccaccagaatcaaatacgccgtgcggcgtaacgcttgagcatgctcggaacatcgagaatcagcgcgatccgaccgtcaccggtgatggtcgcacccgacatgcccggggttccctgcagcattttgcccaaaggcttgatgaccacttcttcctggcccaccaactggtcgacgacaaagccgatccgctgagtgcccacggagagaatcaccacatggccttcgcgctgctcttcatgcttggccgaagccaccagccagcgcttgaggtagaacagtggcaacgccttgtcgcgcacgatcaccacttcctggccgtccaccacgttggtgcgcgacaggtcgaggtggaagatctcgttgacgttgaccagcgggaaggcgaacgcctggttgcccagcatcaccatcagggtcggcatgatcgccaaggtcaacggcaccttgatgacgatcttggagccctggcccttggtcgagtaaatgttgatcgagccgttgagctggctgatcttggttttcaccacgtccatgcccacgccacggccggacacgtcggagatctcggtcttggtcgagaagcccggggcgaagatcaggttgtagcactcggtgtcggtcaggcggtcggcggcgtccttgtccatcacgccacgcttgaccgcgatattgcgcagaatcgccgggtccatgcctttgccgtcatcggtgatcgacagcaggatatggtcgccttcctgctccgccgccagaatcactttgccgttgcgggacttgcccgaggcttcgcgttcttccggggtttcgacgccatggtcgacggcgttgcgcaccaagtggaccagcgggtcggccagggcctcgacaaggtttttgtcgaggtcggtttcttcacccaccagttccaggttgatttctttcttgagctggcgtgccaggtcgcgaaccaggcgcgggaagcggccgaagactttcttgatcggctgcatccgcgttttcatcacggcggtctgcaagtctgcggtgaccacgtcgaggttcgacacggccttttgcatggcttcgtcgccgctgttcaggcccaggcgcaccaggcggttacgcaccagcaccagttcgccgaccatgttcatgatgtcgtccaggcgcgcagtatcaacgcgcaccgtggtttcggcttcactggcaggtttttcggccaccggcgccgctgcggcacgcgcaggtgccgcagcggctgccggggctggagctggagctggtttggcggcagctttggccggcgcaggtttctctgccaccggtgcggcagttgcagccgcagcggccggggccacttcggtgaacttgcctttgccgtgcaattcgtcgagcagggcttcgaattcgtgatcggagatcagcccgtcgccggcaggttcagccttggcggctggcgctgcggcggtcgcggcgacttccggcaaggcttcggccacaaacgtgcctttgccatgcagttggtcgagcaatgcttcgaattcgtcgtcggtaatgtcggtgctggcaggcgcagccggtgcttgcggttcggcggcagcaggcggctcggcggcagcaggcgccaatgcgtcggcggcgaactggcctttgccatgcagttggtcgagcaaggactcgaactcagcgtcggtaatgtcttcgctggtcggcgtggcaggcgcggctgcgggtgcttgctgcgcttgcgcctcggctttcacggcgctgagggagttgagcagctgttcgaactcgctgtcggtcacatccgcttcaggctcggccaccggcgccgcttccaccaccggcgcaaccgccgtggtgtcggcaggttcggccaggcgcgccagggcggccagcagttccggggtggcagccgtgatcggggcacgttcgcgcacttcgctgaacatgccgttgaccgcatccaatgcttcgagaattacgtccatcagttccgagtcgacgtggcgctcacccttgcgcaggatgtcgaacacgttctcggcgatgtgacagcactccaccagctcatggagctggaggaagccggcgcccccttttacagtgtgaaaaccgcgaaaaattgcattgagcaggttcgcatcatccgggcggctttccagctcgaccagttgttcggacagttgctctaaaatttcgccggcctctacaaggaaatcctgaaggatttcttcatcggcgccgaagctcatgtgggtgctccttagaagcctaaactggataacaggtcatctacgtcatcctgacctgacataacgtcttcacgtttatcggcatgaatctgcggaccttcacccttggcgagatgtttttgtggatctttttccgagaggatcgcttcgcggtcatgttcgatgccggcaaaacgatcaacctggccggccatgagcaccaatttgagcaggttgctttccacttcggtgaccaattgggtcacgcgcttgatcacttgaccggtgaggtcctggtaatcctgggcgagcagaatgtcattgaggttgctggcaaccgtgcggttttcctgctcgctgcgcgacaaaaagccgtcgacccgacgcgccaattcacgaaactcttccgcgcccacttcccgacgcatgaagcggccccagtcaacgctgagggcctgcgcttcggtggccatgccattgaccaggggcgtggcgttttccaccaggtccatggtgcggttggccgctgcctcagtcagcctgaccacgtaggacaggcgctcggtagcatcggtgatttgcgaaatctcttcggcctggggcatatgcgggtcaatctggaaattgacgatcgcactgtgcagctcgcgtgtgagcttgcccacttcctggtacaggccgcggtcacgggtctggttgagctcatggattaactgcaccgcgtcgccgaactggcctttttcaaggctgtcgaccaactggtgagcatgctttttcagggtcgactcaaaatcgccctgtgacgtttctttatgctccatagctcccccgtggcagcatcaatgaccgatgcgttcgaagattttttcgatcttctctttcaaggccagcgcagtgaatggcttgaccacgtaaccgttaaccccggcttgggcggcttcgatgatctgttcacgcttggcttcggcggtcaccatcaacacaggcaagctgcgcagtttttcatcggcgcgcacgtgacgcagcaagtcgatgccggtcatgcccggcatgttccagtcggttaccagaaagtcgatgctcccgctgttgaggatcggaatcgccgtaatgccgtcatccgcctcgaccgtgttggtgaacccaaggtcacgcaacaggttttttatgatccgccgcatcgttgagaagtcatcaacgatgaggattttcatgttcttgtccaattcgacctccaagcagtcttaaacgcgcccagcacctggacgcgccatttcaatcaacaggcgttacacaaaaaggactgcccagggcaccacggaacgaacccgcgaaggcttgaagccttcgcggtagcgtctgcagtgtccccacactgcctgtcagcgcgcgcgccactctcccaatcgcccccgcaagcgggctgcgcactggctgtgcaactggctgacacgcgattcgctgacccccaggacctcaccgatttccttgaggttcagctcttcgtcgtagtacagcgccaacaccagtcgctcacgctccggcaaattggcaatcgcatccgccaatgcgccctggaaacgttcgtcttccaggtcgcgcgacggttcgagatgagcactcgcgccgtcctcgtgcagcccttcgtgttcgccgtcctgcaacaggtcgtcgaaactgaacaggcggctgcccaaggtatcgttcaaaatcccgtagtaatcgtcgagactcaattggagttcggccgcaacttcatgatctttagcgtcacgaccggtttttgcttcaattgcgcgaattgcgtcactgaccattcgcgtgttgcggtgtaccgagcgcggcgcccaatcccctttacgcacctcatcgagcatcgcgccacggatacggatgcccgcatacgtctcgaaactcgcccctttgctcgcgtcgtatttggtcgacacttcgagcaaaccgatcatgccggcctggatcaggtcttcgacctgcacgctggcgggcaggcgtgccagcaggtggtaggcaatgcgcttgaccaggggcgcatagcgctcgatcaattcgccttggctgtcacgtgccgactttttgtaaaggttgtagccgctggatgtcatagcacaggtcccgcgctcgtctgatgcaccaatcgctcgacgaaaaactccagatgcccccgagggttggcgggcaacggccaagtatcgaccttctgggcaatagccttgaacgccagtgcgcacttcgaacgagggaacgcttcgtagactgcacgctgcttttgcacagccttgcgcacacactcgtcataaggaactgcgccaacgtattgtaaggcgacatcaaggaagcgatccgtgaccttggtcaacttggcgaacaggtttcgcccttcctgcgggctttgggccatgttggccagcacgcggaagcggttcatgccgtagtcacggttaagcagtttgatcagggcataggcgtcggtgatcgaggtgggttcgtcgcagaccaccagcagcacctcttgcgcggcgcgcacgaagctgaccacggactcgccgatgccggcggcggtgtcgatcaccagcacgtcgaggttgtcgccgatgtcgctgaaagcctggatcaggccggcatgctgcgccgggctcaggtgcaccatgctctgggtgcccgaggcggccggcacgatgcgaatgccaccggggccttgcagcagcacatcgcgcagctcgcagcggccttcaatcacatcggcaagggtgtgtttgggtgtcagccccagcaacacgtcgacattcgccaggcccaggtcagcatccagcagcatgacgcgacggccaagctctgccagggccagggacaaattcactgacacgttagttttcccgacgccacctttgccgccggtcaccgcgatcacctgtacgggatgcatgctgcccattttatttctttaccttgtcttgcttagacgcaggctacatggcttggccgcgtgaatcgcttgcagaccatcgatgtagatacatttcacggtgttcatcctgaccctcaacccacccgcttggcggggttgtggtaaaggtcggcgaacatatcggccatcgcttcctcgctaggctcttcttgcatttgcacactgacagcacggctgaccaactgatgacggcgcggcagatgaagatcatccgggatccgcggcccgtcggtcaggtaggcgaccggtaattcatgactgatagccaggctcagcacttcgcccaggctcgcggtttcgtcgagcttggtgaggatgcaaccggccaggccgcagcgtttgtagctgtggtaggcagcggtaagaacctgtttctggctggtggttgcaagcaccaggtaatttttcgacttgatgccacgcccggccaggctttccagctgcatgcgcagcgccgggtcactggcttgcaggccggcggtgtcgatcagcactacgcgtttgcgcagcagcgggtcgagggcgttggccagggactggcccgggtcgacgtgggtcaccgacacattgagaatgcggcccaacgtcttgagctgctcctgggcgccgatgcggtagctgtccatgctcaccagcgcgatattctgcgcgccgtacttgagcacataacgcgcagccagcttggccagggtggtggtcttgcccatgccggcagggccgaccatggcaatcacaccgccctcttccagcggttcgatttccggggtgacgatcatgcgcgccaggtgcgccagcaacatgcgccaggcttggcgcggttcttcaacttcggcggtcagcgccagcaggtcgcgggacaacgggccggacaggccgatgcgttgcaggcggcgccacaggttggcctgttgcggcttgctgccttgcaactggttccaggcaagcgacccgagctgtacttcgagcagttcacgcaggccattgagttcaaaacgcatcgaatcgaacacgcgctggtcgactgcggcggccggggctggcgctgcaggacgtggcggttctttgaaagtcggttcaaccagcggctcggcggcggtcagcggcaggccggcgaacaactggcgattggtggtggtatcgctgtcgccacgcatgctcagctcagcctgggccgagacaatgcgcgaagcggtcttgcgcagctcgtcttcgagctccatgttcggcacgcgcggcgccaaggcctgcggcgtgtaatccagcgcagccgtcagctcgacaccgccggcaatgcgacggttgccgataatcgcggcatcggcgcccagctcatcacgtaccagtttcatggcctgacgcatatcggcggcgaaaaaacgcttaacttgcataacccactacctcagccgttgggccctactgtcgcgacgatagtcacttgcttgttgtcaggaatttcctgataagccaaaacgtgcaaattcggtactgccaggcgtccaaaccgcgacaacatcgcgcggaccgggcctgccaccagcagaatcaccgggtgacccgccatttcctggcgctgcgcggcttcgatcaacgagcgctgcagtttttccgccatgcttggctccagcagaacgccctcttcctggccttgtcctgccttctgaatactattgagcaatatttgttccaaccttggctccaaggtaataacaggcagctcagactcaatgcctacaatgctttgcacgattgcacgggacaatccgacgcgcaccgccgccaccagagcggcagtatcttgactcttggcggcattgttggcgatggcctcggcgatgctgcgaatgtcgcgcaccggcacctgttcggcaagcaaggcttgcagcactttgagcaactgcgacagcgacagcacgcccggcaccagttcttcggccaattttggcgaggctttggccagcaaacccatcaattgctggacttcctcgtggccgatcagctcgtgggagtgcttgtacaggatctggttgaggtgcgtggcgaccacggtgctggcatcaaccacggtgtaaccgagggattgcgcctggctgcgctggctgacttcgatccacaccgcttccaggccaaaagccggatctttggcggtgatgccgttaagcgtaccgaacacctggccggggttgatcgccagttcgcggtcggggtaaatctcggcttcggcgaggatcacgcccatcagggtcaatcggtaggcgctgggcgccaggtcgaggttgtcgcggatatgcacggtgggcatcaggaagcccaggtcctgggacagcttcttgcgcacgcccttgatccgcgccagcaattggccgccctggttgcggtccaccaacggaatcaggcggtagccgacttccaggccgatcatgtcgatcggggtcacgtcatcccagccaagctccttggtttcctgggcgcgggccggagacggcagcagatcttgttggcgggcgatctcctgctgggccaggaccttgacctggttttgcttgcgccagaacaggtaagcgccgccggccgccatggccgccatgctcaggaacgagatatgcggcatgcccggcacgatgcccatgatcgccatgatgcccgccgccacggccagcgctttgggcgaggcgaacatctgccggctgatctgcttgcccatgtcttcggaacccgaagcacgggtcaccatgatcgccgccgctgtggataacaacagtgatggcaattgcgccactaaaccgtcaccgatggtcagcaaggcgtagaccttgcccgcatcgccgaaggtcatgccgtgctggaagataccgaccgccatgccgccgatcaggttgatgaacagaatcaacaggccggcgatggcgtcaccgcgtacgaatttgctcgcgccgtccatggagccgtagaactcggcctcctgggccacttccaggcggcgggccttggcttggccctggtcgatcaggccggcgttgaggtcggcgtcgatggccatttgtttgccgggcatggcgtcgagggtaaaccgcgcgctcacctcggaaatccgcccggcgcccttggtcaccaccacgaagttgatgatcatcaggatcgcgaacaccacgataccgaccacgtagttaccgccgatcaccacctcaccgaaggcctggatcaccttaccggcggcggcgtggccgtcctggccgtggagcatcaccacccgcgtggacgccacgttgagcgccaggcgcagcagcgttgcaatcagcaggatggtggggaagacggcgaagtccagtgggcgcagggcgtacacgcagaccagcagcaccaccaccgacagggcgatgttgaaggtgaagaacacatcgagcaggaacggcggcatcggcaacatcatcattgccagcatcaccagcaacaacaacggcacacccaggttgccccgcgacaagtcagtcagggtgccacgggccgtgttgagcatttgagagcgatctaccaccggtattcctcgtgttccttgaagcaaagttttgacgctgagaggcgtcctggaggcggtattgcaagaagccttccaactttggattcatgccgacgatcgtcgagccggaactgattcaagggtgggagctggcttgcctgcgattgcggtgtacccgtcacctaaagggccggccatgagtcagtcatcgcaggcaagccagctcccacatttggaactgtatacatctgctgctatcgaggaaatttccgacagggttttaaggtttttgatcgttcccacgctctgcgtgggaatgccgcctgggacgctccgcgtcccgatttgagccctgcgcaatggtgacgcggagcgtcacgggatgcattcccacgcgggagcgtgggaacgatcatcgaatactcagtaactccaccttaaaaacaagtgtcgcgttcggcggaatgaccccacccaaacccttcgcgccatacccaagttggggaggaatcgtcagttcgcggacgcctccaaccttcatcccctgcacgccttcgtcccacccctggataaccctaccgcgacccagttcgaacgcgaacgggtcattacggtcccaacttgagtcgaactttttgcccctcgagtcgggcttgtcgccgtcctccagccagccggtgtagtgaacggtgacggtctggccagccaccgcttctgcaccatcgccctcttttatgtcctgatattgaagaccgctttcagtcgtgaccatagccatatgctccttaacccgaggggctgaagtgatcgttcccacgctctgcgtgggaatgccgcctgggacgctccgcgtcccgatttgagccctgcgcaacggtgacgcggagcgtcacgggatgcattcccacgcgggagcgtgggaacgatcatcaaacactcattaactccacttcataaacaagtgttgcgcccggcggaacgcccccactccatccctggtcgccatacccaagctggggcggaatcgtcagtttgcggatgcctcccaccttcatccccagcacgccctcctccaaccctttgatgaccttattgcgacccagcacgatgacgaacggcttgccacggtccctactcgagtcgaacttcttaccatccgtcagcgtgccgacgtagtgaacgttggcggccaccccagccactgcttctgcgccatcgccctgttttatgtcctcatactgaagaccgcttttagtcgttaccgtagccatattccgctccttaacccgaagggttgaagtgatcgttcccacgctctgcgtgggaatgccgcctggggcgctccgcgtcccgatttgagccctgcgcaacggtgacgcggagcgtcacggggagcattcccacgcgggagcgtgggaacgatcaatcactgcgtgcctacaggaccttgacgcgatcagcctgtggcccttttggaccttgggaaacctcgaattccacttccacgccctcatcaagcgtcttgaatccgccggtctctattgccgagtagtgaacgaaaacgtcatgcccatcaccatcctgagtaataaacccaaagcccttttcagcgttaaaccatttcactttgcctgttgccattgccgctctcctgacatcgcgctcgaaacccggcaccacgtcgctagataatcttgatgtagagcgcaaaaacgcccgtgggccgatgaatcctcgcgagttgcacccgctgcccatttttcaaccggcgcgcacccagactcctacgatccacacgcacgggctcttcgccgccatccactgcgatccaaccttcaccggttttttggttgtacgatttgatcgtgcccgtcaccgcttccatcaccactccccctgcatctcgcaactacttgtgtgcagtgtgtgctgtcatggaaccgcaggaaggcgaggctggctactgtcaatgttgacaggtagacgggggttgcggacgagtggtagagggcgggtgaaaaccgagggacgtgctgagcggcttgccacaacaagcgctgctcccggaccgggtccggttttatttttttcgctggcgagatgttcgcgccttgggcggcgccggcaacccatcgaccgcgctgcattgatcgaccgccggctgcacgggcaccgcattgccatcgcggtgcctggcaataaaaccaatgcccttgaccgcgtcgaaccacctgaccgtgcccctgtccatcaccgctctcccgagccacgcataaaggcgcgcctcgctgctctatcaaacagtgaaggcggtgtaatgggtactgtcaaagttgacaggtaagcgcaggttttagacagatggcaggcgttggctgttataccaccatcgcgggcaagcccggctcccacagggggtgggagccgggcttgcccgcgatggcgtcggtgcaggatggctcaggaatcgcggcgcaagtccggtggaatcggcaggtctttaagcggttcgggccgcttgcccttgcccgcacggtattggcggatctggtagacgtaggccaacacctgcgccaccgccaaatacagccctgcaggaatctcctgatccagatccgtggagtagaaaatcgaacgcgccagctccggcgactccagcaacagaatgtcgttggccacggcgatttcgcggattttcagcgcggtaaagtcgctgcccttggccagcagcatcggcgcgccgcccttctccgggtcgtacttgagggccacggcgtagtgggtcgggttggtgatgaccacgtcggcatccggcaccgccgccatcatcttgcgctgggacatttcgcgttgcagttggcgaatacgctgtttgacctcggggcggccctcttggtctttgtgctcgtcgcgcacttcctgcttggtcatcagcagcttcttgtggctttcccacagctggatcggcgcgtccacggcggcgatgatgatcagcccgcaggccatccacagcgcactccagcccaccacttgcacgctatggatgatcgccgactccagcggctcatgggcaatgcgcagcaagtcgtcgatgtcggacgacaacaccgtcagcgctacaaacagaatcaggatgaatttcgccagcgccttgagcagttccaccaacgccttggtggaaaacatgcgcttgagcccaggcccggggttcatgcggctgaacttgggcgccatgctgccggcggcgaacagccagccgccaagggacaccggcccgatcaaggccgccaacagcagcgtgatcagcaccggctgcaccgccagaattgcgattttgcccgagtgcagcaggtactggcccatggcgccggggctgagcagcacttcgcggggcaaggagaagttgagtctcatcaactccatcatgtccagcgccaaaccgccgccgtaaatcaacaggccaccggagccggccagcatcacggcgagggtattgagctctttggagcgcgcaatctcgcccttttccctggagtcctttttacgtttctccgtggggtcttctgttttgtcctgaccactctcgctctcggccatggctcaacgcgcccgtgccagatcacgtaagaactgcaaggcgtcggtcgccagcggttgatactgattgagaatgtcggccatgccgatccagaaaatccccatgcccaacaccagggtcaacgggaaaccaatcgagaaaatgttcagctgcggcgccgcgcgggtcatcaccccaaaggcgatgttgaccaccagcagcgcggtgattgccggcaacaccagcaacagcgaagcgcccagcacccagctcaggcgccccaccagttcccagaagtggttgaccaccagccccgagcccaccggcaaggtggtgaaactttcggtcatgacctcgaacaccaccaagtggccgttcatggccaggaacagcaaggtcaccaacatggtcaggaactgcccgatcaccgccaccgacacgccgttggtagggtcgaccatggacgcgaagcccatacccatctggatcgagatgatttgcccggcaatcacaaacgcctggaagaacaacgtcagcgagaagcccagcagcgcgccgatcaaaatctgctcggcaatcagcagcaacgcactcagatccagggcattcaccggcggcatcggcggcaacccgggcacgatcaccacggtgatggcgaaggcgaaatacaggcgaatgcgccgcggaaccaaggtggtgccgaacaccggcatggtcatcagcaccgccgtgacgcggaacatcggcaggatgaacgacgccacccaggtgctgatctgggtgtcggtcaaggccagcacagattgcatgcggtcagccgatcaactgcggaatactgccgtacagctgcaggatgtattccataaaggtttgcaccagccacgggccggcgacgatcagggtgatcagcatcaccagcaagcgcgggaggaagctcaaggtttgttcgttgatctgggtcgcggcctggaacatcgccaccaacaggccgaccaacaggctcggcaccaccagcacggcgaccatcatggtggtcagccacagcgcttcacgaaacaggtcgaccgctacttctggggtcatggcgctacactccgccgaaactgctggccagcgtaccgataatcagcgcccagccgtccaccagcacaaacagcatgatcttgaacggcagcgaaataatcagcggcgacagcatcatcatccccatggccatcagcacgctcgccaccaccaggtcgatgatcaggaacgggatgaaaatcatgaagccgatctggaacgcggtcttcaattcggaggtgacaaacgccggcaccaggatggtcaatggcgcctgatccggcgtggcaatgtcggtgcgcttggacaaacgcataaacagctcaaggtcgctggagcgggtttgcgacagcatgaagtccttgatcgggccttgggccttgtcgatcgcgtcctgggccgtgagtttttccgccaggtacggttgcagggcttgctggttcaccttgtcgaacaccggcgccatgatgaacagcgtcaaaaacagcgccatgccggtgaggatctggttcgacggcgtctgctgcaggccgagggcctgacgcagaatcgagaacacgatgatgatccgcgtgaagctggtcatcagcatcacaaacgccgggataaaactcagcgcggtcatgatcagcaggatctgcaggctgaccgagtattcctgggcgccggcagcgttggtgcccagcgtgatcgccgggatcgacaacgggtcggccgccaacgccaacggcgcggccagcaacagcatgagcgtcaataaaacgcgcattacttcttatccttctgatccttgcccagcaactccatcaggcgctgggcgaattctggcgtggtggcctcggtcttggccacttctaccggcgacttgagcacgtgcagcggggtgatgcggccgggcgtgatacccagcagaatctgttcctcgccgacttgcaccagcaccagacgatcacgcggaccgagggcgcgcgagccgatcatctcgatgacctggccattgcccgggccgatgcgctgcacgcggcgcatcaaccaggccagcacaaaaatcaaccccaccaccagcaacaggccgagcaccaactgcgtcagttgcccgccgatgccactgctgactacgggcgccgcagccgccgcttgtgcgaccggctcagccgccagggcgctcaatggcagcgccagaaacagtcccgccatcgaatacttcatatcagcgcaacttcttgatgcgttcgctcgggctgatcacgtcggtcaggcggatgccgaacttctcgttgaccaccaccacttcgccatgggcgatcagcgtgccgttgaccagcacgtccagcggttcgccggccaggcggtcgagctcgatcaccgaaccctggttgagctgcagcaggttgcggatgttgatttcggtgctgcccacttccatggaaatcgacaccggaatgtcgaggatcacgtccaggttcgggccgtcgagggtcaccgggtcgttgtttttcggcacgctgccgaattcttccatcggcagacggttgccggccggcgcggtggcggcgtcggcggccagcagcgcgtcgatgtcgtcctggccaacatcgccggtttcttccagggccgcagcccactcgtcagccagggcctggtcttcggcggaagtgttttcgtgttcggtagccattacatgtcctcggcgaagcaaaaattattgttgatcagcgacggttgatcggttcgatcacttgcaacgccaggttgcctttgtgcgaacccagcttgaccttgaacgacggcacgccgttggcacgcatgatcagttcttccggcaattccacgggaatcacatcgccgggctgcatgtgcaaaatatcgcgcaaacgcaactggcgacgggccacagtggcgctcaaaggtacgtcgacgtcgagcaggtcttcgcgcaaagccttgacccagcgctcgtcctggtcgtccaggtcggactggaaaccggcgtcgagcatctcgcgcaccggctcgatcatcgagtacggcatggtcacgtgcaggtcgccgccaccgccatcgagttcgatgtggaaggtggagaccacaatggcttcgctggggccgacgatgttggccatggccgggttaacttccgagttgatgtactcgaaattgacttccatgatcgcctgccaggcttccttcaagtcgatgaaggcctgctccagcaccatgcgcaccacgcgcagttcggtcggggtgaattcacggccttcgatcttggcgtgacggccgtcgccgccgaagaagttgtccaccagtttgaacaccagtttggcgtcgaggatgaacagcgcggtgccgcgcaacggcttgatcttgaccaggttgaggctggtgggcacgtacagcgagtgcacgtattcgccgaacttcatcacctgcacgccacccaccgccacgtccgccgaacggcgcagcatgttgaacatgctgatacgggtgtagcgggcgaaacgctcgttgatcatttccagcgtcggcatgcgtccacggacgatgcgatcctggctggtcaggtcataacttttgacgctgccgggttcggcagccatttcggtctgtaccagaccatcgtcgacgccatgcaacagcgcgtcgatttcatcctgggacagcaggtcttgcacggccatgtcgtgatcctactgcaatacgaagttagtgaagagcgcctgctcgaccacgactttgccgagctctttctgggccacttcctgcacgctggcagtgaccttctggcgcagcatttcctggccgaccggggtggcgaggctgtcgaagctctgcccggagaacagcatcaccaggttgttgcggatcactggcatatgcactttgagcgcatccaggtccgcctggttacgcgccagcaaggtgatgctcacctgcaagtagcgttgacggccgttctgattgaagttggcgacaaaggccggaagcatcggttcgaagattgccggttgcttgacgttactggcggtttcggcggcgggtgccggtttgcttgcactgctgtgcatgatgtaccaagtgccgcccaccgaggcgccaatggccaggagcaggcccagcacgatcaacaggattagcttgagcttgcctttgcctgcggggggagttgctgctgcgtcgtcgctcttcgccatgccaataatccgtcactattctgggattcatagatctacggaaaggcaagagcaagtgttatgccagagttgtctggtaatcagggaagcgagaacaccccggaccaaatgtgggagctggcttgcctgcgatggcggtgggtcagttggcatttctgtcactgatacaccgctatcgcaggcaagccagctcccacattgatcgggtttcaacaggtgtcaggcgtagtaatcaacggcgctggagccaatcaccgtctggctcaccggcgcgaccgccgccgccacttcagcgtgatcacccgcatcaccgccctcaccgcgtccgccgctgccactcacgccgcgcgcctggttctgctgttgttgctcctggccctgcccctgccagccacgcgactggtcggagacgttaacgtcgacctgccccatgccctgctgggcaaacatctcgcgcaaacggccggactgggtttccagcgcctcacgcaccaccgcgtgaccgctcatgaaggtgacctgggcttgttggtccgcggtcatgttgaccttgatatccaggcgccccagctcggccggctgcaactggatctcggccgacttgaggttggcgctggacaggtacatcacgcggttgaccacttcctcggtccaaccgctctggtgcatggccaacggggcattcgcaacgggtggcaaggcattcgcggttttcggcgtggcggcctgggtcagcgcggccaggcggttggcgaagtcatcgacgcgggtgtcgctgctggcgtctttcaaatctttgaggccgccttcgatcaagccactgaaggctttgtcgccgccctggtcagtgctgtctttggtggcttgctggtcgaccatattggccaggccggcggcaaagttctgcgccgcggtcggctgatcctgggtcggtgcgggtgcagctttctgcggcgtctggctgctggccgagacgtgaccgccctgctccatcgccaggcgcacggccggcatcgaatccagcgggtcggctgccgggtcgaacgcgggctgcttggcttcatcggtggcggcgaccggtggggcaacgaccggctgggccttatcgtcctttgtcgcggcaaccggggccggggtttccacgggcaccggaacggcaaccggggtgacggtggcaatcaaggccgggtcgacgaccgggtcaaccggcggttgctgcaccagggacgggtcggtgggtttgtcgtcgtcactgctggtgctgtcgtcggacgtggccggtggcttggcaggcaagggattgccgctatcggcaaccgctggcgtgctggcggcaggcttgtcgctgctgtttgcaggcttggtgctggcgtcggaaggcttgttattcgcgggtttagccggagtgtcgtcggtctttaccgtgggcttcgagccctggctggcgaacacttgagcaaagccctgggccttgtcccgcgggtccgcagccgctaccgcaggggtggcggccggcgcttgaggcttggccgcgggggcagcctgaaggagcgaattcggggcgactggcataggtaaaggtctccactgcattggggatcggggatgcagtattgggaggtagagcaagagttgggccaggtttgcatgttgcggacaaatcgcccgctcaatgtgggagctggcttgcctgcgatagcggtataacggtgacgaatgagttgactgactcaccgcatcgcaggcaagccagctcccacagttgggttgtcatataggtattacacaggtgactcagaggctgaatcgctgcctttccgactcatacaacggccgaaccaaagcaaactcacgatcaatctgatcaaccaacgccccaaggtccgctgtcgatttaaccgactccacctccaagcgctggcacaactgcgccaattgcaccgccccaaggttgccactgctgcctttaaagctatgcgcaatccgccccaacgccttggcatcattacgcgccccgcgcaacgcatcgatgcgtttctttgaatcctcaaggaaggtatcgagcaacttgggatactcgccttccatcacttcctgcaaacccgacaacacgtcggggtccagatgaatctcagccacttgctcgctccttgatcaagaatcggcggattatgccagagccccccagcaaaactccacgcacacactgcgcccgccatcggaccagcgtacatcgctgctcagttgacggaccaggctcaagccgcggccagacagacggtcgacatccagcggccgcgccagcacctgttccacgtcaaacccagggccgctgtcttcaatgcgcaacgtcattttgccgcccgtggccgtcggcaccacttccacatgcacacgcacatagccgctgttcaactgcgccagccgctcattgcgcaggcggtaatagtgggcaaacccctgcgcatcacgcttgagcttcgaatccaggcccaacacgccatgctccagcgcattcgaatacaactcggccatcacactgtaaagcgccccgctctgcttgcgcaggccgtggatctccagcagtaattgcagcagatacggcagcgggttgtagcttttaagggtctgcgcgcgaaactcaaaactcaccgaccagtccagcgggcacgactgcccgctgtcggcatacagtgcctcggctgcgcgcaacggctggccgtcctgcaaggtgatctcgaccatgctgacgtcgtcccgcgcctggccacgaaacgctgccagggccttttcgatgtcttcgaacaggtgatcaggttcacggttggccgcgaacacctgctgcaaacgctcggcgccgaacaactggtcattggcatcggcggtgtccagcacgccatcggaaagcaaaaagacgcgatcaccgagggccatgggccagacctcggtgctgtcatcaaacgtctccgccgacagcacgcctaacggcaggtgccgcgacaccaacggcgtgcgcttgcccgtggccacttcatgcacataaccctcgggcatgccgccgttccacacttccaccacgcgccgctgggcactcaggcacatcagggtggcgcagcagaacatgtccaccggcaggatgcgtttgagcttggcattcatctcccgcagtgtttgcgccaggccgtagcccttggccgtcatgccataaaacacttctgccagcggcatggcgccgacggcggccggcagcccgtggccggtgaaatcgccgagcagcacgtgcatgtcacccgagggcgtataggccgccagcagcaggtcgccgttgaacagcgcatagggcgattgcagatagcgaatgtttggcgccgcgttgatacagcccgagtgcgcaaccttgtcgaacaccgctttggccgcgcgctgctcgtgcagcaggtaatcgtggtgcctggcgatcaggtcacgctgctgcaacaccgtggcctgcaggcggcgcaggcgatccatggcgttgattttcgccgccaggatcagctgattgtaaggcttgggcaggaagtcatcgcctcccgcatccaggcactgggccagggcttcgctctcgcgcagggaggtgaggaagatgatcggcaccagcgcttcgcccgccagttgcttgatctggcgcgccgcttcaaagccgtccatcactggcatcagcgcgtccatcagcaccagctgcggacgctcacgcgtgaacacctcgacggcttgcgcgccgttcgtggcggtgagcacctgatgcccttggcgccgtatgatcgtcgacaacagcagtaaatccgccgcgctgtcttcggcgatcagcaccgtcagcggctcaaggaccggcgccaggcggctcaagtgagatcgaacagtttgtcgaagttggaaatggcgaggatcttgcgcacatcggggttgctgttaatcacctgcacttcggcattgtcaccaccggcatggtcgcgtaacagcaggagcatgcccagggccgagctgtccatgtaagtggtgtccttcaagtccaccacgtagagcgcgggcactttgtaaaaccgctcgtaggcatcacgaaaggcttggtggctaccgaaatcgaatcgccccttgaccgtgatcgtcaacttcgtcccatccagggatacttctgactcgactgacatacgactgcttccttgtcattggcaatatgcaacaaggtttagcagctgatagagatgtgggcaacactgatgatcaaaagtgggagagcatgtgtgggagctggcttgcctgcgatagcatcaccgcggtgtgactgataagcctcggcgcctgtatcgcaggcaagccagctcccacacaagcccagctcccacattaggtaggggttgggcgtcagtactgtgattggcggggaagacgctgtgacaactcatccagcagcttctgctcgcgcttgtcttcaatcgcccgcgcttcgtcgatataacgctgcaccaatttgcgcaaaccttcgacccgggcgaacgccgcctgccaggcctcgcgggctttatcgaggttgttctggtgccaggccaggctctggcgctgttggccgacggccgtctcaagctggttgagaaagccctggtagcccatcagccattggccggacacgcccttgctgccgcgttcgatccactgctgctggtactcgccgcgaaagcgctccaggtcgccgagcttgctttcggccaggcgcacctggccctggaaataacccaagcgctgtaccgcggctttttcggccttttcggccatgtccaccacgggggccaggcgtgaagaacgcgtgctggccatggcttaaccgcctggcgccggggcgaagatcgagcccaggtgggcttcgctttcgcccatgctgatcttgtcgttgaggccctggcgcaggtaggtcaccagttgcggttgcagggcaattgccaggtcggtttcacgatcgccgccggccacataggcaccgacgctgatcaagtcgcggctctgctgataacgcgaccacagctgcttgaagtgttgcgcgcgagccatgtgttccggcgtgaccacggcgggcatcacccggctgatcgaggcctcgatgtcgatggccgggtagtgcccttcttcggccaggcgccgcgacagcacgatgtggccgtcgagcacgccccgcgccgagtcggcaatcgggtcttgctggtcatcgccttcggacagcacggtgtagaacgcagtgatcgaaccgccaccggcctcggcattaccggcgcgctcaaccagcttgggcagtttggcgaacaccgacggcgggtagcctttggtggcgggcggttcgccaatggccagggcgatttcccgctgggcctgggcgaaacgcgtgagcgagtccatcagcaacaggacgttcttgcccttgtcgcggaaatattcagcgatgcgcgtgcagtacatggcggcgcgcaaacgcatcagcggcgcatcgtccgcaggcgacgccaccaccactgaacgcttaaggccttcttcaccgaggctgtgctcgatgaattccttcacctcacggccccgctcaccgatcagcccgaccacgataatgtcggcttcggtgaagcgcgtcatcatgcccagcaacaccgatttacccacacccgtaccggcgaacaggcccagacgctggccgcgaccgaccgtcaataaaccgttgatgctgcgaatgcccacgtccagcggcacgctgatggggttgcggttgagcgggttgatcgtcgggccgtccatcggcacccaatcttcggccttcatgccgcccttgccgtccaacgcacgaccggcgccgtcgagtacgcggccgagcatgctcatgcccatcggcaggcggccggtgtcggcaagtggcaccacgcgggcgccgggggcaatgcccgccaggctgcccactggcatgaggaaaatcttgctgccggaaaagcccatcacttcagcttcgacctgcaccgggtggtagctgtcgtcgttgatcaccaggcagcgactgcccatagcggcgcgcaggccttcggcttcaagggtcaggccgaccatgcgcagcaggcgcccttcgaggatcggttggccgggcaacaccgtggcctcggcgtagccgctgaggcgcttggcgaagctggtgcgatcaaggcgcatcggcggcgtccaggtcgacgctcaggtcaggctcggccgggtgcaaggcttgttcgtgcaactggtcgaagagcttggccatgatctgggtgatacgggtttccaccgtggcatcgatacggctgtgttcggtttcaacgcggcaaccaccgggcagcagcgccgcgtcttcgacgatgcgccaggtttcttcatggcgctcgcgcagggctttgacctgttcgaaatcctgcgggttgatgtacagccgcacattgccgacgcccaacggcagcagcttgagggcttcgcgcatcacgctttcgatgtggctggaatcaagcaccagctcgcgctggatcacctggcgggcaatgtgctcgaccaggccgaccatggatttttccagctgcgaatcctgttcggcgatcgggtcgaacaggctgcccatcaagcgttccaggctggccagcttgacgctgagcgcttcctcggcctcttggcggactttcagggtggtgctgcgaaaaccgtctttttcacccgccgcgaagccctcgttgtaggcctcctggcggatggcttccaattcttcaagggtcagtggctggacttcatccagcggcacttcttccatttccgccggtgtttccaccaccggttcaggctcgggctccggcacgtgcgggtcgaagctgggcaacgaccaaatgtcgaacccgccgacatcccgcgcgcgaatcagatcgctgggcgtctcatctttgttcgacatggatggcgccttagatcatttcttcgccgcccttcccgccgagaacgatttctccggcttcggccatacggcgggcaatggtgaggatttccttctgggcggtttccacgtcgctgacgcgcaccgggcccttggcttccaggtcgtcgcgcaacagttcggaagcacgcttggacatgttcttgaagatcttctctttgacgccttcgtccgagcctttgagggccagcaccagcacgtcggaagacacctcgcgcagcagcgcctgaatgccacggtcgtcgacatcggagaggttgttgaacacgaacatgaggtcttcgatctggccggacagggtgtcgtcgatctcgcggatcgagtccatcaactggccttcgaccgagctgtcgaggaagttcatgatgtcggccgcgcgcttgatgccacccagggtggtacgcgaggcgttcgagttgcccgagaactgcttctcgagaatcgtgttgagttctttcagggcggccggctgcacggtgttcagcgacgacacgcgcaggatgatgtccaggcgcactttatgatcgaagtggccaagcacttcaccggcctggtcggggtcgagataggcgacgacgatggcctggatctgcgggtgctcgtagcggatcacgtcggcgacggcacgcggctccatccatttcaggctgtcgaggccgctggtgttgccgcccagcaggatgcggtcgatcaggccgttggccttgtcttcgcccaacgccgaggtgagcatcttgcggatatagctgtcggagccgacgcccaggctggtctggtcgccgacgatctcgacgaactcgctcatcacctgttcgacttgctcgcggtgcacattgcgcatttgcgccatggccacgcccacgcgttgaacctctttggggcccatgtggcgcagcacttgtgcggcgtcggtctcacccagggacagcagcagaactgcggctttgtcgactttggtgagcttggcaacagcggctcgatcattcatctgcgttaatccactctttcacgacctgggccacacggcccgggtcttctgccaccaaactcttgattgcgttcaactgagcgtcgtagccttcgctcgggcttggcaacagaatgctttgcgggccaccgaggctgacgcggtcgttggccagttcgccgtccaggccgcccatgccacccaactcgacgtcgccgcccgccagggccagctgcttcttgccgtggccggtgatgttgttgagcaccgggcgcagcacgccgaacaccagcaccaggatgaacaacacacccagcacttgtttgacgatgtcccagaaccacggctgcgtgtagaacgacgggtcggcgatcacttcgccacgctcggcggagaacggcatgttgatcacgctgacactgtcgccacggctggcgtcgaaaccgacggcgtcctgcaccaggcgggtgaagcgcgccaattcgtcggcgctccagggcgcacgggtcacagcaccgtcagcggcattgaccttgacctggtcatcgaccaccaccgacaccgacaggcgattgatacggccctgctgctgtttggtgtggctgatggagcgatcgagttcgaagttcttggtcgactggttacgcttgtcggccgggtatggcgcgagcatcggctggccggtggccgggtccatgatctgctgaccgttggcgtccaacagtggctggccaggctgaatcgcaccagcggttgcggcagcgccaccggtggtttgcggtgccgaagcgggagctggcggctggttgctcagggcacccggcacaccttgcgggccattgctggcggtacgttgttcgctggtcgactgctcgctgcgcagggccggctggtccgggttgaactgctcggaggtcgactcgacggcgctgaagtccacgtcggcggacacttcagccttgtagcggtcgttgcccagtaccggttgcagaatattgtgcacacgctgggtgagcatgctttccatgcggcggctgtagtcgaactgcttgccggcctgggtcagcgcggagttctcggccaggtcggagagcaagttgcccttctggtcgaccacggtgatttgcgacttgctcaattcgggaacgctggtggccaccaggttgatgatcgccagcacctggccaggctccagggagcggccggaaaacagttcgaccaacaccgaggcacttggcttgcgttcgtcacgtacaaacaccgagcttttcggaatcgccaggtgcacgcgggcgcccttgacgttattcaagctggagatggtgcgcgccagttcgccttccagaccacgacggtagcgcgtggcttccatgaactggcttgtgcccaggccctggtccttgtcgagaatttcaaaaccgatattgctgtcggacggcgtaacgccggccgcggccaatttcatccgcgcacgggccacgtcgtcggccttgaccagcagcgcgccggagttgggctccacggtgtaggcgatgtcggcggcggccagggtttccatgatctgcttggaatccatgccggccaggctgccgtacaacgggcgataatcaggttgctgcgaccacagcaccacagcaaaaccaatcgccacgctggcagccaggccgaccatcaggcccacctgacgcaacatggtcatttcggagaggttttccaggaacgacaggccaaacagcggcggcttgccgtctgccttggcgggtacgttgtccacgactgcttctgccatgacttaaatctcgtccttaaaccggcatctgcatgatgtcttgataagcctggaccaacttgttacgcacttgggtcaaggcttgaaaggaaacgctggccttctgcgaagccaccatcacgtcggtgaggtctacgccgcttttgccgatttcgaaggcggtggccaactgactcgaggcttgctgggtatcactgactttattgattgcctgaccgagcatgtcggcaaaactgctttggcccaattccggcgctggcgcgacggatttcggttgagccatggcatccatttgcatggagcgcatatccaacatcaaccgattgaactcaataccctggctcatgaccttctctctccgacgacccgcaattttttgacactacgtagcggttactaggggtggtagcaacaagggtgccagctccgtggcgattcgtaagaaaaggcgacaaaccctgtcggcccgatgcttttttcaggtggcgaagaggtaggcttctacgtccattcccgcgtcacgcatctgcgccagcttgtagcgcaaggtgcgcgggcttatccccaagcgctcggccgcttctttgcggcggccgcgctcggcgcgcagggtgtcgatgatcatctggaattcgcggcgacgcaggtcgtcgcccaaaccgccggcggattcggcttcgaccgccaccacaggcgccggcgccaggctcggcaacggtgccgcgcccgtgcccatggccaggcagaagtcctgcggctggatcagcccgccctgctgcaaaatcagcgcgcgctggatcgcgttgtccaattcgcgcacattgccaggccatgggtagctgatcaggcaggcctgggcatcggccgacaagcgcgcctgggcgtgcttcatttttttgacgtggttgttcagcaggcgctcggccagcgggatgatgtctgccgggcgctcgcgcagtgggcgccaggccagcgggaataccgaaaggcggtagaacaagtcttcacggaagcgccccgccgccacttcacccgcgagatcacggttggtggtggcgaccacacgaatgtccagctggatcggtttacgtgcgccgacgcgctccacttcgcgctcctgcagcacccgcagcaacttggcttgcaggcccaggggcatttccgagatttcatcgagcagaatggtgccgccgtccgcctgttcgaacttgcccgcctgggcggcgatggcgccggtgaacgagcccttttcatggccgaacagcgtggcttcaagcatgttgtcagggatcgccgcgcagttgatcgcgataaacggttgtttggcgcggctggattgctggtggatataccgcgccagcacttctttaccggtgccggactcgccggagatcagcacggtggaatcgctgcgcgccacacgggccgccagttccagcaactgcgcgctggccggctcgaaggcaatcgggccttcgccgtcgctggccgggaccacgccgagcgcatgccgggcgaccagctcgatcaaggctttgggctcgaacggcttgaccaggtaatccgccgcgccttggcgcatggcgtccaccgcacgctctaccgcgccgtgggcggtcatcagcaataccggcagttgcggctggcgtgcgcgcagcaggccgagcaactggtggccatccatgccgggcatgttcacgtcgctgaccaccaggctgaaggactcttgctcaacggcctccaaggcgtcctcggccgaaccgaccgcccggtagtcatggcccgccaacagcagcgtgtcagccaatgcttcacgcagggcgcgatcgtcttcaaccaataaaaccttgatagccatagtccttttactccgcgcttgccgcgctggaaaacagcggcaaggtcatcaatgcacaggtgccacgccccaaccgggagtgcagttgcaattctccctgatgcgcacgcgccactgccttgaccacggtcaggcccaggcccgtaccgttggttttggtggtgaaaaagggttcgcccaggcgttgcaacaccaccgggtcgatgccgctgccgctgtcgctgatgcacaggcgcagggtttgcccgcggctgtacaggtgcactttgaggcgcgcgccggggccgctggcctgggtggcgttttcgatcaagttgagcaaggcgccgaccagcgtgtcgcggttgcacagcaactcgccgagatggctgtcgcactgccagcgcacgttcgcctcttgaatatgcgttgccgctgccgcctgcagcgattgcatcagcacagccggcgtgaggcggtcggtcagcggcaattcgccgcgggcaaacaccagcatgtcgcgcacctggtgctccaattcatgcaggcgctccttgaggcggccggcaaatcgctggtgggtggcggcgggcaattgctcatcagtcaaatgactggcgtagatcagtgccgccgacaacggcgtacggatctgatgcgccaaagaagcgaccatgcgccccagcgacgacaagcgttcatggcgcgccagctggtcttgcaggtgacgggtttcagtcaggtcgttgagcagcaccagttggccgggctcggcgtcgagagaacgggtggcgatggacaggcggcggccgtccttgagggaaatttcatggccatcgtcttcgcgtggcgcaaagcagcgcgtaatcacgtggcgccacagttcgccttcaagcggctcgccgagcaagtcgcgcgcggccgggttggcttcgcgcacgcgccccatctcatcgatgacgatcacgccaccgggcaacaggtcgaggaggttttgcagacggttggccaggcgctctttctcggccagctcttccatgcgctgggcactgaccaccgccagctcgcctttgagctcggaaacccgggcctccagcaagctgtaggagtcagtcagttggctcgacatctggttgaacagcgaaaaggcctgttccaggccctgccggctttgctgctctacagaggggagaagcccctggatatccggggccgaagaatgttgggcggcgtggggcatcatgctctctcgcttggctgaccgtcagttaaacggaacgttgcgagggctgtagcaatacccgtgccgaaaaaaaaccgctgactaatcagcggtttatatttcaggcgtcaatcatctgtctgctcatcgccttcccggcggctcatgccgtacttgcgcatcttctccaccagggtcgttcggcggatacgcaagcgttcggcggcgcgcgcgacaatgccgttggcatcgtccaacgcctgctggatcaggccttgctcgaggctaccgaggtagtccttcaagtccaggccttcgggcggcagcatggcggtagaaccgaagtccggcgtatggccattgatggccacgcgctcttccaggtcgctgcgcaggctgtcgaccagttgctcgtcttcgtcgtcgacgtagcggaatttctttggcagctcgaccacgccgatcacaccgtaggggtgcatgatcgccatgcgctccaccaggttggccagttcacggacgttgcccggccagccgtggcggcacagggacatgatcgcggcggagttgaagcgaatcgagccgcgcttttcgtgttccatgcgcgaaatcaattcgttcatcagcagcgggatgtcttcgacgcgctcacgcagcggggccatctcgatagggaatacgttgagacggtagtacaggtcttcgcggaagctgccgacctcgatcatgctttcgaggttcttgtgcgtggccgcgatgatgcgcacgtcgacgctctgggtcttgttgctgcccacgcgttcgaaggtgcgttcctgcagtacgcgcagcagcttgacctgcatgggcagtggcatgtcgccgatttcgtcaaggaacagggtgccgccgttggccagctcgaaacgcccggcacggctggtgatcgccccggtaaaggcgcccttctcgtggccgaacaattcgctttcaagcagctctgccgggatcgccccgcagttgaccggcacgaacggcccgtcgcggcgcttggagtgatagtgcaggttgcgcgcgaccacttccttgccggtgccggactcgccgaggatcagcacgctggcgtcggtgtcggccacttgctgcatcatctggcgcacgtgctggatcgcacggctggtgccgacgaggctgcggaacaagttgggttcgcgatgacggccgcgctcgcgggcctggtcgtacatctcacggtaaacctgggcgcggtgcagggagtcgagcaatttgctgtagctgggcggcatttcaagggtcgaaagcacgcggcggcgttggtcttccggcaggtcgacagaagaaacatcgcccattagcagtaccggaaggaactcatcccaggtcgacagtgtctttaacaagcccagtactgcaccaggagcgtttaccgtcccgatcagcacacaaatgacttcacggctcgacgacaaagagctgaccgcctgctgccaatcatggctaccgcagggtaaattttcttcaccaagaaaatttaaaatcaccgccaagtcgcggcggcggacgctatcgtcatcgatcagcagaattttggtttcacgccacatgcaatagcaacttccctagtaaaacttcctgccccagagtgagggcaatctagacgtctgtaagatttcttaccttggtagacgtctgaaatctgaaaacagcactagttaagtcaaaaatgctggcacagtcaaatatatgacgcaccgttcggactaactgagcccattcagccgaacagatggtaaacctttgacgcgttttccgctcggttgatctgcgacatctcttcgaaaatcgcctggcgctcgcccgtcgtcacttccagcaactgctgatacaccgccaataagctctccagcttttcccgcagggcatcctcgtccaccggcgcgttattgagcgcctcatcgatcaccgcacggcagcccatatccagttcgccgatagcgtcccagttacgtgccgccaaggcgtcgaccaaggcttcgcgggtttcgtcaatccgttgcagggcgtggctcatgacatcatcctcaggccgcaaggcctacagtgttgcaataccgtcccagccttccttgagcgtaatcatcaggccggctacttcgtcgatcatggtgacatcgttcttgctgttggcttccagcaggcgcgtggtcatgtaggcgtacaggttgtccaactgttgcaaggcggccggatcatcggttttttccgggttcaggccgtcacgcaagccgatcaggatgtcgatcgccttaccgagcagcaggcctttttgcgcgatatcaccacgagccatggcgcccttggcctgggccatgcgatccagcgcgccctccatcagcatctggaccagacggtgcgggctggcttcggagacctgggcatgggaattgaccttctggtattggcgaagggctctcatgggattcatgtttctacctcgtgacaggcgacagctaaattggatgggctctgactaatatgtcgactgggtcgcaaaaaactttaaccccccccaagtcggtcgaaggcggcgcccgatggcggtatttaccaccgggcggcttcatcgggatcagctgtccgaggacgacttgttcagcgcgttgagcgtggtcatgacgctggaacgctgactggtgagctgggccaccaggttgttcatcgtcgtatatttagcggtgaggctggtcttcagggcggccatgcgcgcggtcagggtgtcctgctggttttgcaggtccttgaggttgttcgacagggtcgaggagcgcgtggcgagaacaccggtgttgctcagcgcgtagctgtcggtcgcggttttcatgcgcgccagcaggccattgtcgccgttgaaaataccgccgatgtcggtagggttggtcaagatcgccgcaccgaatattttatcgtcaatactcagcttgccggtgcccgagtcagtgttcaccccaaattgcgccagggacttcaacgtgcccgtgccagccattgcgttcatttgcgcgcgcagggacgactgcagggtgcgcatggtggcatcaccggtcagcgcagacggcgtggtcgaaccatcggcgttggtggtgattttggtttcagtattgatcgccgtcatcaaggcgttataggtgtcgacaaagccctttaccgagcttttcagggtgtcgttgctgcgactgaccgtgatggtcgaggcgattcgatttggactgttctgatctgtgacgccagacggaagaggcgacagcgccgtcaacttgatactcacgccgctgattgcgtcagtcagggtattgctcttggattcctgcgcagtaccgtcaatggtgtacttcgcattcttcggctcggtcaccactgacgtccccgcttccaggccggagttaccacccagggtaatgtcggtgccgacaccggtattggttgacgtcatgaccaatcgagaacccgtggcgtcagtcaggatgttggcactcaggcctatgctgctgtattgcgcgttgatcgaatcacgtacttgttgcaacgtcgcgcccggtggaacagtgaccccataactctgcccagactgggaaatctccagtttcgtcgacgtcgtaccggcattgacgaccgtactcggcccctttgcatacgtctgggtcgcaaccttcgaggaggtcgccaactggttgaccaccagcaaatagttgcctgcggaggcaccagcccccaaggtaacggtggacacgtttgaatccgacgtcgtcgccgtcaggccaccaatactggcgtccttggccatattgtccatggccccgcggaaggcatccagcgctgcttgaatcttgccgatcgaggacagctgggcagtcgacgtttgcgtctgcttgttgatctgcgactgctttggcgcttgttcagcgttgaccaaggccgtaacgatcgactcggtattaatccccgtaaccgggccgcttaccgtgatatcacccatgactcttctcctgatcggggctggcgctttattgacggacgacgcctcaagcagctacagcaacaaaattcatgccagctcagactttggcgtcaaacaacacactgctggcgtcgtgaagactttgtgcgagtttcaatgccgtttccgaagggatttgacgaatgacctcgccactgtcggtcgcaatgaccttgaccaccacctgatgggtggagtcatcaatggaaaagtccaggttgcgctgggcagcctggacgaatttgcgaatatccgttaccgcctgttcaaggtcggaggatttcgagtcttgcttgggttcgcccgtggcaaccgtggggtctaccttggttttctgcgggtcggctgtcacaggggcaggcgcgctctgcggcgccgctgctggataagacaggttcaacttgacgctcatgtccatgtccaatctcctcatcacgcaaaagacaaaagggcacgtaaacgcgcccttccgtcagtcatctaccgatggctattactgaagcagcttcagtacagcggatggcagttggttggcctgggacaggatcgcagtggaagcctgttgcagggtttgttgcttggtcagctgagcagtttctgcagcgtagtcaacgtcctggatctgaccgcgagcggcgctggagttgtctgcaatgctctgcaggttggcaacggtgttgtcgaaacggttttgtacagcacccagaccagcacgttgggagtcgatgtcggagatcgcttgagtgatcacgtcaatcgagttctgtgcgttggcagcagtggtgatgtcggtgttgttaacggtggttttggtggagttggcagcagtaccagtagctgcgaacagacccgtcacaccggcgccgctcagcgagtagctgctggaggagttcagggaaactgcaccagtagcgatgatcgcggtgttagccagagcaacggcagtaccgaaggtgccagtaccgtcttgggtagccactttgataccggcaacagcgcctgggtcgccagcgttgaaggtcaggttctcaccggtgtcagacttgaccgacagcgcttgagtggtcgaatcgtagttaacggtgatgcccagcttggcagcgttggacttcagttggtcagccaggtcggaagtgctggtcacgccagtgaactgcacagcagtaccgccgccgactgccagggtgaagttggcgctggcaggggttgcaccagcgatggcagcggagtcaacagtgaactgggcaacggtgctggcagtagcagccaggccgcctacagcgccgttcatttgagcagcgatctgcttggcggaagcgccggcagcgatggtcaggtttttcgactggccgccaccggtaacagcgattgcgccgccggcaacaccagttgcgcttggagcaacgccttggctcttcagctgctgcgaaccaatgttgttggctgcaacgttaccgatgctcatgtcgatggtctggttggcgttggcgccgacctggaacgaagtggtaccgaaagaaccgtccagcaggttcttgccaccgaaagtagtggtggtagcgatacgggtcaattcagcggtcagagcagcgtattgagcctggttcgacttacggtcttcagcgcttggcgagccgttggcggattgcagagccagggtacgcatgctttgcaggatgttggtggactgctgcatggcgccttcagcggtctgagcaatcgagctgccgtcgttggcgtttttgatcgcaacgcccaggccgttgatctggctggtcagacggttggagatttgcaggccggccgcatcgtctttggcgctgttgatacgcaggccggaggacagacgctgcatggaagtttgcagggcgccggaagccttgttcaggttgttctgaacggtcaacgaagcaaggttagtgtttactgttaaagccatgacgaaatcctcgtgggtggtgtactgcggcttccggccctggcaaccgccgggtgtggcctagagaaccttcgtaatagttatcgtcgtgaacgcaggtctcttgaggacttttttgattttttttactagcacgtggccaccccttgtaattcaagcatttacgatagcccaaagcctcgcatttgctgggttttctggcgtcaaataaaaaacgcccaggctttttcaagcctgggcgtttttgtgtgcggcgctatcagcaggtcacggacgatagagaatcgccgaaccccacgacaaaccgacaccaaagccactgatcgcaacacgcttccagtcgccatccatcatgtgcttttccagcagcagcggaatgctcgaagacacggtattgcccgtctcgaccatgtccttgatgaatttctccaccggggcgtcttcaaagcgtcgcgccacggcgtcgacaatcgccgcactgccctggtgaatgcagaacgcatcaatctcgtcagccttaagctcagactcgttgagcagctcgtgcaaatgcgccggtactttgagcagggcgaagttgaacacctggcggccattcatgaaaaacacaccgtcgctgaccttcaggtgcggcgcgccggaaccgtcggtgccgaacttcgacttgcccagcagccacggagcgtcttcgcccatccacgtcgcggtggcggcatcgccgaacagcatggtggtgttgcggtcttccgggtcgacaatcttcgaatacgggtcagcggtgatcagcaggccgtttttcaggccggtggcttccatgaagcccttcatcgcataaatgccgtagacgtaaccggagcagcccagggaaatatcaaaggcggccacgtgggtcggcaggcccaatttgtcctgaacgatggcggccgtgtggggcaagccctcttcgtcgccgttctgggtcacgacgatgaccgcatcgatggactcgcgcgacagttgcgggttggcagcaaacaaggcattcaccgcctcgacacacaggtcggaggtttcctgcgcagcatccttgcgcggcaggaacgccgaaccgatcttgccgatgatgaaatcttcatccttggcgaatttggcgccctgggcgtagttatcgaccccgtctgccggcacgtaactggcgatgctttttatgccaatcattgtggcttcccaatactaaatagctggataacacccctcgaacgacgccgggagtgctgacaatagaggggataaccccgtaaaaatatcgctgaaagccgccgcgcaaagacccgcagtcgacttatccttttcacacgatacagtgaagatgcgctttatgactcacaggtcactcaattttgtgcgctttgtgcaaaaccctgcaacattcccggcgccagaaatgacaacggcccaccctgttgccagggtgggccgtctgctctgccgatgattacatgcggctgaacaggctcaactgagagattttcacaaacgccagctgcgaggcttgcagcatggtctgctgcagcgtcaggtcgatggcggcctggcccatgtcgacgttggccaacgacgacatggtggaggtgttggccaggcccaggctggtgttttcctggccctgaatatccagggcgttctggcgtgcaccaatcgaaccgcgtacctggtcgatttgcgcggtcgcgttgcccaggttgccgatggtggtgttgagcacatccttgagcttgttcatcgccaccgggtcgccatcggccggggtttccagcgccttgcgcaactggccgagggtgtccagggcgttcatgttcttgttgctggtggcgccgacggcaaactggtcgccggcacccggcgtgccactcacatcaaaggtcacgccggcggcagtgatcgacgtcgcgcccgtggccatggtgccggtggcaatcgacttgctgttagccgtgtacggctgggcgtacacctcgtaagcattgccgctggtgaacttgataatcgcgcccgagttgggaaaggtgctggtgtaggccgcctgatccgtgacccggccaccggtcaactgcgcggtggatgcattactcgccgtacgcgaactgctgaaggtgtccggcttgctttccagggtaaacgccttgcccgccaccaacgcatcagagtccgggcccgaggccacatccgaacccaggttcaggctgatatcgaacttgaccccgcgcaggttgatgctgtgcgcgccttccttggtggaatcaaacgtgccgttaccggtgatctcggcggtcacgtcgttaccgtccttgtcggtcacgctgtattgagtgctgctggcgaaggtcaccttatacggctggccatcggcaaagttcttggtgtacgccgtgccgttggtaaccaggcccgccgagatcgcgactttgccgtcattgactgccggcggcaaaatcgtggcctgggtgcgaccggtgttggaagaactctccaacagcgtcttgccggtgtcgcccgcagcgatggtcaggttgctcgacacttgcaggctcagcggcgtctcatcaccctggtaggtataggtgccatcgttgttgcggctgtaaggcggcgtatcggtcttggccccggagaacatgtagttgccgctcgagtccttggtgttgagcaagcccaacacctggtcctcgagcgcgccgacctgggcggcaatcgcctggcggtcatcattgctgagcttgaggttaccggcctgcaacgccagaccctgggcggtttgcagcgcggtgttgatgctgccgagcacgctttcttcgttggtcagcgagttttgcaggctggtgatgttgccgttgtattgccccagcatgtctttctgctgttgcagcatcagcaattgggcggcggccacgggatcatcggcggcggtttgcacgcgcacaccggagctcgcctggtcctgggccttcaccacaccggaatagttatcctgatacttgctggagctggtgtcgaaatactgctgtgtagagatacgcatcgttccagactcctttaaagggcgttaatcagtgtgctgaaggtttcttgcgcggccttgatgatctgcgacgacgcggtgtagtactgctggaacttgatcatgtcgcccgcctcctcgtccaggttgacctgggacacggagttgctcgccgccttgttcgccgccagcaaggcgccggtggcggtgctgtcggtattggcctgggcggccttggagccgacctgggagaccaatcggctattggcgctgaccaggctcacgcccgcattgccgtccaccgcacccaccgtcgccttggtttgcaagcccagcaactgctgggcgttgcggccatcggacgccgcgccgctgttgaacgaaaacgtggtgctgtcgtttttaaccggcgaaccggccacggtggtatcaaaactgaagcttttgccggggatcaacgcaccgctcgcatcgcgcatcggcacgttgacggtgatcttgttgccctgccccggaatgatgctgccggtgccgatcgagttgccctgggcatcggtgagcgagtaaggctgggtgccgtccgctgccgggtcgccgaacaccatcttcaccggcatcgagttctcgatcccggtgcgcagctgcgcggtcgccgcgccgccattgatatcgataggcacggtcaacaccggtggcgtgaatgtgccggtgccggtgttggtcttgctggcattgccggccaatggcccggcgaacgcgattttgttcgggtctttcagttccacaccgatgttgctggcacccgtggccgtcgggctgactttaaagctgtcaccggcagccactgtgccgccggtattcaacgccagggtgaaaccatcaatcaccggcggcggcgtggtggtggtgtcgaacgaccccatggccttgccatcggaacgcaccacgttgtactggttgccgctggtgaaggtgactttgtagtcgaaggtcgacagcttgctgctgtcggcaatcgtcacattcaagttgcctgaacctgcgctgttacccgccgccgcctggctgcgctgggcaatcgccgcggcgctgttgatgtcgctgaacagcgaggaaccgaaatcgccattcaggtccaggccctggcccaactggctgttgacgctgtcggcggtggcaatggcgatgcgacccaagtcgttgatggccggcatcagcacgtcactgcggtaacgcaacaggccgccgatgctgccgccggtcaccaccgagccgatgtccatcgacgtgtcgcccattttgagctggatggtgtactggctattgtcggtgctgctgggcacggccgaaatcgtattggcgatactgccctcgaccagcgactggccggtgccggtggtgatgctgagctggccgttcttctcggtcgcggtcacgccaatcaattcgttgagcgaacgcacggcttcattgcgcgcatccagcaggttgttcggcgcgctgttcgacgagccctgggcctgcgcaatctgactgttcagcgaagcaatcgacgcggtgatcgtgttgacctgatcgctcatggtcttcagctggccgttgatggtctctttctgctgggtcaactgggtggaaatcgcgttgaagcggttgctcagggtctgggcgctggtcaccagcaattgccgcgcggacacatcgcttggggtcgcggccgccgtttgcagcgaggcgaaaaacgcgctgagcaccgccgacatgccggtggacttgtccgacatggtcttgtcgatggctgcggcctggcccgcgtaggcggtggcgtcgctgttgagcgaggtgctgctctggtaggcggcgcccaaaaagtcgttataaatgcggcgcacatccgccagtgtggtgccgctgccgatgtacacgccgccatactggttgttggcgctggcgttctgggtggtctgctgacgcgagtatcccggggtgttgacgttggcaatgttgttactcaggaccgacagcgatccttgagcggcgttgagccccgacatcccgatattgagcaaactcatgattcagaccttataaatgagtggatgcgcccgcggcagcgtagttctggtaactgttcatcgttttggcgatctgcgaaatcttgctggcgtagtccgggtcggttgcatatccggctttttgcaactcgcgtacaaactgttccgggttgtcggctgatttcacaacttctttatagcgatcattgctttgcagcaatgtcacgaggtcgtggaagctgtcctggtaggagttataggaacggaactgcgccgtttccttgaccatcgccccatcacgaaactcgctggtgattgcacgcgcctggccgccctgccaactctgcccggccttgatgccgaacaggttgtggctgctgctgccgtcttcggcgcgcatcactgatttaccccaaccggtttccagcgcggcctgggccaccaggtacttcggatccacgccaatgcgcgcggcggccgccttggccatcggcagcatggtggcgacgaattcatcctgcgagctgaaggcttttttcgccggcgccagcggtggctgggcgatggcgcgaccgtagacctgcatgcgcccgctcggcacggcaaagctgcgcgcagtgctgttgatcacgttgtcggcggcggcgctgttacgcagcggcgcgctttgggcgacagtcgttgcgtcggtgctcggcacgatgccggccaacaggcggtcggtcagcttgctcggcagggcaatacggcgctggttcatcagctccatatcgttggcgtgcgcactcgcgccttccggcacggccacgcgatatgcccacaacgggcgctggccattggagcggcccaacgggccttcggctttagtgccggcggcgatttccgtcggcacatcaactttcttcgctggcgcctgcgcggcttccgggccttgcaacgtggccgcctgggcgtccaccggtttgttcttctgcatctggcgcatcagcacgtcggccaagccgataccgccgccttcgcgggacatcgataccgccagctgctggtcgtacatttcctggtattgcttggcagccggggtgttcatcgggttgtccttgcccagcgcctcggtggccgagcgcatggacttgagcatctcgctcaaaaacagcgactcgaactcctgcgccactttgcgcatgttgccttcgctgttcttgtcggcgccgaccttgagctggttaagccggttgaggtcggagtaagaccccgagtccgccgtgctgctgatcccgctcttgcgcatatccatggccatggcctcagatcacaatcaggtcggcttgcaaggcgccggcctgtttcagagcttcgaggatcgccatcaagtcgcctggggctgcgcccacctggttcaccgcgcggacaatctcatccagcgtggtgccggggccgaacttgaacatcggcttggcttcttgctgagcattcacacgcgaacgcggcaccaccgccgtctggccgttggacaacggcccaggctggctgacgatcgggtcttcggtgatggtcaccgtcaggctgccgtgggttaccgctgccggcgacaccttgacgttctggccgatcacgatggtgccggtacgcgaattgatgatgactttggccaccgcctggcctgggtcgacctcaaggttttccaggatcgacaggtagtcgacgcgctggcttgggtccaacggcgcggtaacgcggatcgagccgccatcgatggcctgggccacgccagggccgagcatgtcgttgatcttgtcgaccacgcgcttggcggtggtgaagtccgaccggttgaggttcaaggtcaggctgttgccctggttgaaaccgctcggcacggtgcgttcaaccgtggcgccgcccggaatgcgaccggccgatggcacgttgacggtgatcttcgaaccgtcacggccctcggcgtcgaaaccgcccaccaccaggttgccctgggcgatggcgtagacgttgccgtcgatacctttgagcggcgtcatcagcaaggtgccgccgcgcaggcttttcgagttaccgatggacgacacggtgatgtccaccacctggcccggcttggagaacgccggcaagtcggcactgatcgacacagccgcaacgtttttcagctgcacgttgcccgagcccgccggcaccttgatgccgaactgcgagagcatgttgttgaaggtctgcagggtgaacggcgtctgcgtggtctggtcacccgtaccgttgagccccaccaccaggccgtaaccgatcagttggttggagcgcacgccggaaatactcgcgatgtctttcaaccgctcggcgtgtgcccctgcgctcaaggccagcaataacgcggcagccatcagctgtttgagtttcaaagtggccacctagaaagggaacagcgggctaaggaagaaacggtcgaaccagcccggctgactcgcatcagcaaacgaacccgtacccgagtaggtaatgcgcgcatcggcaatccgtgtcgacggcacggtgttgtcggtggaaatatcatcggcgcggaccatgcccgcaatccgcaccagctcgtcgccggtgttgagggtcatccacttttcaccgcgtacggcgatgatgccgttgggcaacacatcggccacggtcacggtgatcgagccggtcaggctgttgccctgccccgccgcgctcttgccgttggtggcgcggtcgccgctgtagccggcgtccaggctcaggtcgccactgcccagcgggttgttggtgttgggcacgccgccgaacagcgaggtcaagccgatgctggtcttgctggtcttgccgatctgcgagttggcgtttttgctcgcctgggttttctcgttcagggtgatggtgatgatgtcacccacgcggaacgccttgcggtcgctgtacaggttctgttcgaaaccggcctggtagatcgagccattgttggccgccgccggcaacggcgtgcgcggcaacaccggcgcgtagtacgggtcattgggctttggcgtcggggcgacacagcccgcgagcacggcgatcccactcaatgccagaacagaaacatagcgattcatgacccttacctcacggtgttgcaggcgccgtcaatggcgccccatagacttgattacagattctgcgttacgaacgaaagcatctggtcggcggtggaaatcaccttggagttcatctcgtaggcgcgttgggtggtgatcatgttgaccatctcctcaaccgtgctcacgttggaggtttccagggtgctttgcagggtggtgccgaaaccgttcaggccaggcgtgccgatttgcggcgcgccgctggaggcggtttccaggaacaggttgttacccatggcctgcaggccggccgggttgatgaagtcggcggtttgcaggttgccgatcacttgcgaggccgggttgccagccacggtgatcgacacggtgccgtcgttgccgacggtgaaggttttggcgtccgcaggcaccacgacagccggctccagggcgaaaccgttggcggtgacgatctggccattggagtcgaggtggaaagtaccgtcacgggtgtaggacgtagtgccgtccggttgcaggatctggaagaagccacggccgttgatggccatgtccaacggctgaccggtttgctgcaggttaccggcgctgaagttcttctgggtgccaacgatctgcacaccggtacccagttgcaggcccgacggcaattcgctgtcctgggtcgactgggcgcccggctgcttcttgatctgatagagcaagtcctggaactcggcgcggtcacgtttgaagcccgtggtcgacacgtttgccaagttgttggaaatggtggtcaggttggtgtcctgggcggacaaacctgttttggcaacccatagagccggaagcatgctgttctccttcgtgcgcctgtttgttggcgccgcgctgcaaaattagtgttcgttcagtgaggccgcgatcagctcatcgacagaacgcgcgtcatggcctggtcgtcttctttagcgctgttcatcatcttgatgtgcagctcgaactgcttggaaagcgagagcaccgcagtcatttcttccaccgcgttgacgttgctcgcctgcaagaaacccgaggtcagcgtgacgttcgcatccgcctgcgccggttggccatccttggtgtggatggtgccgtcgaggcctttattcatgttcttgaggtcgggctggaccatcttgatgcggtccacttccgccatcactcgcgggccttcgcccatggcgcggatactgatggtgccgtccgagcccacttcgattttctgctggggcggcacggcaatcgggccaccgttgcccatcaccggcatgccgttgccggcgcgcaatacacccagcgcatcgacgttcatgctggcgctgcgcacataggcttcgctgccatccggggtttgcacggcgatccagccattgccgttgaccgccacatccaggtcacgacccgtctcgatcatggcgcccggcgagaagtcagtggccggccgctcggtcatggcaaacgcccgcgccggaaagctgtcaccgaacaccggcatcgaacgcgcctgctccaggtcacgctgaaagccgttggtggagatgttcgccagattgttggcatgggccttctgcgccagtgcattctggctggcgccggtcattgccacgtaaaggtacttatccacgctctatcctctttctgacggacgcttgccgcccaccgctgtactgatgaggcttaagcaatttgcgaaccaactttttaaaacaaggaaaagtccaggcggagcggggctttgcggggaggcgcggagattatgaggctggacgagagtcgaaaaaacggcggactactgccgcttacggcaagcacaggtctgatcaacgacaaagatcaactgtgggagctggcttgcctgcgatagcggtgggtcagttagcttatgtatccactgatacaccgccatcgcaggcaagccagctcccacaggggatgcgttcacttatcagccttgagaatttcgtaatcgcgcagcttgttggcgatggtggtgtgcgaaaccccaaggcgcttgccgagctgccggctgctggaatgctcggcatataaagcctccagcactgccttttcaaaccgcccgacgatctcctccagcccgccctccagggaaaaatcgccaagcggctgacgcacaccgtaatccggcaagcgaatatgctcagccttgaccgtgccgccctcgcacaacgacaccgcctgaaacagcacgttttccaactggcgcacattgcccggccagtgatagtggctgagccgatccatcgccgccggcgccagcttgggcaacgggcagccaatctgccggctggcctgatcaaggaagtgctcgaccaacggcgccaacccatccaggcattcgcgcaacggcgggatatgcagcgacagcacgttcaagcggtgataaaggtcctgacgaaactccccgcgcgcacaaagctccgacaaatccacttgggtcgcacagatcacccgtacatccaaatagacctcttcatcactgcccacccggcgaaagcagccgtcctgcaaaaagcgcagcaacttcacctgcaggcgcgcgctcatttcgcccacgccatcaagaaacaacgtaccgcccgccgtcagctccagcagccccaacttgccctcggcccgcgccccttcaaaggcgccggggccatagccaaacagctcggtctcggccatcgactccggcaggcccgcgcagttaagcgccatcaacggcgactgcccacgcgggctggccaggtggcaggcgcgcgccagcagctccttgccggtgccggtttcgccttctattaatagcggcgcatccagcggcgccatgcgccgcgcttcacgcaccaccgccgccatcaccttggaactctggaaaatgctgtcgaagccgcgcagctcctgcttgcgcacattgtagatacgctcaccgacacggtcggcgcggtgcagggtcaacaccgcgccggccatggcctcgctgtcgtcatgctcggaggattgcagcggcgcaatgtccgccaggaatacgtcgcccttgaccttgacccgcagcccattgatccgcgacttgctcgcgcgcaccaactccggcaagtcgaaatcttcggcatagcgtgacagcggaatgcctggcacctcgtccacgcgcacgccgagcaactgcgccgccgcacggttggcggcgacgatggagccgcccatgtcgatggacagcaccgggaactccagggcgccaagcagcgcattgagttccatgtgccgacgctcgctgggcatcagccctacccgcttgacgccaaacaccccggcaatcgcttcgaattgcgggcgcagcgcctggaactgcatgttcaccaggttcgggcaaaacaggtaaatagcgttgccatgttcgccgccgacctcgcccttggcgacgttgacgccgtattccaccagcaggttgagaatgtcccgcaggatgccgatgcggttctggcaatgcactttgatacgcatgaaaaggcccgaaaagtgggagggcgccgcggctttttgccgctgggcgcagatagtcgtcaagattatgtgacagcgcgtgagcttttcacagcccaatacaacgacagaccggccgatcgtaacgaaaactttacggaaatcggtaaaatttcctacagccctgaccatcagccggatggaatccgcccgccttgcgcgttatcaataggttcatcgcaggacataacaagaacgaatgcctagcaggagagccgtatgaagcagacgcaatacgtggcgcgtgagcccgatgcgcaaggttttatccactacccgccggaagaacacgcggtgtggaacaccctgatcacccgtcagctgaaagtgatcgaaggtcgcgcctgccaggaatacctggacggcatcgacaagctcggcctgccgctggatcgcattccgcaactgggcgaaatcaacaaagtgttggccgagaccaccggctggcaagtcgcccgcgttcccgcactcatccccttccagaccttcttcgaattgctcgccagcaaacagtttccagtggcgacctttattcgtacccgtgaagaattggattacctgcaagagccggatattttccacgagatcttcggccactgcccactgctgaccaacccttggtttgccgaattcacccacacctacggcaagctcggcctcgcagccaccaaggagcaacgggtgtacctggcgcgcctgtactggatgaccatcgaattcggtttggtggataccccgcaaggccggcgcatctacggtggcggcattttgtcgtcgcccaaggagagcgtgtactgcctgtcggacgagcccgagcaccaggccttcgacccgctcgaagccatgcgcacgccgtatcgcatcgacattctgcaaccgctgtatttcgtcctgcctgagcttaagcgcctgttcgacgtggcgcaggaagacatcatgggcatggtcgagcgcggtatgcagctgggtctgcacgcgccgaaattccctcccaagcccaaggctgcttgagccttacgttttgaggccaggtgagtctgttccctggccgcgcgttgctttagggtaacgcccactgacgaccgtttttcaaacactcgaattcaggacacccacatgaccaccttgaaccaagcccactgcgaagcctgccgcgccgacgccccacaagtcagcgacgaagagttgccggtactgatcaagcagattcccgactggaacatcgaagtacgcgacggcgtgatgcagctggaaaaggttttcctgttcaagaacttcaaattcgccctggcctttaccaacgccatgggtgaaatctccgaagccgaaggccaccacccaggcctgctgaccgagtggggcaaagtcaccgtgacttggtggagccactcgatcaagggcctgcaccgcaacgacttcatcatggccgcgcgcaccgacgaagtggccaaggacgccgagggccgcaagtaatgcatttcgatgccattggccgcgtgcccggcgacccgatcctcgggctgatggacctgtatgcccaggacaccaacccgaacaaattcgacctcggcgtgggcgtctataaggacgaccagggcctgacaccgattccccacgcagtgaagctggccgaacagcgcctggtcgatacccagcccaccaagacctacatcggcggccacggcaatgcagcgttcggtgcgttgatcagcgaactggtgctgggcagcggttcagcactgattcgcgagcgacgtaccggcgccacccaaaccccgggcggcaccggcgcactgcgcctgagtgccgactttattgcgcaacacttgcccggccgtggcgtgtggctgagcaacccgacctggccgatccacgaaaccctcttcgccaaggccgggctcaaggtcagccattacccgtacgtgggggctgataaccgcctggatgtagccgcgatgctggcgacactcgccaccgtgcccgagggcgacgtggtgttgctgcacgcctgctgccacaacccgaccggttttgacctggcccaggacgactggcgccaggtgctgcagatcgtgcgcgagcgccacttgctgccgctgattgacttcgcctaccagggctttggcgacggcctggaacaggatgcctgggcggtacggttgtttgccgccgagctgccggaagtgctgatcaccagttcctgctcgaagaacttcggcctgtacagcgaccgtgtcggcgcgttgatcgtgtgcgcggcggatgccgagaagctcacggatgtacgcagccagctggccaatacggcgcgtaatttgtggtcaacaccgccggatcatggcgcggctgtagtggcgaccatcctcggcgatgccgaactcaaacaggtatggagcgacgaagtcgaagccatgcgctcgcggattgcacagctgcgcgcaggcttggtggaggcactggcgccccacgggctggctgaacgttttgcgcatatcggtgcgcagcgcgggatgttttcctataccggcttgagtgccgaacaggtcaagcaactgcgcgagaagcacagcgtgtatatggtcagttcgggccgggccaacgttgccgggtttgacgcgacgcgcctgaccctgctggcccaagccatcgccgacgtctgcaactgaagaaaccgaagcaaactgtgggagctggcttgcctgcgatagcggtgtatcagttagccttttttggctgacacaccgccatcgcaggcaagccagctcccacatttgaactgagtaaggcctttagcccgcaaccatctcggcttttagctgtgcctctttggcctgcgcgtccgccaaccgatacaactcgatatgcccatcccagtgctcgatcaacgccgtgcacgactccacccaatccccgcagttgaggtaatccacctcgcccaccttgcgaatttccgcgtggtgaatatgcccgcagaccacgccatgcaactcgcgcttggtcacttcgtgggcgatggcctcttcgaaatcgctgataaagctcaccgccgtcttcaccttgtgcttcaggtacgccgacagcgaccagtagccgtagccatagcgcgcccgccagtgattgagccagcgatttagcgtgagggtgaactcgtaggccgagtcgccaaggaacgccagccaacggtggtagcgggtgatcacatcaaactgatcgccgtgaatcaccagcaaatggcggccatcggcggtgacgtgcacggcttcgtccaccagctggatattgcccaggatcagcttggaatagcgccgtagaaactcgtcgtggttgccggtgacgtagatcacctcggtgccgcgcttggccatggtcagcaggcggcggattacgttggtatgggcctggggccaatacatgccgccgcgcattttccaaccgtcgataatgtcgccgaccaggtacaccttgtcggcgtggtagcccttgaggaactgcgacaaatgttcggcctggcaatcccgcgtgcccaagtgcacgtcggaaatccacagggtgcgaacccgttgtttacggctgggtttggcaaactcggcacgggtcatgggcttccctcaacggtgttttcgcgagcttgcgccccggcggttaatagcccatgacagctgtgcgtcagtctgatgacagcgcctggcgcccgtgaagcgttgtagactggtgccttgcgccaccaggagaccgcgatgagaccgaccctcacgctgcgccactacctcgaagagcccctcgcccacagccatgaccacgcacagctggtgttcggcctgtcggggcatttggacctggaagtcgatggccgtggcagccaggtgcatgaaagcagcgtgatggtgctgcccttctgcgcccatcacgcctgcggcagtcgcgatggcagccgctgtctggtgctggatgtgcccaccgaccattgggtggtgcaatcgctgggcgagcatgccgatgccagccgccgcctgctcgaccaatcggcacacctgaccctggattcgcgccaaaaccagctggtgcaatggctcgcgcacagcccggtggatgacccactgatcgtgcagcaaggcgcggtgctgttactggccagcctcaatcacccgctggcccaaccggtgccgggaaaacgcctgccgtatgcggcgttcaatgcgcatatcgaacgccacgttaagcacccgttgcaggtcgcagacctggcgcgcatcgccgacctgtcggtggcgcgcttgcatgcgcgctttatcgccgagtgcgggcagacgccgatggactacatccgcagccgtcgcctgcacatggccctgggcatgttgcgcgaaacgccgctgcccatcggcgagatcgctgagcgcgtcggctacagctcgcaaagtgcgtttgccgccgccatgttgcgcgagtttggcgcctcccctggcgccttgcgacgctcatcatagtctggcgataaaaaacgcgagccgcgcgacagacgcccacgccttcaaccctctagactgcgatgctgtcacccccgttggttcaaggatcgcaatgactccccgctcagccctcggcgccctgcatatcggcgcattgatgtttggcctcaccggcgtattcggcaagctcgcggcggcctcgccggccattatcgtgttcggccgcgccgcctttgccgtggtcgccctcgccgtctttgcgcgattcgccagcaacaccgcctggaaaaaactcgagatgcgcgactggcgccgcctgctggtcagcggcgtgctgctggcggcgcattgggtgaccttttttattgccgtcaaaaccgcaggggttgcggtcgccacgctcgggttcaccgcgttcccggcgtttaccgtgatccttgaagggctgatcttccgcgagcgcattcgcgccaatgaagtgctgttggtggtgctggtcagcgtcggtttgattctggtgacgccagacttcaacctcgccagcgccgccacaggcggcctgctgtggggcatcgcctcgggcctgctgttctcgctgctgtcgctgaacaaccgcgccagctccgggcgcattccagcggtacaagcggcgctgtgccagaacgtggtggtcgcggcctgcctgctgccggtggcggcaccggggctggcggatgtgcgcgcaatcgactggttgtggatcgggctgcttggggtgttctgtaccggcctggcccacagcctgtttgtcgccagcctcgcggtgatcaaggcgcgcaccgcctcggtggtatttgccatggagccggtctacggcatcaccgctgcctggctgctgtttgccgaaaccccgaccttgcgcatgctgctgggcggcgcgctgatcattgtcgccatcgtgctgtccgggctgatgggcagcaccagccaagccaaggcacctgcggcggcggcctgatgctcaggcgttgcggtcgttgtggcccagatcccgctgcgggtcgatctggtcgcgcacacgctgtttaagcaccttggcctccgggaagccgccatcggccttgcgctcccagatttgcacgccgtcgcaggtgatgcgaaacgcgccgccggtggccggttccagggccacacgcgccaaatcatcggcgaacgtactcaacagttcctgggccagccaggccgcacgcagcagccactgacattgagtgcaataggtgatgacgatctcgggtttggtcgcagacataatttgagaggttcctggcataacgagctcggcggatcgagtggctataataccggcctttatcgcccagcctcgagattgatgatgcgccgcctgctgtcctgcctgtttctgtgcctgctccccctgctcgccgacgccgtcgaaagcccacgcccgaaaatcggcctggtgctgtccggcggcgctgcccgtggcctggcgcatattggtgtgctcaaagccctggaggagcaaggcattcaaatcgatgccatcgccggcaccagcatgggcgcagtgattggcgggctgtacgcctcgggctacaagatcgatgaactggaaaagctcgcgctgagtattgattggcaacaggcgctgtccgacgcgccaccccgcgaagacgtgccgtttcgacgcaagcaggatgaccgcgatttcctggtcaagcagaagctcagctttcgcgacgatggcagcctcggcctgccgctgggggtgatccagggccagaacctggccctgctgctggagagcatgttcgcccatagcagcaacacgcgtaatttcgacaagctgccgattcccttccgcgctgtggccaccgacatcaccacgggcgaaaaagtggtgttcgccaagggccacttgccccaggtgatccgcgccagcatgtcgatcccggcggtgttcgccccggtggaaatcgacggccgactgctggtggacggcggcatgaccgacaacatcccgctggatgtggcgcgcgaaatgggggtcgacatcgccatcgtggtcgacatcggcaccccgctgcgctcgcgcaaacagctggctaccgtggtggacgtgctcaaccagtcgatcacgctgatgacccggcgcaactccgaggaacagctcaaggccctgcaccccaaggatgtgctgatccaaccgccgctggcggcctacggcgtcacggacttcggccgcgccaaggacatgatcgacgccggctaccgcgccacccgcgccctcgatgtgcgcttggcgcatctgcgccctgccgagccaatagatccgcaactggtagcagcgcgcacgcccggcgaacgcaccccggtgatcaccgcgatcaaggtggagaacgactcgaaggtcagcgatgacgtgatccgctactacatccgccagaacctgggcgagccgctgaacctgggccgcctgcaaaccgacatgggcacgctgtacggcctggattacttcgagcaggtgcaataccgcgtagtcaaaaagggccaggacaacaccctggtgatcagcgcacgcggcaaacgcagcggcaccgactatttgcgcctgggcctgaacctgtcggatgacatgcgcggcgacagtgccttcaacctcggcgccagctaccgcatgaatggcatcaaccgcctcggcgccgaatggctgacgcgcgtgcagattggcgaccgccaagagctgtacagcgagttctaccagccactggatgttggctcacgctacttcgtcgcgccctatatcagtgcccaggcgcagaacgttgaggtcattctggacaacgaccctatctctgaataccgcgtggaacgctacggcttcggcttgaatgtggggcgccagatcggcaacagtggcgagatccgcttcggtgttggcgaggcctggggcaaggcggacgtgcgcattggcgaccacaatgagccaagtcagagcttcaacgaagggttctatgagctgaaatactcgttcgactccctcgataacgtgtacttcccgcataccggcgaagacatcggcctggcctttcgcgagttcgaacccggcctgggctcggaccagcgctaccggcagtgggagttcaagctggacaaggccatgagccatggcccggacacactcatactgggcggtcgctacgggcgcacgctggataaatccgacgtggtgatctccagcttcctgctcggtggggcgcggcaattgtcgggctttcgcgaagatgcgatatcggggcagaacatcgcgttgatgcgtgcggtgtactaccgccgcctgacgccgcgttcatacctgccgctggatttcccgctgtacctcggggcctccgtggaacgcggccgggcatggaacaacgacaatcagttcgacagtggctacatcaacgccgcgagtgtgttcctgggctttgatacgccgctggggccgctgaatttcagctatgggttcaatgatgataatcagcaggcggtgtatctgaacctgggccagacgttctagacagtaaaaaaccactgtgtgaactgggttgtgggggagctggcttgtgtgggagctggcttgcctgcgatggcggtgcatcagtcactgaataagctgactgaactaccgctatcgcaggcaagccagctcccacattttttatctctgtgtatctgagatcaggacttttccagattcgccagaatatgcccatgcacccgcatgcacacgcgcaaatcttcttcgtccacgcccacaaacagctcatggcgcaacgccgtggcgatggtttcaatttgttcgatcaaagggcgggcggtgtcgcagagcaaaatgcgcttggcgcggcggtcttcgagcacggcctggcgttgcaccaggccctggccttcgaggctgtcgagcaggcgtgccagggtcggcccttctaccccgacactttgtgccagctcacgttgggtcggcgcctcggtgaaacgggccaggtgcagcagcaccagccaacgcgcctgggacaaacccagccccgccaagcggcggtccagttcggcgcgccaacctcgggacatttgcgccaactgcatgccaaagcggtgttgatcggttaaaggcataaaaaactcatggtttagactgaaaataaagtgtggctaattattagtcagctaagcatgagccatgccaggaggcaagcgtcgctatgtactgattcgttacattggcgcaattggcacactaaatttcgaattcagactgcaacgcggcccttacgcagtacaaaacaccttctggaacgcgcccggtaaacagcggcgcgatttccgtaaccggtggcagttcgccttctccgtcgaggaacgcgtcctggatttcaccgagcagatcttccggcaaatcaagggcctgctccaacgacagctgctgcttgccgatggattcagccagcaaggtatagacgtttttttccgaacattgcagctggccggcaatctgcagcggggtcatgccggcacgcgccaggctgatcagttcgtggcgaatatcggcgacttccttcggcgcttcggcctggccgccaagcacttcgaggaaggcctgcccataacgctccagcttgcgtgcgccgacaccgctgacccggcccatttcggccagggtggtgggttgttcgcgcagcatctccagcaacgtggagtcggggaagatgacgtaaggcggcacgctgtgctcctgggccaacttgcgccgcagggtgcgcaaggcttcccactgttcgcgctcttcgccacgtaccaactggctggccgggctggtgctgctgcttttggcggtggtttgcggcttgaggtcgcggcgcagctccaggctcacttcgcccttgagcaatggccggcaactgtcgttcaagcgcaggccgccatagccttcaatgtcaatgtccacgaggttgcgtgccaccatctgccggaacagcgagcgccactcaccctcggcgcgggccttgccgacgccatagaccgagagtttttcgtggccgaaactgcgcactttttcgttgtccttgcccagcaacacatccaccaggtggccgacgccgtagcgctgccccgtgcggtagatggtcgacaacgcctggcgcgccggttcggtggcgtcccaggtctgcacgccgtcgacgcagttgtcgcagtggccgcacggctcgggcatgtcttcgtcgaaatacgccagcagggtttgacggcggcagcgggtctcttcacacagcgacagcatggcgtcgagcttgtgttgctccaggcgcttgtggcgctcgtcgccctcggagttctgcagcatctgcttgagcatcaccacgtcttgcaggccgtagaccatccaggcatccgccggcaggccatcacggccggcgcgaccggtttcctggtagtacgcctcaagagacttgggcaggtccatgtgcgccacaaaacgcacgttggatttgtcgatgcccatgccgaatgcgatggtcgccaccatgatcaggccttcctcgttgaggaagcgtttctggtgcgcagagcgcgtttcattgggcaggcccgcgtggtacggcagcgccgggtagccttgctcgcagaggaacgcggccacttcgtcgaccttcttgcgtgacaggcaatagacgatgcccgcatcactgcgccgctcggacagaaacgccagcaactgcttgcgtggctgctccttgggcacgatgcggtagaaaatattcggccggtcgaagctcgacagaaaacgctcggcgttctgcaaatgcaggcgctcgacgatttcttcgcgggtgcgtttgtcggcggtggccgtcagggcgatacgcgggacgtcgggaaataattccgccaactggcccagttgcaaatattcgcgacggaaatcgtggccccactgcgatacgcagtgggcctcgtcgatggcaaacagggcaatttccaggctctgcaagaatgccagcatgcgcggctgcaccaggcgttcaggcgccaggtagagcatcttgacttcgccgcgcttgattcgcgcggccaggtcgcgctgctgctcggcgctgagggtggagttcaacgacgcggcggcgacgccgagttcttcgagggtggcgacctgatcgtccatcaacgcgatcagcggcgacaccaccacggccaagccattacgcaacagcgccggcacctggaagcacaacgacttgccgccgccggtaggcatcaataccagggcatcaccgccactggccacgcgctcaatgatcgcaccctggcggccacgaaagctgtcgtagccgaagatgtccttgaggacgcgttgagcctgctcgagcatgtaaaactccaaaatggtgccgaaatccctctgtacaggctggccgaaaaacccgggcttcacgggaaataatccgtaagcgaagttttcgcgggttggcgctttgcctgcaggggcatcacaaaacgcggcagtatacccgagcgtcggcccgcaaagggcgccactgacgaatagcgagtgctatctaaaacccggcaaatatgccttgcagctggccggggcgctcaagaaagcctagaattgcgcatcgtttattcccaaggtatcccgtaatgtccttcgctgagcaactaacccgcctgcaagccttcctcgacgccgatgagctgcatgacgaggcgctggactacgtggccgcccacggctacctgaccgccctgtcgatctcgtccgacatcgtgccggaccgtgagtggatcgacgccttgtttgccgaagaaccgcactacgctgacgccgaccagcgcgaagaaatcgaatccaccctgctggccctcaaggcccacatcggtcgccaactcgcttccgacgaggaattcgagctgccatgcgagctggacctgggcgaagacccggatgactccgacctgcgcggctggtgcatcgggttcatggaaggtgtgttcctgcgcgaagccgcctggtttgaaaccgccgaggaagaagtcagcgaaatgctgctgccgatcatggtcggttcgggcctgttcgacgaccagccggagttctccgacatcgcctccgacgccaacctgatggacgacatgatcgtacagattccggaagccctgaccgcgctgtacctgctgtgcaacgcgcctgacgaaaaaccggcgatcctcaagccacgtcaccactgagtcgtttgcccgtgacacccatgggcactcgctcgtcgctcctgcgttacgcactgctggccatcggctggctgagcgtggcgctgggcgtgatcggcatcttcctgccggtgctgcccaccaccccctttctgctactcgccgccgcctgcttcgcgcgaagctccccgcgtttctaccactggctggtggaacacccgcgcctgggcccgtggatcaaagattacctggatggcaatggcatcccgctcaagggtaaggtctatgccatcggcctgatgtggctgagcattggcgtctcctgctacctggtgccgctgccgtgggcgcgcgggtttatgctgaccagtgcggtgctcgtaacgatctatatcctgcgccagaagaccctgccgccgcgataaccgtgggcgctggcatgtgtgggagccgggcttgcccgcgatagcatcgccacggtgcaactgtcacaccgcggtgcctgaatcgcaggcaagccagcgcccacaaaagccagtagccccacacgccagatcctgcacacgaccttggtcgacactgactaaccccaagcatcatgcgagactgtgccaccgggcccggaatgcctgggtgttcttatgctcggagttaccatgacgctgtccagcgggctgatcgccgccgttgccctggcctatatggccattatgtttgccatcgccttttacggggaccgccgccacgcgccgctgccgccacgggtacgtgcgtgggtgtatagcctgtcgctggccgtttactgcaccagctggaccttcttcggcgctgtaggccaggccgccgaacaactgtgggcctttttaccgatttacctcggaccggtactgttgctggtgttggcaccttgggtgctgcagaagatgattctgatcagcaagcaggaaaacatcacctccatcgccgactttatcgccgcgcgctacggcaaatcccagtccctggcggtggtggtggcgttgatctgcctggtcggcgtgctgccctacatcgccctgcaactcaaaggcatcgtgctgggcgtgaacctgttgatcggctccggccccgacaccaccggcacccgcgcccaggacaccgcgcttatcgtgtcgctggtgctcgcgctgttcaccattgtgtttggcacacgcaacctcgacgccactgaacaccaccgtggcatggtgctggcgattgcgtttgaatcgctggtcaagctgttcgcctttctcgccgtcggtgcgttcgtgacctacggtttgtacgacggtttcggtgacttgttcagccaggcgatgctggcgccgcgccttgaggaatactggaaagaaaccatcaactggccgtcgatggtggtgcaaaccggcgtggcgatgatggcgattatctgcctgccccggcagttccatgtgaccgtggtggagaacatcgacccgcaggatttgcgcctggccaagtgggtgttcccggcctacttgatcctcgcggcactgtttgtgattcctatcgccctcggcggcaaaatgctcttgcccggctcggtattgccggattcctacgtgatcagcctgcccatggccgaagcgcatcccgccctcgcggtgctggcgtttatcggcggcgcatcggcggcgactggcatggtgattgtcgccagcattgccttgtcgaccatggtctccaacgacatgttgctgccgtggctgctgcggcgctccagcgccgagcggccattcgaagtgttccgccactggatgctgtcggtgcgccgggtcagcatcgtgatcatcctgttgctggcctatgtgagttaccggctgctcggttccaccgcgagcctggcaaccatcggccagattgcgtttgcggcggtcacccagctggccccggcgatgctcggcgcgctgtactggaagcaggctaaccggcgcggggtatttgccgggttggcggcaggcacattcttgtggttctacaccttggtcctaccagttacggcgaaaagcctgggttggtcgctgagccttttccctggtctgacgtggctgcattcgcacccgtttagcttcgccgtcacctcgctgacccttggcacggtgttctcgctggcgggtaacttcacgctgttcgtgtgggtctcgatgctgtcgcgcacacgggtgtccgagcactggcaggccggacgctttattggccaggaaatcagccaacgcgccagcgcgcgctcgatgttgtcggtacagatcagcgacctgctcagcctggcggcgcgttttgtcggcgaagaacgtgcccagcagagctttatccgctttgcctatcgccaaggcaaaggcttcaaccctaaccagaatgccgataacgactggatcgcccacaccgaacgcctgctcgccggcgtgctcggcgcttcttcgacgcgtgccgtggtaaaagcggcgattgaagggcgggaaatgcagctggaggacgtcgtacgcatcgccgacgaagcctctgaagtgctgcagttcaaccgcgcgttgctgcaaggcgcaattgaaaacatcacccagggcatcagcgtggtcgaccagtcgctgaagctggtggcctggaaccggcgttacctggagctgttcaactaccccgacggcttgatcagcgtgggccgaccgattgccgacatcattcgctacaacgccgagcgcgggctgtgcgggccgggtgaggccgaagtgcacgtggcgcgacgcctgcattggatgcgtcagggccgcgcgcacacctccgaacgtctgtttccaaatggccgcgtgatcgagctgatcggcaacccgatgcccggtggcgggtttgtcatgagcttcacggatatcaccgccttccgtgaagccgagcaagcgctgactgaggccaacgagggcctggaacaacgggtcaccgagcgcacccatgaactgtcgcaactgaatgtggcgctcaccgacgccaaaggcgtggccgagtccgccagccagtcgaagacgcgctttctggctgcggtaagccatgacctgatgcaaccgctgaacgcggcgcgcctgttctcagccgccctctcccaccagaacgacggcctgtccagcgaagcccggcagttggtgcagcacctggacagctcgctgcgctccgctgaagacctgatcagcgacctgttggatatctcgcgcctggaaaacggcaagatcaacccgcagcgccaaccctttgtgctcaacgaactgttcgacaccctgggcgccgaattcaaggccctggcccacgagcaagggctgcgtttccgcctgcgtggtagccgcttgcgggtagacagtgacatcaagttgctgcggcgcatcctgcagaattttctcaccaacgccttccgctatgccgacggcccagtgctgcttggcgtacgccggcgcaagggtgaactgtgcctggaagtctgggaccgtggcccgggcatcccgctggataaacagcaggtgatcttcgaagagttcaagcgcctcgacagccaccagacccgcgccgaaaaaggcctgggcctgggcctggcgatcgccgacggcttgtgccgggtactcggccaccgcctgagcgtgcgttcgtggccgggcaaaggcagcgtgttcagcgtgcgcgtgcctttggcgcgtaaccaggccagcccgaaagccaaaccgacgccagacaacgggctggcgctgagcggggcgcaggtgctgtgcgtggacaatgaagaaagcatcctgatcggcatgcgcagcctgctcacccgctggggttgcgaggtgtggacagccaccgaccaggcgcaatgcgcggcactgctggccgagggcgtgcgcccgcaattggcgctggtggattaccacctggaccatggcgagaccggcaccgagttgatgggctggctgcgcgcgcaattagcggagccgattcccggcgtggtgatcagcgccgacgggcgcccggagatggtggctgaggtgcatgcggcagggttggattatttggccaagccggtgaagccggcggcattgcgggcgttgctcagtcggcatttgccactgtaattcggctgaactcaatgccttgtgggagctggcctgcctgcgatagcggtggatcagtcaccatcgctatcgcaggcaagccagctcccacatcgacggcgtgctactcgggcaagtgcgccacaccatccgaatcggtcatcgcccgctcaagcaaatccgccggcaggcttttactcgcacgcgcgcccagcaaccttaactgctcggtacgactgaccaggtttccgcgcccatccgtcagcttgtttcgcgccgcgctgtaagccttatccaactgttgcaggcggttgcccacctcatccaggtcctggataaacagcacaaacttgtcatagagccagccggcacgctcggcaatttcccgcgcgttctggctctggcgttcctgcttccacaggctgtcgatcacccgcagggtggccagcaaggtcgtggggctgacgatgacgatatggcggtcgaacgcctcttggaacaaattcggctcggcctgcaacgcggcggaaaacgcggcctctatcggcacgaacaacaacacaaaatccagactgtgcaggccttccaggcgcttgtaatccttaccggccaaacctttgacatgattacgcaaggacagcacgtgctgcttcagggcagcctggccaatcacgtcatcgtctgccgccacgtactgctgataggccgtcaggctgaccttggagtcgactactacctgtttgtcgccgggcaacatgatcaacacgtccggctggaagcgctcgccgtccgggcctttgaggctgacttgagtctggtactcgcggcccttctccagcccggcatgttccagtacacgttcaaggatcaattcgccccagttgccctgggttttctggcccttgagcgcgcgggtgaggttggtggcttcgtccgacagacgcaggttcagttgctgcaggcgttcaagctccttggccagagagaaacgctcgcgcgcttcattctggtagctttcttccacgcgcttttcgaaggactggatacgctccttgagcgggtcgagcaactggccgaggcgttcctgactggtttcggcaaagcgctgttcacgttcgtcgaaaatcttcccggccagctcggcgaattgcgcgcgcagctcgtcccgcgagccttgcaggtcggcaaggcgttgttgatggctgtcctgttgctcgcgcagttcagcgcgcagtgcggctgatagcgcgtcgagacggcgcagctcggtgtccttggcgctgcggtcgaggttccaggcatgggcggcgtcgcgggcgttatcgcggtcgatctgcagcagttcgacttcacggcgcacggccgccaagtcagcttgtttggcggcgttggcctggctgaggtcgctgatttcgtcgcggctggcgtcgagttgcgcggccagcccttcctgggccagctgcgcggtggccaggcgctcttcaagcagctcccagccggtcatgcgcgcgctcagccgccgttgaatctgccagcacacggccaataaaggcactgcagcgccagcgacgcccaaggcaatactggtccagtcaaaagccatcgccatttctgccatcaccgaaaaagaccaaggttaaccaagcacagggctggaggacagctcagtcttcgacctggcccagttcgcgctgggcgcggcggtcgccggcgcgcgcggccaggcgcagcaggtcatggccgatgcgacggtcgcgggcactgccgcactcacggcacattaactggcccaggcggctctgcgcagccaccacaccttcacgggcgggctgcttgagcaagcgcccggcgaagtgcttgacgttggtgctgtgccccaggcgcgggctgtcgagcagccacaaggcgactttcaaggaaaaacgcttgggtgcggtaacagtctgaggggtgtcggtaacagaaggtgatactgagcgaaacttcataaagcactgcgggacagaacggaaggcgcgccactctactctttttttcctacaggtaaagctgaaaaatccgtgcacgcccgttctagagcaagcgcttgggacaatccacagaagctgtggataactcagtggacaacccgcctttaactcgcgcaaaggcccatggaacgggggccgcagtcaaactgacgattttttcaccaataaaaaaaagcgatatttttcattgacttaaattttcattacaggcaaatggcgctgcttccgggccgggatcagagtggttacacacctcgcaactaatgtgcacaagtacccatccgctggttatatcgccgagattttttgcgcctacacgtctgaaaaatgttaccggaggtccaggccggggacttttcaaatctgccccggctcgccacactgccttacctccacgcaacctcgaaaggctcgatgaaaggaatcctcgtattcgccgtgttgctgctggctatctgcgcaacctcgctgggtatcaatgcagcactgccctcgcccgacggtgcattgtttgccatcgccatcctgctgtcggcagcgtttaccgccgtgagcctgtgcatcgaactgggtgaaggtcggatcaatgacatgcgcgacgtgatcaatgtgatcgagaccggccgctccttgcgcctgaccctggcggcttacgggctgggttgctcactggcggcggcggttaccgtgctggtctatcgcgggttgttgggcgcctgatcaaggttttttggatagcacacttcccttccgtgtttcaatccgttactatccgcggcgttagtaccaagctgaaagtcaattctggtcgaacaactcccctgaacaacacgggatcgaccacctcgatggtttccaggtattccttgtgacgacactgcctttgaacaagcaaagggtgtcgcgaagtttaaatactctgaccgaaccaacctgcaaattgatcaggatcttcaccccgggcccagaacctttgcccttgtcgtgttgcctgccctcctaagtacctacctgccagcccaagcgcgcctaacttattagcgcttcaaactggctgctttgttccagtcgggttcttcgtttgatcaatggtgatcaacgttactggaacgttttaacgttgcacggttcttatccgtgtcatttgtaggaacaccaataatatgtccactcaaatccacactcaggatgccattcgcaccctcaccaacgcttttgcaccaatgaactgcctgatcatggccgctcgcaaaggctgcttcagcttcaccctggtcaacgaacacggcatcgcgcgtcacagcgaacgcctgtaccccgatcaatactccagcgcagagccgctgcaggccgtgatcgagcgtacccgtcaggcattgattgcctgatcgacccgagtcgctgaaacacaaaaaaccctgcttaaaacgcagggttttttattgcctggcgtttaagcacaggcgatgacttaagttccaaacgatataaacgttataactaaatgaagaagatgttttaaaaacaatcctttacatcgtaaatatgacactacacttcaactcaagcggcgtgatccgcttacgacgagcctgagatccgattcaccgctgccaagccccctctcaggcatcgtcgaccactttcatggatcgaggcttgtatgggtatcgccgccagtgaattgtgtcgttatgtgatcaggccgacgttgatatacctcggccgccataacccgacagccgaagccctgctgctgggcattgccgccagccagtcggaactcggctcggccctgcatgaccggcgcggccacggcctgtacagcatcaccgaacctcgtcaccgcgccctgtgggacgactacctcgcaccagaccccgaacgtgccagcctggtacgtggcctggccagccagcatgcattcctcagcgcgccgcagctggaactcaccgtgaacctgcgttacgccaccgccatcgcctggctactggtagaacaacaccgccctgccctgccgccggcgggtgatgtgctggccatggcacgtatctggaaagaaatatttcaccctcaaggtcggctccgggacttcacccaagcgtggcaaacctgtgtttcacccatgaatcaggtcacttgttgatcaggcgttttgcaagattcggcaaaaaaccgcgaatctggtcggattgtcctacaaaaccgctctatctcctacattacggcctatagcgctaacttaaatttattgttactttccgcagcggtgatcaccacggagttctaataatgaaaaaagtaatgctcaagaccacacttagcctcgccgttaccatggcctcctcccaactgtttgcaagcggcttcgccttgaacgaacaagacgttgcaggcatgggtacgggtttcgcaggccgttcttcttctgccgaaaacgccagcactgtctacggtaaccctgccggtatggctcgcctcgaaggccagcaaatcaccggcggtgttgcagcgattgatgcctcgaccaacatcaaggatgtcagcggccgctccagcggttcgaacaaaggcgatatggtgcctttcaccgctgtgcctttcggcttctacaccaataaactcaacgagcaatgggctgtcggtttcggcgtttatgctccgtttggcttggtgaccgactacgaaaatggcttccggggcaaagcctttggcagtaagagcgaagtgaaagtcatcactttccagccgactgtcagctatgccttcaatgaccgggtttccatcggttttggtccgaccatcaaccgtatcgcaggtacgcttgagtccgacatcaacttgccagtcccgggcacaggctccaacaacatcaagatcaagggtgatgacaccgccgtcggcttcaacgccggcctgttggttcaagccactgacaccacccgcgtgggcctgacctaccactcgaaggtgaaatacaagctcgaaggccacaccgaagtgagcaagggcaccaacgtaccggccgggctgtttaataatggccgctacgacgcttccttgaaaatcgacacccctgaatcctgggacctgtccgttactcaagacatgagcgacgcctggaaactctacgcaggtgccacctggactcgttggagccgcctgaaagacatcaccgtcaacaacgaaggtgtatcggccgcagccggtagcggtcttttggctccgcaaattgtcggcaccatcaaagaagatcagaactggcacgatacctgggcatatgccctcgggacgtcgtaccgcgtcaccaagcaagtggtgttgcgtaccggcctgaccttcgaccagtcgccgaccaacaacaccgatcgttcgccacgtatccctaccggtgaccggactatcttcagtctcggcctgggctacgacgtaatgccgaacatgaccgttgacctggcttactcctacctcaaggaagaaccggtcaaggttgcgcgcgccaacgcactgggccagtcctacaacgccaagtacgaaaacagcgccaacggttttggcctgggcgtaacgtacaagttctgatctgacgctgcataaaaaagccccgctctcctgcaaaggaggcggggctttttagtcggcgctaatcagggtttggacgcaatcgcctgttccaccgccttgatcaggtccggactgtccggtttggtcaggctggagaaatcagcaatcaccttgccctggcggtcgaccacgtacttgtagaaattccacttcggcgcgctgctctgttgcgccagagccttgaacagatgcaccgcatccggccccttgaccttctgcggttcggtcatcgtaaaggtcacgccgtaattcacgtaacagaccttggcagtctcttcaccggtcttggcttcctgcttgaagtcatcggacggcacgccgatcacttccagcccctggcccttgtagcgctgatacaaggcttcaaggcctttgaactgcggcgcaaagccacaaaagctggcggtattgacgatcaccagcggcttgccggcaaagcgctgacacaaatcgatggattccttggcccgcaacttgggcaattggccctccagcaacggcgggcaattggcggccatggccacacttccaacagccatcaggacgggtacagcaagccagcgcgtcagcatctcgaaggtccttgagtcagtacagacacagaacttaacagatcgacatccccagttgcatcaacgccagcccgccgtgctgccagccccaccaggccagcaataacaaaaccacgcccgccgaaagggccagccagcgcaccgtcacactcatgccgcctccatttgcgtctgcaaacgcgccaccggccgctcgcgcaccggccaattcagcgcggcagcgagcaggctcagcaggatagccacctgccagatcaaatcgtagttaccggttcgatcatagaccaccccacccaaccagccgccgaggaacgaaccgagctggtggaacaggaacacaataccgccgagcatcgacaggttgcgcacgccaaacaaagtcgcgacggtgccgttggtcagcggcacggtggacagccacaaaaagcccatggccatgccaaacaggtaggccgtgacttcggtcaccggcgcccacaggaacagcacaatcaccaccgcgcgcagcaggtacaagccggtgagcaaacgcggcttggacatacgccccccgagccatcccgccgtgtacgtaccgaacacgttaaacaggccgatcaacgccagcacggtagtgcccaccgtggccggcagatgctggtcgaccagatacgccggcaggtgcacaccgataaacaccacctggaacccacagacgaaaaagccgaacgccagcaaccagaacccggaatgggagcaagcctctttcagcgcttcacgcagcgtttgctggccgaccattacgggcagcggtttgtccttgagcatcgccaccagcggcaggatcagcgccaccatcaaacccagtgcgagcaaggcggccgaccagcccaaccagctgatcaggcccaaggtgcccggcaccatggcgaattggccaaaagaaccggcggcgctggcgatgcccatggccatactgcgtttttccggtggcacggcgcggccgacaacaccgagaatcaccgaaaacgacgtgcccgacaggccgatgccaatcagcaaacctgcgctaagcgacaacgaccacgccgagtcggacatgcccatcaacaccaggcccacggcgtaaagtaccccgccgacaaataccgccttggtggcgccgaaacggtcggccagggcgccggtaaacggctgtgccaggccccagatcaggttttgcagggcgatggcgaaggcaaaggtctcacggccccagccgaactccatgctcatcggcgccaggaacaggccgaagccatgccgcacgcccaacgacaacgccaggatcagcgcactccccacaagaacccagccactggtgcgccacatcgaggtcatttcttattctccgctcgcgggtatatacccgcttgtagtcgaacaaacccgctttcaggcgagttcgtccagcaaggccaacagggtttcgcgcttttcggcgcctaaccggtcaattaatttctgctgcgccgcttcccacgccggcaaggcggcagccaggcgtgcttcgccggccgccgtcaacagcaccaggcgattacgcaggtcatcaccctcaaccagctgcaccaggccttcgccttccagcacccgcaggttgcgccctaacgtgctgcgatccaggcccatggcttcggccaggctggaaatgctcggttggtcgaggcgctgcaggttacacagcaaagaatactgggcgacgttgatcccgaagccgtcgagagcgccgtcgtaatgcctgctgacgccacgggcggcacgtcgcaggttggtgcataaacattgggaggcaagcatggaacgtgtatatacccgcgattatggaaatgcaagaaagtgttacagcgccaagccgatcaacaccgcgacttccagcagctccagcagggctcctgcagtgtcgccagtggtcccgccaagccgattgaccatcaactgacgcagcccgataaagcacagggcggcgagcaaaacggcaaccccgccactgaaaccgccgatcaggatgcaggccaggccgctgaggatcagcacctgttggccgacaaccctcggcagatgatccgccagcgcctgacccaatccgcctgtacgcacatagcgtgtggtgaggaacagcgccagcatcgaagcccgcccgatcagcggcgccagaatcagcgccgcgccgttgtgctgctcgatcaaggccaccagcgcggtgaacttgagcagcaacaccaagcccagggtgaccacggcaatcggcccgctgcgcgggtctttcatgatggtcagcgtgcgctcgcggtcgccaaagccgccgagccaggcatcggcgctgtccgccaggccgtccaggtgcaggccgccactgagcagcacccaggccgtcagcaacagcgcggcgtgcagcaacaacggcgcgcccatcagcgctgtattcagcgcccataacagcaacccgaacaacaaccccaccagcggataaaacagcagcgaacgccccaacgcctgaggctgcggcatgcccggcagacgaatcggcaggctgctgagaaattgcagggcgatccagaacggcaacatcgtcagattccttcctttaacacgccgtcggctgtcacctgcaggctgaacagcccgccgtggccgacttcgacattcagcagttgcgcccgaggcaagccacgcgcctgcgccagcagcaggcgcatcacgccaccgtggctgatcaacaacacacgctcaccggcaaaggcctgatgcagacgtgagacggcgccgagaacacgctcggaaaagtcgctgacgcgctcgccctcaggcggcgtaaaagcgtacggatcggcccagaaccggcccagcccttcagcgtcggtctccatcagcgctgcggcgctctgcccttcccaggcgccgaagtgcagctcctgcagatccttttccaagctcaccggcagattcagccgcgcccccagctcatgggcaaacagcgcgcaacgttgcagcggcgaactgatcaaccggtcccacggcccctgttccagcacggcgtcgcgcatctgcgcccagcccctggccgtcaacgcatcgtcgaggctgccgcgcaggccaccgcccagctcggtttcgccgtggcgcagcaggtccaggtgcaagatcatgccgggcgatctgccacggccgcttcggcgaacgtcgccatctgcccgtgcagcgcacacgccaggcgcaacatcggcacggccagcgccgcgccgctgccttcacccaggcgcagacccagctccagcaacggttgtgcgtcgaggctttgcagcacatgacgatggcctggctcagcgccacgatgaccaaacaccagccactcacggcatgccgggttcaggcgcgtggcgaccaaggcggcgaccgtgcagataaacccgtccaccagcaccacgatgccttcctgggcgcaggccagatacgcccccaccagcgcggcaatttcaaaaccgccgaggttgaacagcgtgtgcagcgcgtcaccccgttgcccggcatgcagcgccagcgcgcgttcgatgacggccaccttgtggctgacgccctgggcattcaaaccggtgcccgggccggtcaggtcactcactgcgcaatcgagcaacgcgcacgccaaggcgctggcggcggtggtgttgccgatgcccatctcgccaccgataaacagctgggcgccgtcatccagtgcacggcgtgcgctgtcgcgaccggcttgcagggccaaacgcccttgggcctcagtcatcgccgggccgttgacgaagttggccgtgcccgcgccgatgttcaggtgacgcacaccgggcagatccagcgacggcgtgaccgtgccaaggtcgacgacttccagctgcgcatccagctgccgcgccaacacactgatggccgcgccaccgctgacaaagttgtgcagcatctgcccggtcacttcctgaggaaacgccgatacgccttctgcgaccacgccgtggtcaccggcgaaaatggcgatccatacgcgatccaccagcggcttgacctggccttgcagcccggccagctgcaccgccacggcctccaactggccgagggagccggccggtttggtcagttgctgctggcgagccagtgcttgtgcatgtgccgaagcatccacggctttacaggggttgagccaccaggtgtcagtcataacgcagtacctttcaaagtcaggggcaggccggcgacggtcaggacaacgcgctgacaccgctcggccaaggcttgatgcagccaaccggcttcatccacatagcggcgagtcaattcgcccagcggcacgacacccagaccggtctcgttgctgacaaacatgatttcccctggcaacgaagccagggtttccagcagttgatcacgctcaaacaccaggcgcgccgggtcttcgagcatcagcagattggtcagccacagcgtcaggcaatccaccagcaggcagcgctcggcggatgcgttttcttgcaacgcgcgcgcgagctcgaccggctcttccaccagcccccagtgctcgggacgccgctgacgatgcagcgcgacgcgctcattcatctcgccatccagcggttggctggtggcgatgtagatgacatccaggccgctctcactggcgagcctttcggcgaggcggctcttgccggaacgagcaccgccgaggatcagttgatacatgggaaggcacctttgtcggccggccaagaatttgaggcgaacactgtccagtgtgggagcgggcttgctcgcgaatgcggtgagtcagttacaaatgagctgactgaaccaccgccttcgcgagcaagcccgctcccacattcagggcgtggtgcatcagatgaatagtggttggctggcaggccgccatcgcaggcaagccagctcccacagaaaggcagattggcttttgatctggctgtagatttggctgtagatctggcttttgattttgatctcaagcgccccgttaaaccacgctggccgaacgcaggcttgaatccgtgggtaacccggcaggacgccgggttagccgcgctgggccaaggatggcccatcgcggcggcccacgaattcaagccttcgttcgggcacaccgagcctaagcgaggtgccgagtggtggggcgaggactttttgcttactttttggtccttcaaaaagtgagccgctgtaagagcggaaccataagtggccgttacccaaggaatggatatgtacaccgacgcaccgccctcgcgagcaagtcgaatcgtcgcaccgccgctcccacattcagggcgtggtgtatcagttgaatagtggttggctggcaggccgccatcgcaggcaagccagctcccacagaaaggcagactggcttttgatctggctgtagatttggctgtagatttggctatagatctggctgtagatctggcttttgattttgatctcaggcgccccgttaaaccacgctggccgaacgcaggcttgaatccgtgggtaacccggcaggacgccgggttagccgcgctgggccaaggatggcccatcgcggcggcccacggattcaagccggagtgcgggcacaccgagcctgggcgaggtgccgagtggtggggcgaggactttttgcttactttttggtccctcaaaaagtgagccgctgtaagagcggaaccataagtggccgttacccaaggaatggatatgtacaccgccccaccgccttcacaggcaagccagctcccacagcgaaatcggatatacaccgtcagatcccgcacagcttaagcagcaaatcggtgtccagatggttctccacaaggtccgccaaccgctcgatatcgcgctcgcgcagggcgtggtaatccacctcttgcacctcctgcaacccagcccagcgcagcaacgaactgcacgccgccggcgtttcaaacaggccatgcagatacgtgccaagaatctggccgtcttcactctgggcgccgtcactgcggccgtcatcgagcagcacggcggcgcgcgacaaggcattgccggaggtcacacccgcatggatttcatagccgctgacctccgcatcctccagcaacaagcgcccacgcacattgcgcaactgcttctcttgttccagcgtcgtactgaacgccagcaagcccaagccttcactcgacccgacaggcccttccagcccaagcgggtcgtgcacgtgttcaccgagcatctgcaacccgccgcaaatccccagcaccttgccgccatagcgcaagtgccgggccactgccgtgtcccagccgttggcgcgcaggtaggtcaaatcactgcgtacacttttcgagcccggcagaatgatcaggtcagcggccggaatcgcctggcccggcccgacaaactgcaggtcgacctgcggatgcaggcgcagcgggtcgaaatccgtgtggttgctgatgcgcggcaacaccggcaccactactttgagcacttgcgcggccttgtcgatctggcgctggtcgatgccgtcttcggcctccaggtgcaggtccatcacatagggcaacacgccgaccaccggtttgccggtgcgcgcttccagccaatcgagccctggctgcagcaaggcgatatcgccgcgaaaccggttgatgatgaaccccttgacccgcgcctgctccgtcggcgacagcaattcgagggtgccgaccagatgggcaaacacacccccacgattgatatcggcgatcagcagcaccgggcaatccaccgcctcggcgaagcccatattggcgatgtcgttggcgcgcaggttgatctccgccggggagcctgcgccttccaccatcaccaccgggtaggccgcgctcaaccgcgcatgggaggccagcaccgcttgcatcgcgatggctttgtagtcgtgataggccacggcgttcatgctggtgacggcacggccgtggatgatcacctgggaaccggtgtcactgttgggcttgagcagcaccgggttcatgtcggtgtgcggcgccaggttggcggcctgggcctgtaccgcctgggcgcggccgatctcgccgccttcagcggtgacggcgctgttgagcgccatgttctgcggtttgaatggcactacggcgatgccctggcgcaccagccagcggcacaacgcagtcaccagggtgcttttgcccgcgtcggaggtggtgccttgcaccatcagcgtactcatgcagcgtccttgtaggcggccagggcttgatcgaggcgcaaccaatccgcctccgtgtcgggcaggccaaaacgcaggctgctgtcgtgaataaacaggcgcagcaggatgccgcgctgggccatgaattcgtgcatgcgctcggcgtgcggcgtgatcagccactggaacaacgcgcagccaccgtgaggctgaaaaccgtggcgctcaagcaggtcaaacaagcgctggccggcttcgatacaacgctctcgctgttgcacatgcccggccgtatcgcgcaggcacacttggccaagcacccgcgtcggcccactaaccgcccaagggccgagctgttcggcgagcaacttgagcagcttgcgttccgccagcacaaagcccaggcgcacgccggccaggccaaagaatttgccgaacgagcgcaacacaatcaggccgacttgatgggcctggctggccaggctcaactgcggcgtcacgtccataaacgcttcgtccaccaccagccagccgccgcgctgggccagccgcgcgtgccagtccagcaggcgttgcgggctcaggctcaaaccagtggggttgtttggattgaccaccaccagcacgtcgaggccgtcgagaaagaagtcgacttcctgctcctgcacttcgcgcaccacgtaaccggcgcggcgccacgcttcggcgtgttcggcataacacggcgacaacacgccgaccttgccggagcggcgcaggcgcggcagcaattgaattgccgcctgggaacccgccaccggcaatacgtgggcggcgccgtagtactcgctggcggccctttccaggccgtcatcggtttccggcaaccgcgcccaggcccgcagcgggatctcggggatcggccacggccagggcgcgaggccactggacaaatcgagccagtctgcctcggcgatcccgtactgaatcacggccttacgcagccgaccaccgtgctcaagcataaaattgcgcccccgcgcagaggatcaacagccacaaccatacgccgcgctgcaccagttgccagccacggtcgatggcgtcggcgtcagccgccgggccttcgcccagttgcgggcgctgatgcagctcaccgtgataaatcgccgcgccgcccagttcaacgcccaatgcgcccgcacccgccgccatgaccggcccggcgttggggctgtcccatgtcgggccctgggtgcgccagcatttaagcgccaggcgagttttgccgagtacggcgtaggtcaatgccaccaggcgtgcaggaatgtagttgagtacatcgtcgatttttgccgccgcccagccaaagcgctcgaagcgttcgttgcgatagccccacatggcgtcgagggtgttgctcaggcgataaagcaccacgcccggcacaccggcgacgacaaaccagaagattgcggcaaatacggcgtcgctgccgttctccaataccgactcggtcgccgcgcgcgcaacttcggtgcgatccagctcgctggtctggcggctgaccagataactcacgcgcttgcgtgcctcatccagatcatcgccacgcagggcttgggcgaccggaatcacatgctcgccgagactgcgcatgcccaacgccaggtagagcgccagaatctccagcacccagccgatatacggcgcccatgacagtgcagtcgccagcagggtcagcggcaccaccgcgataaaccacgcggtcacgccgtggctgcgccaaccgcgcccgcctgtgttgaaccgttgctcgatgcgcccggcaaaattgccaaacgccaccagcggatgccagcgcctgggttcacccagcagcgcatccagcgccaccgcagcgacacacagcaaggccacactcattgactcactccccacacattctcatacaacatgtcactcagcggccgtggttcggtccagccttcgagttgcaacatcggtgccgagtagaactccgccaccggcccgaggcataacaccgccaggggttttgcgccgggcggcaagcccagcaggtcggccagggcttgcggttcgaacagcgaaacccagcccatcccaacgccctcgacgcgggcggccagccacagattctggatcgcacacgacagcgacgccatgtccatttccggcaaggtgcggcggccaaaaatatggcgctcgcgatcatccatcagcgcggcgaccagcacctcggcgcagtcgtggatgccttcgaccttgagcttcatgaactcatcggagcgctcgcccagggcttcggcggtgcgtacgcgctcttcttccaccaattgctggatttggccgcgcaggcctcggtcgctgatgcggatgaatcgccagggctgcatcaatccgacgctgggcgcctggtgcgcggcctggagcaggcgttgcagcaactcgggggccacgctgccgccggtgaagtggcgcatgtcgcggcgttcggcgatggcgcggtagacggccaggcgttcggcttcggggaaggcgttgtctgtcatggcttgttggcgggcaagtcgaatcgtcgcaccgccgctcccacattttgatttgcgaacgctgtcgatgtgggagcgggcttgcccgcgatagcggtctcagggctaggcgcaaacaatgcagccaccgccgccggattggaggggaagtaaaagtgcacgtaggaagccgtcatccgcccctgccggtataccgcctcggcaccgcgcccgccattcgggctcaggccacgggcaatcggctgccactcggtgctggtcagggaatgatgataggtgtgcccgcgcagcacgccttccggcaactcgacactttgcagtgccagcgccgcgagtttcttttgcatcaccgcatcgccctgcagcaggccgaccagctcggcgcgggtgccgtcgacatcggtgagcgagtccagcaggtagagcatgccgccacattcggcgagcagcggtttaccggcggcgtggtgcgcgcggatagcgttgagcatcgaggtattttccgacagcgcctggtgatgcagttccgggtaacctccgggcaaatagaggctgtcggcgtcaggcaattcttgatcatggatcggcgagaagaagtgcaactcggcgcccatcgcccgcagcaggtcgaggctggcgccataggtgaaggcgaaggcttcgtcgcgggccacggcaatgcgtacaccggcgagcaaaggctcggcttcgatcacttccggcgcggcgaaggttaccggcggcggcaaggcgacttcgcaactactgcccaaggcttgggcggcggcgtccaggcgcacgtcgaggtcattcagttcgctggcttgcaccaggccgaggtggcggctgggcagctcgattccggtttcgcgcgacagcgcgccgtaccagcgcaggccttcggtgaggctgccttccagcagttgcgcatgccgcaaggtgccgacgcggttggccagcacgccggcgaacggcaggtccggctggtaacgcgccaggcccaacgccagcgcaccaaaggtctgggccatggcggtgccgtcgatgacgccgagtaccggcacgccgaagtgccgcgccaggtcggcgctggagggcgtgccgtcgaacaggcccatcacgccctcgatcaggatcaggtcggcctcgcccgccgcgtcccagagcaaacgccgactttcctgctcgccgaccatccacatgtccaactgatacaccggcgcaccgctggcgcgctcgtgaatcatcgggtcgaggaagtccggcccgcatttgaacacgcgcaccttgcgccccaggttgcggtgcagacgcgccaacgcggcggtgacggtggttttgccctggccggacgccggtgcggcgatcagtacggccgggcaatgacggggctgattcaaagttcgacgcccttctgtgccttgataccggcctggaatgcgtgcttgagcatgcccatttcggtgacggtgtcgcccatttcgatcagctcgggcttggcgccacggccggtgaccaccacgtgctgcatcggcgggcgggcttgcaggtcgctgagtacttggtcgaggtcgaggtagccgtgcttgagggcgatgttcaactcatccaggaccaccaggccgatggaggggtcttgcagcattgcgcgggacaccgcccaggcggcttcggcggcggcgatgtcgcgctggcggtcctgggtttcccaggtaaagccttcgcccatcacatggaagcgcacttgctcgggaaagcggcggaagaacaactcctcgccggtgctgttacgccccttgatgaactgcaccacgccgcattgcatgccgtggcccatggcgcgggcaagcatgccaaacgccgagctgcttttgcctttgccgttgccggtcaataccagcagcaagccgcattcgttcggggagttggcgatgcgctcgtcgatcacggcttttttgcgcagcatgcgcgccaggtggcgttcgtcgcggtcgggggaatcagtcatggcagctctccgttggggctggacaaaaacggcgggcaggaaaaagaaaaaacagacagccaagcatcgcccaccgtgatgctgttggatgatccaggccggtctccggactcatgagtggcgttctcttcatagaaaacaggccgacggcgcgccttcccatatcacgtggatacagtggcaaaaggcaccgtcttgactcatttaccgttgcgggggcagcgccggaatcgcggcagcactgtgtacaagtgcgctcgctcaccggcttccctgtttcactctgtcggcacacggccacagagcacctggaacaagccgcgaaggttagtgggttgggggtggagcgtcaattaaagctggccttgcacttgaaccatccgactgccgcgcttctctacccttacaggtattaaggagaaaaccatgcacaaaaccagactcgccttactgatcatgctcgccggcaccctcgccgcctgtggcgaaagctcaaccttgcaggtctccgacggcaccgggccttcgcccaagctgccggagccgaacaaaaccctgatccccactgtgaacatcgccccggcaattggctggcccgacggcgcgaagccgacagcggcctccggcacgcaagtggcggcgtttgctgaaggcctggaccacccgcgctggctgtatgtattgcccaacggcgatgtgctggtggcggaaaccaacgcgccgcccaagccggatgattccaagggcattcgtggctgggtcatggagaaagtcatgggccgcgccggcgccgccgtgccgagcccgaaccgtatcaccctgctgcgtgatgccgatcacgatggtgtagccgaaacccgcaccgtgttcctggagaacctcaactcgccgttcggcatgacgctggtcggcaatgacctgtatgtggcggattcggacaagctgttgcgcttcccttatcagccgggcgaaaccgcgatcaaggccgccggcaccacggtggtcgacttgccgggcggcagcctcaaccaccactggaccaaaaacgtggtggccagcaaggacggcagcaagttgtatgtgagcgtcggttccaacagcaacgtcggcgagaacggcctggcggcggaagaaggccgcgcggcaatctgggaagtcgaccgcgccaccggcaagcaccgcattttcgcctcaggcctgcgcaacccgaacggcatggcctgggaaccgcagagtggcaagctgtggacggcggtgaatgaacgcgacgagatcggcagcgacctggtgccggactacatcacctcggtcaaggatggggccttctatggctggccgttcagttactacgggcagcacgtggatgtacgcgtttctccgcaaaacccggacctggtcgccaaggccatcgctccggactacgcggtggggccgcacacggcatcgctgggcctgacctttgccgaaggcagcaaactcccggcgcagttcagcaatggcgcatttatcggccagcacggttcgtggaaccgtaagccgcacagtggctacaaggtgatcttcgtgccgttcgagggtggccagcctaaaggccagccggtggatgtgctgaccgggttcctcgacaaagacgagaaagccatgggccggccagtgggcgtggtgattgatcagcagggggatttgctggtggccgatgatgtggggaacaaagtgtggcgggtgtcggccgccaaatagccgatctcgaatacaccacaaaccaatgtgggagctggcttttgtgggagctggcttgcctgcgatagcatcacctcggtccaatttgaagacccaggtgcctgcatcgcgggcaagcccggctcccacaaaggcccggctcccacagtttgatttctgctgagccttaagggttgcgcgccaagttcgctggcagcacgcgcttggcgctcaagtaggcattctgccaataggccttggacagcgtatccagcttcactgtgccgccggtttgcggcgcatgcacaaagcggccttcgccgacgtagatccctgcgtggctgacctgtgaaccgccgccggtggcgaagaacagcaagtcaccggtctgcaggttcgcttcgctgacgtcctgggcacgcatcacgatcagttcacgggtggtgcgcggcaaagaaatgcccgccgcgtcacggtagacaaaaccaattaagccgctgcagtcaaagcccgagtccggcgtgttgccgccccatcgataaggcgtgccgaccaggcccagcgcacggaagagcacgtcttcggccgcaggcgagaaactttgggtggaataattgaacaccggcttcggcttgacggcgacgggcgcaggcggcggtggacggcttgcgcaggcgctgaggagcgcggcgcaaacaagcagaatgaggcgggctgaggtcgacatgggcagaacaatcctggtctggatgcggctttcgctgccgaacgctgaaaaccagaacgcgcaagcaaagctcgcgcgaacggattacaacaatgtccagggattctagcgcttacacgtcaaacttcaagtatcactttaactttacttgctagcggtaaccgtagtcggggccatggcgagtgcgcgcttggcttcgatgaaggttttgctccagtagctgtcgcccaggttgtcgactcgaacaccaccactgcggcggctgctggagtggataaactggttatcgcccaagtagataccggcgtggcttacgcgaccacggccagccgtactaaagaaaagcagatcaccgggcttgaggttgttgcgtgcgaccaacggtgcatccacgttgatcatttcgcgggtcgagcgaggcaaattcatgccggcttcttcgcgaaacaggtagccgatgaaaccgctgcagtcgaaaccggcttcagaggtgccgccaaaacggtaacgggtaccgatcagagacatgccgcgttcgaggatgctgtcggccagaactggaagctggtaaggcttgctgccggcgaagtcggccagttccttctcggttgccacctcttcctcataaacagtggaagactgtgatgcaacgaattttgcctgggactgttgtgctggtttttgctgctcagccacgttttgagtgtgggtggcgcaaccaaacaacagggtaacgagtgcgagaggcacgaggggtgcgaagcgatttagcatgggcacgaccgtggctgatgtgtaaagaagtcgagactatgcccactatcacatcgatttgcaaattcaatcgtgatctatgtgacttcttgtttgaacgatgacatctaagcccttaacacccaatacccgccttttgcgtggccaaaccggcccaaacgcaggttttctggcgcctgaaatttgccgaaagccacgcaatacagggcctggctaccagccgagggtttccttgagaaacgggatggtcagcttgcgctgagcctgcaacgaggcctgatcgagctgttcgagcaagtcgaacaacgcgctcatgctgcgggtgccacgggtgagaataaagtgcccgacttcatcggtgaggtgcaggccgcgacgggacgcacgcagttgcagggcgcgcagtttgtcttcatccgacaaagggcgcatctggaagatcagcgccagggtcaggcgcgacttgaggtcggccagcttcaccggcaactcacgcggcgaggtagacgcggctatcagcaagcgtcggccgctgtcgcgcagacggttgaacaggtgaaacagcgcctcttcccaatcggccttgccggcaattgcctgcagatcgtccaggcagaccagctcgtattgctcaaggtggtcgaagatgccgatgccacggtccatcaattcagccagcggcaggtaaaccgccggttcacccatctgttcgaagcgcaggcacgcggcctgcaacaggtgggtgcgccccacgccgtgcttgccccacagatagatcaggctttcagtccacccggcgtcggcttcgcagagccgctcgacatagccgagtgcagcggcattggcgcctgggtagtaattgataaaggtggcgtcgtcacgcagacgcacacccaagggcagctgaatcggtttcatgctgactgaacggctccaaacgaaccgttagtggcctctgtgtaaagtttgcaaagtttatacccgtgacgccgggcgcacaatgcagcagaccacaagcaaaatcaaaggtttgcgttaacttgggtcgatttgcgcaaattgtttgacgccccgcctgcagaaacaacaaacccggcctaggccgggtttgtgacgaagcggttacaggtcggggtcttcaaccccggtatacacatcggaatccttgtacagatcgtgcacatggcgcaccagcaccatgatcaccgccgctaccggcagggccagcaggatgcccgtaaaaccaaacagctcgccgcctgccaggatcgcaaagattaccgcgaccgggtgcagaccaattcggtcccccaccagcaacggcgtcagcaccatgccttccagggcctggccgaccataaacaccgcaacaatccccagcatcgggtacagatcgccaccgaactgaaacagcccggcgaccagtgcagcaccaatcccgatcacgaagcccatgtacggcacgattgcggccagaccggcgatcaaaccgatcaacaggcccagttccaggccgatcgccatcaggccggccgcgtagatgatccccagcgccaacatcaccagcaactgaccgcgaacaaacgcgccgagcacctcatggcactcttccgccagggagacgatgcgctcctcactgttacgcggcagcaggctacggatcttggccatcatgatgtcccagtcacgcagcaggtagaacgccaccaccgggatcaacaccagattggtcaaccagccgatcagcgccaggctggaggccgtggcctggctgagcaccacaccgacgatatcggtggtctgccccatatgttcactgatggccgccttgaccttgtcgaacttccagaaaccgtccgccagccccaacttggcctgggcccacggcattgccgtgtgctgcaaccagtcaagcatctgcggcgccaactcatacaagcgaaacagctgcttggcgagcatcggcaccaacaccaacaccagcgcggtgatgatcaacgtgaacagcgcaaacaccgccaccacgcccagggtgcgcgacaggccggctttctccaggcgatccaccacgggatcgaacagataggccagcagtaacgcaaccaggaacggcgtcaggatcgaatgcagcaagaacacaaaaacgcacagcaggacgatcccgccaagccacacccaacgacgcgtatccgccataaaccactccattatttgcttctatctatataggaagaacttttaccaacgaaaacgcagttgcgcctgcggctcaggtgcagcggccggctgcgtaccgtccaccactggctgctggacaggtgcttcacctgccggcacttcctgcaacttggccaggctcaactgggtacgcaactgatcggcactgccgttgacgcgatacacaatgcggctgccatccacaagctgcggctggccaccaaagggttcgagcaaatgacccaacgcggcatagcgctccagggtcatgccctgcacttcaagcaattgctcgctgctcacgcccggcttgacggcgaagcgtggcgccagcttttggctgacggccagcaacacggcatcggccacggcggcggtgtcagcaccttgggcagtgccctgctcacttttgtcgcccaaccacaggcgccatttggcctgccattgattcccttcctgacgcgcgtgtacggcgagcaacgcatcggcgccgtagcgctcggaggccgcgcgcagtggcgtggcgtcggcgctttcgagattcggtgcagtggcgacaacttgttcatccaggtcgcccaacggcaagcgcaatggcaggccacggtgttgcgccgcgcgacgcagggcaccggcaattgcctgaccatcaccgaccaggctgctgccttcggttgagtcattcagccaccagccgagaatcgacggccgattgctgccccagatcgacaggcccgcgtcacgcagggcgcgatcggtgctgaccgggtcgaagtccacttgcaggctttccggcgggccggcgtcgtagccgtactggctgatgatttgctgcgggtctttgcgaatcgccgccaaacccgggccgtcggcggccttggcgtcaccggtcaggcgaatcaccagggtttgcaccgcgcgctgggtggcctggtcgcgctcctggggcgactggctgctgaccggttcaagcacttgatagaggccattgagggtttcggcatgactcgccaggctgaccaacgacaagcagcctacaaagaagaatttacacagacgcatgaaagattcccgaacgacaaatttagcggctggaacagaccgcgcgaactcggcttggcatggctgtgaccacagcggccggtaaaacattcacgggtctcggcaagtttttgtactgtcataacgatagcgggttaaaggctataccttaatacgcaccaaggcagagccgattagcatttttttaaccggcttttttaacctatatagccctgcccgtcggcccgaggatggccgctgcctctcaagcctgataaaatcgcgcgccttcgcagaccgtcaacggctgggccttttatccaaagcgcctgccgctcggtcgttacccagaaatcccccctaaaggcctggatcatgagcaagcaaccctccctgagctacaaggacgccggtgtagacatcgacgccggtgaagcattggtcgaacgcatcaagagcgtcgccaagcgcactgcgcgccccgaagtcatgggcggcctgggcggttttggcgccctctgcgaaatcccggccggctacaaacagcctgtgctggtttccggcaccgacggcgtgggcaccaagctgcgcctggccttgaacctgaacaagcacgacagcatcggcatcgacctggttgccatgtgcgtcaatgacctggtggtgtgcggtgccgagccgctgttcttcctcgactactacgccaccggcaagctcaacgtcgagaccgcgacccaagtcgtgaccggcattggcgccggctgcgaactgtcgggttgctccctggtcggcggcgaaaccgctgaaatgccaggcatgtacgaaggcgaagactacgacctggccggtttctgcgtcggtgttgtcgaaaaatccgaaatcatcgacggctccaaagtcgccgccggtgacgccctgctcgccctgccatcgtccggcccgcactccaacggttactcgctgatccgcaagatcatcgaagtgtccggcgccgacatcgagaacacccaactcgacggcaagccgctgaccgacctgctgatggccccgacgcgtatctacgtcaagccactgctcaagctgatcaaggacaccggcgccgtcaaagccatggcccacatcactggcggcggcctgctggacaacatcccgcgcgtgctgcctaaaggcgcccaggcgattgtcgacgtggccagctggactcgccctgccgtattcgattggctgcaagagaaaggcaacgtcaacgagaccgaaatgcaccgcgtgctgaactgcggcgtgggcatggtcatctgcgtggcgcaagagcacgttgaaaccgcgctgaacgtactgcgtgaagccggcgagcagccttgggtcatcggccagatcgccaccgctccagaaggcgcggctcaggttgaactgaagaacctcaaggctcactgatgcctcagacctgtgatgtcgtggtgctgctctccggcaccggcagtaacttgcaggccctgatcgacagcacgcgtaccggcgacagcccggtgcgcatcgctgcggtgatctccaaccgcagcgacgcctacggcctgcaacgcgccagggacgcaggtatcgatacccgctccctggatcacaaggctttcgagggccgcgaggccttcgatagcgccttgatcgaactgatcgacgccttcaaccccaaactcgtggtccttgccggtttcatgcgcattctcagcgctgatttcgttcggcattaccaagggcgcctgctcaatatccacccttccctgctgccgaaatacaaagggttacatacgcaccaacgcgccctcgaggccggcgacacagagcacggctgcagcgtgcacttcgtcaccgaggaactcgatggcgggcctctggtcgtacaggcagtagttccggtagagtctgcggactcagcgcagacgcttgcgcaacgggttcatacccaggaacacaggatttacccgctggctgttcgctggtttgccgaggggcgattgattcttggtgaacagggtgcattattggacggtcagttactcgcggccagcggccacttgattcgaacctaggagattttatgcgtcgcgccttgctcttcgcttttgcgctgttcgccttgccagccgtgcaagcagcagaccttcaccctttctccgccagctacaccgccgactggaaacagttgcccatgagtggttcggccgagcgcagcctgaccaagaatgacaatggctcctggaccctgaatttcaaggcttccatgatgatcgccagcctcaccgaaaccagcgtgatcagtttcgacaaggacgccctgcaaccgaaaagctacaccttcgagcgcggcggcctgggcaaggcaaagaagatcaacctcgatttcgaccatgcggccaacaaggtcaccggcttcgaaaacaaggacccggtcaacgttacccttgaaagcggcatgctcgacaagtcgacttaccagctcgccctgcagcgcgacgtcgccgccggcaagaaaagcatgagctaccgtgtagtcgaaggcaccgacgtcgacacctacgatttccgcgtgatcggcccggaaaaggtccagaccaaagccggcaccattgacgcgatcaaggttgagcgcgtgcgcgacccgtcgcagagcaagcgcatcacccagatgtggttcgccaaggactggggcggcatcctggttgccctgcgccaggtagaaaccgacggcaaggaatacaacatcatgctgctggacggcaccgttgacggcaaggctgtcaaaggtagctgacaggctgatgagcacaaaaagagcctcgctgaatgcggggctttttttcgcctgctgtttttgcgttgaacgtccgaccgctatcgcaggcaagccagctcccaccctggcatgcatttcaactgtgggagctggcttgcctgcgatgacgtcagcccggacaaaccaagctcccaccctggcatgcatttcaactgtgggagctggcttgcctgcgatgacgtcagcccagacaactcatggctttaaaccccacccaaacatgaaacttttgtcataaaactcagcaccctgcgacgcaatgtcgcggtttacggggcctgcagcaacgttgcgttttgcgcaatgaattgttgcgtgcaaaatcagtttacttagcaagctaacaaaacatataaaagaggcctgcgacgacttgccgcagatcaaccagagattggagcaagcagatgactgtaaaagtaactgaacgcgacgatgcacacatgtctcacgaagcactgggccatgggattcacatctgggatgtccatcaacaagaccaactggtcggcatgtttcacgacgagagcgaagcccacaattataaaaacgagctcgagtctctagagatgaaacgccaggcacaaagctcctgaaactctgatatcgcctagacgcccggccccacgcagccgggccgcctatacaaagaacccgcccattgagcgggttttttgcgtttcatcagcagcgattgtccgctgcaattgcgcactcgtatcaaagaagacacatcttacaaagcacccgtacgcgtactacaagccattcccagccccctgaactagcctgttccagacgcttccatgccgtgtctgcgcgcctgattgatcactttattcgtacgtaagtcatgccttccaccctgcccgaataatcgtttgtgtaaaaagcgtaacaacaaatagacatttggtaatagttctcgataccattcgcgcgcttttcacccaggaccacggataaggaattcgacttgatgcatggacacaacagcacgccggaaaaatcactgcttgagcgctggggtgaagctcttgccactccgcaatttgtggccaatcacatcacccttgattcactgatcaacaccctggcgcccgccgccgagcgcagtttccaacgcctgatccaggcgctgtttcgagaaggcctgctgaaccccgacacgcgcacctacgacgaacacggccactgctggctggtactgcctgaccacacccacctgcgcttcgatcacctgcgccctggccgcatggccagttgggacctgcgtggccaggtcatgctggtgcgtgatggccagcccgagcagaagatccaattcccctcgcaactgctgaccttgcttaacagcagcctcgaatcatcagccgaccttgaggtcctgagccgtctcaacaccgaaattgatgacagctttgtcaacgacacactgtgcctggcctttcacgagcagtggacgctcacgctgcacgcgaccatggacccggcccaccaacacaatctgctgagccatctcaagcacgatgcaagcgtgaccaacgccacgtccgtgcttgaacaatggggcacgctgggccacccatggcaccccaactacaagaccaagctgggcttggccaccgaccaggtgatcgacttttcaccggagttcgaagcacgcttcccggtattgctttgcgcgctgcatcgccaatacgcgcatgtcgaagtattggccgataccgcggattactggcaatggtggcaacagcactttccacaggccgcccggcaattgactgcaacgcttgcagcacagggtcttgaggcgggtgactacctgccgctgccagcacacccttggcaggcccgtcaggaattaccgcaactgttcgccaacgaaatcggtgacaagctgctggtgctgaccgatatcgtcgcatttaccgcccacccgaccatgtcgttcaggactgtcctgcctgaaggcagctgcgtcgcgccgatggtcaaactgccggtctcactgcgcttgaccagtgtgcagcgcacggtgtcgccgcgctcggcgcgcatgggcccgcggatcagccacttgctgctgacgatccttgagcgcgagcctgccattgcgcaaatcctcagcatcgtccccgagcggatcggcgtgcacttcaagcctcaaccggccaacgatgaacacgcccgccacttggcggttctgtaccgcgacaatccccagagcctgctccaaccgggcgaaatggcagtgcccgtcggcagtctgtttgcaatcgaccagcacggccagccgctgctgaggcaatgggtgcgcctgagcaaaggccaggacgacgctgatgccatgctggcgttctttcgcgactatgccgcaatcgccgttccggcactgctgggcatgtacctgcgctatggcgttgccttcgaggcccaccagcagaactccttcatggtcatggccgcagacgggcagctgagccgcctgttgttgcgtgacttcggtgatatccgcatcgaccgcaaaaccttgcacgcccacggcctggacatcgaactgcacgatcccaggatgacgctgtacgacgacgcgggctttgtacgtgacaagctgctgcacacggtattcatgtgccacctgggcgaattggtattgctcagtgcccgccacttcgacatcccccaggggttgctttgggatgaactgtcggcccaggtcggccagtgtttcgacgacttgcgcagccaggtcgaaccccagcgctgggcaaccgagcgcgaagcgctgctggagcaggactggcccgccaagtcgttcatgcgcatgcgcctgctggaaagccatgccgatatcgtcgggcgcctgcccaacccgctgagtgccgccgccgatggcagctaaccccaccgcgctgcggctgctggtggtgattcaactggtgtcgatgggggccatggaaatgagcggccccttctggccgttgcagatccagaagttgctgggcgtggccaacgcccagtacaccggcctgctgtcttcgctggtgtacgccgggccgatgatggcagcgatgatcctgacgccaatgtgggggcgcctcggcgaccgtaccggtcacaagccgatgatcattcgcgcgctgctggcgttggcggtatgccaggcgctggccgctgtcaccttcgatccgtggctgctggtggcgatccgagtggcgcaaggtgcgctggccggcttcatcgcggcggcccaagcctatgcactggcctgctgtggtgatggcgggcgcgggcatatcctggctcggctgcaatcggcaaccgccgtggggtcactggcggggccggtgttgggcggctggctgatggatgtctcgggcttcgccctgctgtgctacagcgccaccgccgtgtgcctgggctgcgcagtgctcagtgtgttcctgcccagcgatgcaccgcgctcgcgacccacgcgcacatccgcgcctgccgcactgcccaaaggctggctgggcgcaatgctggggatcatcgtattgattcaggccgccaagatgatgccccagccgttttacgccttgtacgtcgccgatgtgctacaggcacccgcctggttgatcggcgccagctatgccgccagcgcactcacgctggcactgtccgcgccgctttggggccggctgtttgaccgacatcaaccggcacacacgctgcgcatcatcgaatgggtcacgtgggcctgcgccttgacgcttgcgttcacggcgatggccaacgaatggctgggcttccttgccagccggttgctgtggggcgtgtggcaaggcgctttgctgcccgtcgcctacacgttgatcgccaataccgttgcgcccagccagcagggttttgccctgggcataggcaacagcgccgccaaagccggcgcgctgtgcggcgccttgatgggcggtatcggcatggcaatggtgggcctggcgcacagcttctggctggtggcactcacgtatgccttggccgccgtgggtatccgcgccatccgttcgttcacccgaacacccgagacatccggtttttctgtcaatacttctaataactgaaaggcaaggtcatgaacaaatcgcaactggcagtcctgctgcccctgctcggatccatgagcggcccagcctgggccgatcaggctgaagacacccaggcagcacccaccaacctgcaactgcaggcgaccgtggtctcggccacgcgcaatgaaaccagcattgcggggattccgggctctgtgcaggtcatcagcgaagaccagatccgccagcaggcaggtgcgggacgccgggttgcggatatcctcgggcaattggtgccgggtattgcgccctccagtggtggcatgagcaacttcggccagacgcttcgcgggcgcaacacgctgatcctgatcgatggcgtgtcccagaacgccacgcgcgacaacttccgccagctcaacagcgtggcaccggaaagcatcgagcgtatcgaggttatttccggcgcgagcagtgtctacggtgcaggtgcgtcaggcggcatcatcaacatcatcaccaagcgcaacaaaggtgaagacctggccttcagcagcaaaatcggcatgaccgccggcaacaacttcagccacaaaggcttctcctacgagggcttccagagcgcaacgggccgtcaaggccctgtggactggtacctttcgggcaactacgtgcaacgcaacgatcagttcgacggcaacggaaaacgcattccccaggacacgtcccagggcagcaacatggacaccgacacctatgacctgcaaggtcgcttcggctacgagctggatgacgacaagaagatcagcctgtcgctgcaagactacaaagacgaacaagacacgcgttacaccaagaacccacgtaacaccggtaccgccgtcgcagtgaaaggcctggacctggacgaccaacccttcacccacaaccaggcggtcaaccttaactacaccgacaaggatttctacggccagggcctgcaggtcgaaagttactggcggcgtgccgacgcgttgttcttcccggacctgtcgcgtggccgcgccggtatatccgacaacaacagcgtgcaggacgtctacggcctgcgcgcggcgatcgacacgcaaatgccggacatcggcccggccaccggcaacctggtctggggtgccgactacgaccatgaaacctcacgccagcgcggcgaccaataccgcgtcaacggcctgaactacaccaagaccggcaccacgttcgaaatgggcccggacatcgccaccgccaccaaggccatctttggtcaactgtcctacgacatcggtgactggaccctgcgtggcggcgtacgccgcgagtggatccagagcgaggtttccgacagcattgcttatggcgagatcgtccagaccggcaatcgcgcgacactgccgggcggcacgctcaagtacgatgacaccctctataacctcggcgctgtgtatcacctgagcgaaaaccaggatgtgttcgtcaacttcagccagggcttttccctgccggatatccagcgcttcctgcgtgacgtgaacagcaagtacgacattcaaaacctgaatgcccaggcgctgaaggtcgacagctacgagctgggctggcgtggcaattgggacaagtggctggccaacgtcacggcgtatgaaaacacctcggacgtcacccagttctatgacgccaacgaccgggtactgcgcctgatcaatcagaaagagcgtgtgcgcggcatcgaaaccagcctgacgtacaacttcactgatcaatggtcggtcggcggtacgtacgcctacgccaaaggcgagacccaacagaacggcaaatggatcgacctgccggccacacgtatctcgcctgccaagaccaccgcctttgtcggctacgaccgtggcgactacagcctgcgcctgcaaggcatgcgcctggctgactatgacgccgcgttcaaagacaacaacggccgcgacatcaaaggctacacgctggccgacctgttgggttcggtaaggttgccggtaggtcgcctcgaaggtgcggtgtacaacctcaccaaccgcaactaccagaacatgttcgcccaggccaacgcgcgtgcgccgtacccgaatgccgaaggtcgtaccttcagcctgagttacgcagtggattggtgatcggctgacgctactggttaaaacacaaaccccgccttttgagcggggtttgttgttttttgggggggcttcgccccccccaacgcagggcaaaccttaatgccgttcatttaagcaaacgcaatgcttaaagcagcgaagatcaaatgtgggagcgggcttgcccgcgaagacgtcggcccagcaagcattgatattgactgacccaccgctttcgcgggcaagtcgaaccgtcgcacagccgctcccacaggtgttttgcgcttaactgaacggcattagggcaagcctgcttgcctcgctactgcttctacggccttaccacatcagatcatccgggatctggtacgcggcgtacggatcatcctcatccggcacttggctttcggtgaggatgttgagctgcacgatacgctccggcgcacgttcctggatcttcagcgccgcttcacgcgggatcacctcgtagctgccaccgtgatgcacgatcgccagggagccgttgctcagtttgttgcgcatcaaggtgttgaccgacaggcgcttgaccttcttgtcgtcgacaaagttgtagtagtcctcggtcgtcagcttgggcaggcgcgaggtctcgatcaattgtttgacctgggccgtacgggccttggcctcggctttttcctgctgctggcggttcagctcctgatcgcgcttgaccttctcggcgtgcgcctcggcagccaaacgcgcctgggtgtcatcaacttcggcctggcctttatggaccaggcgctgctgcttctgcttctctttgccgacctgcttggcctgcttttggttaaccagacctgctttgagcaactggtcgcgaagggaaaggctcatggtgcttactcacttaggcaactgctcaaccgcagctggacacattcttttcctgacgtttggcttcgccccacagggcgtccaacgtttcgagggtgcaatcttctatggattggtgcgtgtcgcgcaatgcctgttcgataaatcggaaacgtcgttcgaacttggcattggcgccacgcagcgcggcttccgggtcaaccttgagatgacgggccaggttgaccgccgcaaacagcaggtcaccgacttcatcggcgatggccaccgagtcgttatcggccatggcttcgagcacttcatccagctcttcacgcacgttatccaccaccggcaaggcggccggccagtcgaagccgacctggctggcgcgcttttgcaatttggcggcgcgcgacagcgatggcaaggccatgggcacatcatccagcagcgataattgctgcggcgcgtcggacttttccgcacgctcttcggccttgatctgctcccagcgcgccttgacctgctcttcgctcaactgcgggatatccaacggcgcgtaaagatcaccagttgggaacacgtggggatggcgacggatcagcttgcgggtgatgctgtcgaccaccccggcgaattcgaagcgctcttcttcccgcgccaactggctgtaatacaccacctgaaacagcaggtcgccgagctcaccttgcaggtgatcgaagtcaccgcgctcgatggcgtcggcgacttcgtaggcttcttccagggtgtgcgggacgatggtggcgtaggtttgcttgatgtcccacgggcacccgtattgggggtcgcgcaggcggttcatcaggtgcagcaggtcttcaagtgaatacatcagtctcttccgccgaggtgagaacgctgaagatcgaatgtgggagcgggcttgctcgcgaatgcggtgtatcagtcagtacatagttaactgaaccaccgctttcgcgagcaagcccgctcccacattttagtcggcgttcatccagctactcatggggtgcgattacgccgcgtctcaatgatgttcggcaactgggaaatccgccccagcaaccgtcccagcgcgtccaaccccggaatctcgatggtcagggacatcaacgcggtgttgtcctctttgttcgagcgggtgttgaccgccagcacgttgattcgctcattgagcagcacttgcgacacgtcacgcagcaaaccggaacggtcgtaggcgcggatgatgatgtccaccgggtaggtgagcaccggcaccgggccccagctgacctggatgatgcgctccggctcgcgcccgcccagttgcagcaccgaggcgcaatcctggcggtgaatgctcacgccacggccttgagtgatgtaaccgacgatggcatcccccggcaacggctggcagcaaccggccatttgcgtcatcaggttgcccacgccctggatctggatatcgccacgcttgcccggtttgtagccggtggctttgcgtgggatcagctccagctgctcgctgccgcgctccggctcgaccagctgttgcgccaggttgaccaactgcgccaggcgcaggtcgccggcaccgagggcggcgaacatgtcttcggcgatcttcatgttggccttttcggccagcttgtcgaagtccacctgtggcaagcccaggcgtgccaattcacgttcgagcagggttttaccggcggcgacgttctggtcgcgcgcctgcaacttgaaccagtggacaatcttcgcccgtgcccgcgacgtggtgatgtagcccaggttcgggttcagccagtcgcggctcggcgtgccgtgcttactggtgatgatctcgacctgttcaccggtctgcaggctgtagttgagcggcacgatgcgcccgttgatctttgcgccccggcagttgtggccgatttcggtgtgcacgcggtaggcaaaatccagcggcgtagcgcccttgggcaagtcgatggcgtgcccgtcgggggtgaagatatagacgcgatccggctcgatatccacgcgcagctgttcggccaggccgccgatgtcgccgagttcttcgtgccattccagcacttggcgcagccaggagattttctcttcgtactggttggacccggccttgacgtcggtgcccttgtagcgccagtgcgcgcacaccccaagctcggcctcttcgtgcatggcgtgggtgcgaatctgcacttccagcaccttgccctcggggccgatcaccgcggtgtgcagcgagcgatagccgttttccttggggttggcgatgtagtcgtcgaactccttgggaatgtgccgccacaaggtgtgcacgatacccagcgcggtgtagcagtcgcgcatttccggcaccagcacgcgcacggcgcgcacgtcgtagatctggctgaacgccaggcccttgcgctgcattttgcgccagatcgaatagatgtgtttggcccggccgctgatgtcggcgtcgacgccggtggcctgcaactcggaacgcagctggcccatcacgtcggtgataaagcgctcacggtcgagccgccgctcgtgcagcagcgtggcaatctgtttgtattgatcgggttcgaggtaacggaaggacaagtcctccagctcccacttgatatggccgatgcccaggcggtgcgccagcggcgcgtagatatcgaagacttcgcgggcgacacggttgcgcttttcgtcgtcggcggtcttgaccgcacggatcgcacaggtgcgctcggccagcttgatcagcgcaacgcgtacgtcgtcgaccatggccacgagcattttgcgcaggttctcgacctggccctgggtgcccagcaccatggattgacgcgggctgaggctggcgctgatggcggccatgcgcagcacgccgtcgatcagcttggcgaccacggcgccgaagcgctggctgaccagcggcaacgggatatgcccttcgcgtacgccgcgatagagcacggcggcgatcagcgaatcctggtccagcttgagatcggcgaggatctcggcgatttccaacccggtgcgaaagcttgaagtgccttccgcccacaggttcttggccgcattgttctgttgctcggactcacgagcgaactcgcaagcggccttcaaggcttcacggtccagtgccgggtcgacactgacggcatgatccagccatgcctcgagattgatactgccgtcggtgttgatcggctggtgtgctctcacctgtaccatcttgcttaccttccctacgacgcacctttgatgcgccaaaaatcatcgctgacctgcttcataaccttaggctacgtacaactccctgacaggtcacggcccaggagactacaggccagtcggattaaacgggcatcctagcccgcttcaaataacgccatggcctcgacatgagctgtctgtggaaacatgtcgaggatcccggcacgttttagccggtagccttgcttgaccaactcaaccgtgtcccgcgccagcgtggcagggttgcaggacacatacaccaagcgcttcgcacccagggtggcaagcttgcgcacaacctccagggcaccatcgcggggtgggtccaagagtaccgcagaaaagccctgtttggcccattccgcgtcggtcaaaggctgggacaaatcggcctgaaaaaactgcacattatgcaaatcgttgctgacggcgttctgcgccgcccggtccaccatggtctgcacgccttctaccgcgaccacttcgcgcacctgtttggccagcggcagggcaaagttgcccagcccgcaaaacaggtccagcacccgctcctcggattgaggcgccagccattccagggcctgggcaaccatcgccgcgttgacgccggcgttgacctgcacaaaatcgcccggccgataagccagttccaaatcccactgcgccaaccgataacccaaggtcaaatccgcgtcgaccggctccggctggccctcgccatgcagccacaactgggcttcatggaaggtgcaaaattctttcaatacctgcaggtccgcctcggacagcggcgccatgtgccgcagcaacaccgcaatcgacgagccgctgaacagctccacgtgccccagcgcctgaggtttgctcaggcggcgcaacatgttcggcaaacgctgcatgatcggttgcaaggcctgtaccagcaccgggcaatcatcgatggcgacgatgtcctggctggccacggcgcgaaaaccgacctccagttttttcgctttggcatcccagcgcacggccacgcgggcgcggcgtcggtaaccgaactccggaccactcaaaggtgcagcccactcttgcggttcgacaccggccacacgcgacagttgctcggcgagcatgcgctgtttcagggcaagttgttcgtcatggggcaagtgctgcacgctgcaaccgccgcagcggccaaagtgggcgcagggtgccgggcggcgcagttcgctggccttggatacacgctcggtgcgcgcctcgaccactttgccgtgggcgcccaatacccgcgcttcgacgtcttcgccggccagcgcgccattcacaaaccaggtgcggccttcgaagaacacaatgccacggccgtcgttggccagccgctcgatggtcaggcgttgtttcttgcctaccggtatctgcggggcccggctgccgcccgtcggttggaagcgcaggcctctctcgtgcttggccatcagttgggttcgtcgaagatgccggtcgacaggtaacggtcgcctcggtcacagatgatcgcgacgatcaccgcgttttccacttctttggacaaccgcaacataccggccacggcgccaccggaggacacgccacagaagatgccttcttcgcgcgccagacggcgggtggtgtcttcggcttcacgttgggccatgtcgatgatgcggtccacgcgcgtcgcgttgtagatcttcggcaaatactcttcgggccagcggcgaatgccggggatggccgcgccttccatcggttgcaggccgacgatctggatcgccgggttctgctccttgaggtagcgcgagttgcccatgatggtgccggtggtgcccatcgagctgacaaaatgggtgatggtgccgtgggtctggcgccagatctccgggccggtgctggtgtagtgcgcctcggggttgtcgccgttggcgaactggtccagcactacgccacggccttcggcggccatgcgctcggcgaggtcgcgggcgccttccatgccttcttcctgggtgaccaggatcagctgggcgccgtaggcggtcattgccgccttgcgttcggcgctgccgttgtcgggcatgatcaacaccatcttgtaacccttgatcgccgcggccatggccagggcgatgccggtgttacccgaggtggcttcgatcagggtgtcgccgggcttgatctgcccgcgcagttcggcgcgggtgatcatcgacagcgccgggcgatccttgacggagccggccgggttgttgccttcgagcttgagcaacagggtattgctggtttcacccgccatgcgttgcaagcggaccaggggcgtgttgccgacgcaatcggcgattgtagggtactgcaaggtcatggcgtattcgcaatccagactgcgggggcgaacatcataccgggaaaggctggcgggccatatcacgcaaagtgtggtgcttatggcttaaaggcataagcagtcaatcagctgttcacgaacgccatccattcgctgcgggtcaactcatgcaccagaccggtcttggcgttgttcataggcacagccagggtctcgatatagtttttatattcggcttcattcatttcgccagtccccactttggccgtggccagttccagcgcgcgatggaattgcttgagcgctgcctcaaagcgctgcgaatacttgcgctccaggaacgccacccaatattcctcatcctcaagttttgcaggccagttgaactgcgattcatcacgcagaatacgtcgacgtaattcattcacggaatcggcgtctggcacggcagtggctgcgtcaaatcgcccgggcagcgcaaggggcaagtcgaggctgacggccagggcaagtcggtagaccagaatgtgcacacagatttcgcgatcggtcggcagctccaacgcaccctgcacgtaatagcggatggcagccaagcgccgcagcgcccggtaataattaatgaagtcagggcccgcattggctacgtttccagaaagcatctgcaccggcaacatcgccagttcgaggtcattgaggctcaacagccacccatcgatccctgcgctcatatcatttaggggctcctcaaaaagaattcggcgcagccggccattatgattggccgccacaatcagattccagacgcgctgtgtcaggtcctggcgcaaggcttgatgctgcggggcaatcaacgggggataagacgacaggtgccataacaggttgaaaaaacgatcggccattctctcgcccgccaacagctcccattcaccgcgccattgcgccatttcattgagcgggaccgccaccagccaacgctcaaccgaaggaagcgggaattcgccgttgccccacaagccaaaatagatgtcttgataacccggtcgcctacggtaattgctcagccgttgcaacgttccaggggaaagatcgttgccacgaagattcatggcgcgatgcactgtttcatgcaagaagagatcggtcagcgtaagcaccttgatagcgttatcgcgcaaatcgaaggtgcgaagattttccagtgtcaccgcgcccagcggcaaaacattgatttgtgtattccgcagtttgaggacccgcaattgcttcaggccatacaggttcaatcgttgcccccgccccaaagggttattggacaggtccagcttgatcaggcgcgtcatgctctgcaggtggctgacatcccaaagatttggccgaatccggttgttcgatagatacaggcgcttcaagtaccaaagctgcgacacctcgtgagggatttggaccaggcgattaccgtcgagataaagcgtgcgcagcgcgggaaagcgtcggagaaaatgcctcggcaatgcttgcagttggttattgctgaggctcagttgcatcacatgcccaaagtgggcatttatttcaggcaactcattcaggttcaggtcatccagagacagctcgaacatcacgcctcgcgtggaatcctctttgcgccagcaacgccgaattcgctcggcggcttcgcggcgcgcggcggcctggctcgtctcgcctttttctgcggcagaccagcgttcaagcacaccctccaaggcctcacgttccttgaacaaggcatcaatcgcctcgcctcgctcgcgtacggaatcactcaggttttccagtatttcaaacacgtccttatcggttttagacggaaacaactcacgcatacgcgccacttgctggcgatccaccgggccccatccatcaccaccgctcaacgggtaacccatccgcccgtcagccatacggcgcggcgggttgtaccaggcgggccagcctatccccagcagcgcgtcgaccgacgccccttggggttcctgacgatgaccgatctcctgcaacaactcttcgactccgcccacgtgggtgtagcccaacgcctggcgttcccgaggcggcagcgcggctaacaaaacaggcaggaaagccccagggtttcccaccgattgccgagtgccgtccgtttgagggctgtacgcctgataatgtccggccaccggctccaacacgcgtttgagcgccgcatcgacggggccgatgctgtcgagcagtcgcgcctgcgcccgtacttcaacccgcaagtgcggtggccagccgtgtatatccggcaaggtgtgcaggatcaacttcgcactgtcgtgacttgctgctgcgggaaggaacagcccctctaaagcccgggccttgcgcaactgcttgagccaccaacggatataaggggtgagggtcaagggcacgcggccagcctccaggctctgcacctcatccgccgaggcctgacataccaggctctcggccaccgtcgccgtcaagccgataaacttacgctgcagcagctgcgccagtgggtctgaagaacgtttatgacacagcgcctcgaaaaaattccgttccatctgcggcgggtctatttcgaccttggactccagcaccgtgacctgatcgacgcgcgacgcccccgccaccccgaccagcacgtcggcggcctcaggcccaagctcacccagcagctcagcgtaaaaaccctgcccttgcgccacgcccgccttgacccgctgctgaatcgtgaaccgctcaatcgtgtctaacagcagcaccggggggcgctcattacgcacatgcacccgtcgcaggatgcccggtgtcacgccgctgatggttcggatctgcgcaatggcatccggcgacaacgagcgcgtcaccggcccgaggcgccaaaacggtttctgcccatcccacgtcagcgggttttcccactcgtggcgccaggcgccggcgccgttgctgaccagtaccggtgcgtaagcctcttccaaagaggggtgacgaattcgccacggctcatgagtgcccgcgcggtcgaccctgaaatactggctatccaggaacaggtagcgatccggccccaggctgtagaggcccagcgcgtctggttcgggcagcctgctcgacatatcggcggtgctggcgtactgcgcaatctcgcgctggcgaggataaaacgagccatcaggcgcgcgattacgcaacagggcctgggccacctgatggcggaactcggtgattgcctgttgctgattccaccgcagtacagacaggcccagttcggagatctggctgacgatcgccacgtaaaaactgtcggcgccggtcactgtggcacccacccggcgctctgtggggtcgtaaggtgcaaattgaccgtgatcctgatcgatgaccaccagcgtccggtcctttggcccgcgcaaactataaggcacagcttgtcccttggggctgacaaccacagcctgaccggtaaagccgcgcaatacgccagcggcgaactctgtggcccagtgctgcgtctgtcggtcgaaccgccttggatgcaggagcccatcgacgatggcctcgcggcgacccacttgatgggcggcacgcaacgcgctgtaaagtgcttcgggttgcagttgcgaatgcaacagttgcgtctgctggtgcgccgacagcgggtgttcacgcaacacctccagtaaccgcgccaggctcaattgcgggtgcagagcctgtagctgtgtaatcacggcgggtacgggatgcgcttggccgatacgatcaggcaacaggttgcgcactgacgcgtcggcaccgctcggcattgcccggctggcatcggcaaagcgagtgagtgcgtcgaacaaatcgaatttcaaggtgttggccaatgccgcgagctgctgacgaattggttgttcgcctgcggaaaaaatagccggcaacatgtccactatcgcctggggtaagtgcagcgcaatgcggcgtggcgtggcgtaggcaaattgatagttttccaactgtgtcacggtcaccacctgcgtcgttgggcgggtggcgtctttgctatagcgtcgaatctcctggccttggtggttttcaatgctcaaggcggtgcccacgggccaggcttccaactgggtcagcaaaggtgccatgacctgaacggcaccgacggggccgggacgaccgacatcggcgccctcaatcacccagtcgatcagcctgtcggcgttgaaccggtgcacggcctcgaccagcgacgctgacggcggcgcgccttcccagacctgctgcaaggcgtcccgcgacgtgccactcgcgtcaagcaccgcctgcatatcccgcgccgcggcgtgctggctgcccaacattctttcgagcagttgagggttcgtcagctgctgagcatccgcggcggcagtacgccgctgggacagttggcggtacaaccgctgatggcgacgctgcacgctcctggccaggcgggtatgcaggcgcgcactgatgagtaaatcggccaggtcgacaaacccctggagcaactcatctggctgaccttgcagcgcctggtgcccaccgtcaatcaaggcgcgctccattgccacaaacagcgcaaacgcacgtacccgccccaagcctttcaacgcccctggcaccggggtcaagagcagcgtgataatttcactgatcagcgtctgggcaagctcgatcatggttggcataaaaccgggagtttcgttggccagctctttgaggttgtctgcacagcgctggacgtagaagttgctcaagctgaccaggggcacctgttgtaccgttacacgcacatagccgattttctggaccgtgccgagcgtgagaatggcttgagccaaccgatagagcagtttggcgaatgcctccgtagcacccgtgaagtcaggcggcggcccgaccttgacgatattgatcagccgcgcgctgtcacgcagcgacatggcttgataaagccagtcgaccttgcccttgcggtaaaagccgtggaacgcaacgtaaaactcttcgcacgcctcgcggtgactgtcatggtggcgcagagagccgccggggcggttcgggaaaaaactgaaggctcccgggcaatcactgacggcaaaaaccagatgcgggatgctcaggcaatcacccgcaggctcactcacgtattgaccggtcaggcctacgtgttgaggtatccagctggtgttatccaccccatgggggataaacagccgcatttcctccactctcccccagcgcacctcccccgctaacgcgcgcttcacctgctgatacttgtgccggtcgacccgactggccgtcgtgtctctgagcgcttcgatcaaggcaaattcgagctcggccgtcgccaacgccatgatgccgcgccccaacgaaccgttggcctgcagtgcccgttgcagctgcgtgttgagctgcgcgccaatatcgagcctgcgcaccagtgcgatgaactggccggcagtggcgctgacgccgtcgtccagataactggcaccggcaaggcctgtacggccaggaaaggtccaaccggtcaggccgtcgtagttcaagcaggccgcatcccacaaggtcaggctggcgacctttatcgccccctcagcatcgccgcgctgttcgccgcccgatgctttataacgggtgtaaatgcgcgtgacggtggggtcgatatcctgaccggtcagcttcttcaactcagcgcgcagttcgctccctgcgtgttgctcgaatgcctcggtcagctgctggacagccttctccagggtgtgctgggcatcgacccaagccttctgcaggcgcacgtactcgaatgtttcctgttcattgagcacgccaaaaaaactgccgaacttttcccgcatggcgtccaggccttgcaaagcagaccactcgggggcagccatcaacacgggttgttgcgccgctatgtattcgcgcagcgggtcctgcggcgtactgctggtaatcggctcgaccatttctgtgttcctgaaaaggtcagcctatcgcacgccctgcgtctattcgggtagttatatagcgctcggcatcagccgtggtttttgtcgaaaaccgcaggccccatagccgctatctggccttcaatcaacgcgtcgaaaggcttgagcaacggctcgaatgaagccggtgcttccagcacctgcaatgcttgcgcgatagcctccacggtggacaaggcgccgggccctggcgccttgcgcagtcgatagcgcgacacgctgtcgcccgccaacgtcacccgtggcaatgcggccagtaacgggttgaggtgcaacaatttgcgcgccttgcgccaggtgccatcaggcacgaccaacaacagcggtgcgtcgtcaggcgcataggcttgcagaggctgggcgtcgtcagcaggaaacagcaggcgcgcctgataaccgggcgggttcaataacgtcgccaggtcgtcgaacacctcgcccaccaccaactgcgcattgttcaaccccaacgccgccaaccgcgcggtgttgagtgcgtggttgacttcactcgggtgctgcaacagcaacacgcgagtgcggctgtcgaggctggggatcagcgcgcacaggcagtgagtggcaggcctgaggcaacgggaacactggggtctggacatggtttttcaggcctgattgagctgggctttgagtaagtcgcgaaaggtttggatcagcggttcacggctacggccacggcgcatgatcatcgagaacggcgcctgatagccgaaggttgccggcagcagcacgcgcaggtcgcccttgtcagcccacgcctgggcgtagtgctcgggcaggtagccgatataggcgccggacagcaccagaatcagctgcgcctccatactttccacggttgccgcgctgtgtttgaagccgtggcgcgccagctcggcctggctccagtagccgcgcccgaccatgcgttgctgggtgatcacttgttcgggaatacgccgctcgctgaacaacgggtgccgggtgctgcaatacagccagtgctgctcacggtacagcggcatgtagatcagcccgctcatgcggttggaaaaagcgccgatggccaaatccaggcggttgtcctgcacgcccagttgcagctcataagggctcatcaccgacaaattcaggtgcaccgccgggtgttccaggctgtacgcgccgatcacctcggcaaagggcagcgccttgtcgctgacggtggagtcgagcacgccgagcttaagggtgccgcgcaactcgcctttcagcgcggcggcgtattgctcgaaaccttccagctcgcccagcaggcgcaaagtttcctggtggaacagctcgcccttgctggtcaggctgaacccgccacgcccgcgatgacacaacaccaggcccaaggccgattcgagctggctcatgtaggtgctgatcgccgaggtcgaaaggttgagttcatgctgggcgttggcgaacccctgatgccgcacgacgctgacgaagatgcgcaagagtttcaggtcgggcaaggcgttggccatggggtctccagattcagctaatgcgccgcgatcccattgtgggagctggcttgcctgcgatggcggtgtgtcaaacaaagctatgtggctgacccaccgctatcgctggcaagccagctcccaccgttggacggcgctcgacagatggatcggtcaaccccaacacagacgagcgagtttacctcagccattagtttagaaaaatctgaactaagtatttgcctctgccgattcttcccgcccggggcttttcgcagaatcggcccctaataaacaaaacaacgatgaggcaatcccgtggacaagatttttcaccaaccactgggcggcaacgaaatgccgcgcttcgccggcatcgccaccatgatgcgacttccccacttgcaatcggccaagggcctggacgccgcctttgtcggcgtgcccctggacatcggcacctcgctgcgcgccggcacccgcttcgggccgcgtgaaatccgcgccgaatcggtgatgatccgcccctacaacatggccaccggcgccgcgccgttcgactcgttgtcggttgccgacatcggcgatgtggcgatcaacaccttcaacctgctcgacgccgtgcgcatcatcgaagaagcctacgatgagatccttgagcacaatgtgatcccgatgacgctgggcggcgaccacaccatcaccctgccgattttgcgggcgatccacaaaaaacacggcaaggtcgggctggtgcacatcgatgcccacgccgacgtcaacgaccatatgttcggcgagaaaatcgcccacggcaccaccttccgccgcgcggtggaagaaggcttgctcgattgcgaccgcgtggtgcaaatcggcctgcgcgcccagggctacaccgccgaagacttcaactggagccgcaaacaggggttccgtgtggtccaggccgaagaatgctggcaccactccctcgcgccactgatggccgaagtgcgggagaaagtcggcggcggcccggtgtacctgagctttgatatcgacggcatcgacccggcctgggcacccggcaccggcacgccggaaatcggcgggctgaccaccatccaggccatcgaaatcatccgtggctgccagggcctcgacctgattggttgcgatctggtagaagtttcgccgccgtacgacaccaccggcaacacctcgctgctcggcgccaacctgctgtacgagatgctctgcgtactgcccggtgtggcgcaccgctgatgagcgcgcacgaggtgctgcaagccgcggccgacctggtctcggccttcgcccgcaacgaccgcgccgcctacttcggcgcgttcacggcggatgccagcttcgtgttctacaccctcccccagccgctgctcagccgcgatgcctaccaggcagtgtgggacagctggcgccgggacgaggggtttgaggtgctgtcctgcacttcaagcaacgccgctgtcagcctgcaaggtgacgtggcgatttttattcatgacgtggccaccgagctgcgcatgaacggggagcaattttttagccaggagcgcgagaccattgtctttaaacggcaaggggcagacgcacaacaagaacaaggcctgtggctggcctgtcacgaacatttgtccgctgtgccggaagggctgccgccccattagccaatgtgatcggagctgatcatgaataataaaaacaacgataaaagtattcgaaagatagaaaccaacggggtcgaacagatcccggaccacgaacgtaccgccgggcccaaggatctgtttcgtctgatcttcggcggtgccaatacctttgccaccgccgtgctgggctcattccccgtgctgttcggcttgtcgttccaggccggtgtctgggcgattgtgctgggcgtgctggtgggcgcggtgatcctggcgccgatgggcctgttcgggccgatcaatggcaccaacaacgccgtgtcttccggtgcgcactttggtgtccacgggcggattgtcggctcgtttctgtcgctgctgacggcgattgccttcttctcattgtcggtgtggagttcaggtgatgcactggtcggcggtgcgaaacggctgatcggcctgccggaaaccgacctgaccctgggcctggcctacggtctgttcgccctgctggtgctgaccgtgtgcatctatggctttcgcttcatgctgtgggtcaaccgcatcgcggtgtgggcggcgagcctgctgttcctgctgggaatcttcgcctttgcaccggccttcgacagccacttcgccggcactgtcgcgcttggccaagccggcttctgggctgccttcatcggcgctgcgctggtggccatgagcaacccgatttccttcggggcatttctcggtgactggtcgcgctacatcccgcgtgagacgccgaaaatgcgcatcatgctggccgtcgtgctggcccagatcgccacgttgatcccgttcctgttcggcctggccaccgcgaccatcgtggcgatcaaggcaccggactacatcgccgcgaacaactacgtcggcggcttgctggccgtggcaccgagctggttcttcctgccggtgtgcctgattgcggtgatcggcggcatgtcaaccggcaccacctcgctgtatggcacggggctggacatgtccagcgtgttcccgcgcctgctgtcgcgggtcaaggccacgttgctgatcggggtgatgtcgattgccttcatctttatcggacgtttcgccgccaacctggtgcagagcgtgtcgaccttcgccgtgctgatcatcacctgcaccacgccgtggatggtgatgatgatcatcggcctgatcgtgcgccgcggcttctattgcccggatgacctgcaggtgttcacccgcggtgagaccggtgggcgctactggttcagccatggctggaactggcgcgggctgggggcctggatcccgagtgcgttggtgggcctgtgcttcgtcaacctgccggggcagtttgtcgggccactgggcaacctggccgatggcatcgatatcagcttgccggtgacgctgggactggcatcggtggtgtacctgagtttgctgcgcctgtttccggaaccggcggctgtgtatggcccccaggggccacgtcgcagcccaacaggagcaagctccctcgccacaaaaagcgcctcaatagcctaaaaaaataatcggagacccgccgtcatggctttggatttattcgtcgtactcatctacgccgccggcatgctcgtgctcggctattacggcatgcgccgcgccaagacccacgaagactacctcgtcgccggtcgtaacctgggcccgtcgctgtacatgggcaccatggctgccaccgtgctgggcggtgcgtccaccgtcggcaccgtgcgcctgggttatgtccacggtatttccggcttctggctgtgcgccgcactgggtgccgggatcatcgcgctgaacctgttcctggccaagccgctgctgaagctgaagatcttcaccgtcacccaggtcctggaaaaacgctacaaccccatggcccgtcaagcgagcgcggtgatcatgctggcctacgcgctgatgatcggcgtgacctcgatcctggccatcggcaccgtgctgcaagtgctgttcggcctgccgttctgggtctcggtgttgctgggcggtggcgtggtggtggtgtattcaaccatcggcggcatgtggtcgctgacgctgaccgacattgtgcagttcgtgatcaagaccgtcggcctgatgtttatcctgctgccgatctgcctgtaccgcgtcggcggctgggaccaactggtggccaagctgccggcgtcgaatttcagcttcaccgaaatcggctgggacacgatcatcacctacttcatgatctactttttcggcatcctgatcggccaggacatctggcaacgggtgttcaccgcccgtgacgaaaaggtcgcccagtacgcaggcacgttcgccggtttctactgcatcctctacggcctggcctgcgcgttgatcggcatggcggcgcacgtactgctgccgaacctggacaacgtcaacaacgccttcgccgccatcgtcaaagcctcgctgccggacggcattcgcggcctggtgattgctgcggccctggcagcgatgatgtccaccgccagtgccggtctactcgccgcctccaccgtattaaccgaagacctgctgccgcgcctgcgtggcggcaagcaatcgagcctgagcatcaaccgcctgtttaccctgctgaccggcgttgccgtgctgggtatcgcactggtggtgaatgatgtgatcagcgccctgaccctggcctacaacctgttggtgggcggcatgctgatcccactgatgggcgcgattttctggaagcgcgcgaccacatcgggggcgattgcgtccatgaccttgggcttcgtaaccgcgctggtgtttatgttcaaggatggtttggacgccaacacgccgatctactacagcctggcggtcgggctggtgagttttgtgttggtgagtatggtgtcgcgccggccggaggcggtggtggcgcgggcgatttgagctataaaagaagttaaagcggtttcttcagcgggtgcgacgtcggatgtcgtgcccgtttttttgccctacacaaaacaaaagtgggagcgggcttgctcgcgaaggcggtgtaccagtcaactttttattgactgatacaccgccttcgcgagcaagcc

SEQ ID NO: 29 - DNA, 232035 bp, Pseudomonas poae FL10F
ttggccagaatcaacgctaacccacgtttaggcagccccaggaagtgggaacggctttttacggcagcagaaggctgtcgcgcgaggaaggcgagctggcgaacgtccatgtcatgtcccggtgcccgaaggcggcaaataatttaaagaaagaaatccagacggaaatagatcggcgcttcacgttccgtgatcgcagccggtcgttccaaagagtgggcgaaggtcaccgtggcggcgacgttctggccgcgggcaaacagctcaaccgagttgctgctcatgcgcccatgctgttcggcgttgtagcggtcgcggctgatcacgccctggtcgtaaccgaggctggtgccgtactcggcaaacaccggctgcagccaggcccaggtcaccgggcggctccagcgcaggtcgttgcgccagtagccgccgctgtcgccggagagcatctggtctttgtagccgcgaatcgacgactgcccgcccaagctcatgcgctgcgggctgaacagcacgtcttcgctgtgctggccggtcatcaagctgctgaaactcagcgactcgccccacaacttgaacgggtacaagtagctgaccgtggcggtgtatttgcggtagcgcgcatcggcctggccaggcttggggtcatgattggcctgggcgtcgaacgcgccgatgccgtcttgcatgcccaggtcgatgttgagaaacgagctgccaatccggcgcccgtggttgatgccgaactgggcttcgctgaggcggttgctgctcagcgccagcttgctgtcttcgatgaagttgttggtgcgcaggtaggccacgccggtgctcagcgaggttttgctcagcgcatcgcgatggatcacgcgctccaggcgcaactggtggttctggctgtcgccggtctgcttgaacttgaaattattcgcctgggcctgggagcggtactcactttcactgtaggtgtaggtgaggttccaccagccaaatggcaggctgtaattgagcatcgaattgcgtgaagttttctggtgatcgctgattgcatcgtggccgccgcgcaatgaaagctggtcggccaaacccagaggattatcccaatccaggctcgcgccccactgctgctcgccggtgctgcgctggccgccgttgtggcgcgacaacccgacgcgccaaggcttttgcggggtgtttttgaccagcacatcactgccgccgacggccttgcccggcgccaattccatctgcgcctggttcgagggcaggcggttgagttggtcgaccatctgctcgatttcgcgcaggttaagcaactcgcccgacttgcccggaaagctcatcgccagttggcggtgggtgatgccgctgccttcggcgcctttcaagttttcgagtttgccttcgaccacttggatcttgaggttgccgctggaaaggtcttgctgcggcagataagcgcggctggtcaccaggcctttggcgaggtaacggtcggtgatcaccttgagtaccgcgttgagctgcggcacacccaggcactggccgatgtagggtttgatcagttcggcgcgttcgcctgcggaaaggctgtcggcgccggcgaggtcgatggtcttgatcgggaagcaacgggtgtcgaccggggtggtcggcgttgcgggggcggcggatttacccggcagctccttgaggtcttcaaggcgcttttgctgctcttcgagcaggcggtcctggcggtcacggatcaggtcggtgatgccgggggtgttctgcgggggcgctgcgtgcgcgaagccggcagagcccaggcagaaaaaaacggacagcaggccaaccccggcccgacgcacaaaacgccacatttctagatccctctacatggctctgtgccattatttttcggcgatcttagggtggcattttgatggcgtcaattaaatgtacgaatttgtttcagcgttgaaatgttggtgtcagacagtgaaaaaaattagtctttttgcatcaatcacttaaccgcaaaaattggatccaatcgatccgaactgagcatcgagccgtttagggaccgcgagacccggtgggtccggaccgtttttaatatgacgtgatagtcttcaaaccccactcatgcgagcgctcttacatattgagcgaggcagccaagtcaaggacgacacaccatgcacatcacccgtacgttccacccgattggtcaaggtgggttcttcacggaaacccatgagttcagcgcagatgagaaattcaccattgtttatgactgtggggtcgctcaaaatcgaaagcgtgccaacagtgttgtacgccacccagacctcaaagatatggatatcgatatactgttcatttcacacttcgactacgaccatgtctgcaagctggcggtgcttttagaacacgtgggtcatataaagaatgtggtaatgccactattacacgacgaggagaaaatactgctgaccaacctctttcggctatcgggattcaacatcctgaggttgatcaacaacccgagcagacttttcggtaacacgacaaaaatattccgtgttgcaggcatagataatgagaacgtcgttaacggcgccgctgatgaactacctgtctctctcgacactctctcccctgccataccattacgcagtggcattcgtatcggtattcccttcaatagcgctcagcccggccatgactggatattcacgccctacaatcatgagtccagcgcccatcggcaactgcttgacaccgagctaagtgcacagggcttcaatgttcataaattacgtaccgaccctaagtacacgcttgataaggcgattaaaaagcgtcgagagctcaagcgcatttacaatatgctacctggcgggatcaacctgaattcaatgctcgtgtattcaggccccgaatttaatcattcaaagctacgactcaggtccagtgttcaacattcatttgaaatattttgccagcattcgctggcatgccctgtaaatacctactgccacccagacgtactctggcctgactgttttcacacattcattagcccttcaaatatatatttctgctgctgtgtctatgaggatgagttcaggggcatttttaatgcccccggttgtgtttacaccggtgataccgatctaaatacacttgacgttcatgacgtgttcaaaaatgtctggaagcacgtgggtacgttacaaatccctcatcatggagcagcaccgtgcttcgccagcgcggtacttgactatcaaaaaatgatatgtccaatcgctgtgggcagtcacttccataaaacctacgggcatccggccatttcggtgattaacacgatcattcaaaaaggttgcattccggtttttgtgactgaaaacaacaccgcatttgttcaaaccattaactgataacgcttctatccgagcatggcgatttttttgcaaaaatcgcaaagcagctcatcaaccaaccaatgcggccctacgcgccaccgcccacggcgccatcaaccgctgcggggtctggcaggttttgcgcttgagcacgaagttgcggcacttctcggcgaattgttggcggttgtgcaccatgtccagctgcatctgtgccagttcggcttcgcggcagcgtgcaatcaggtcgatgtccaacgccgctttacgggcgcgagccacggcgtacttttcatcggttgacgcgctgcttgcctgctgcatcagccaacggctgaaggcgtgcgggcagcgcgggccgatgccctgaaccagcccgtattgctcggcttgcaaggcactgatcggcaggcaggcgtcggtgagttgatgggcgacttcactgccaacggcgcgtggcaggctgtaggtccagtattcggagccgtacaggcccatggttttgtaatgcgggttgagcaccacgccctgccgggccaatacgatgtcggcggccagcgccagcattacaccaccggcgccggcgctgccggtcaggccgctgatcaccagttgccgggccgtgagcagttcgtggcacacatcgtcgatggcctgaatgttggcccaggcttccagccccggcactggggcggcctggatgacgttgaggtgcacaccattggaaaagctgccgcgcccgcccttgatcaccagcacttgggtgtcccgcgtcttggcccagcgcaacgccgccaccagccgctggcactgctcggtgctcatggcgccgttgtagaactcaaaggtgagttcaccgacatggccggcttcgcgatagcgaatcggttgataggcttgctcatcgaacatttgattggcgatcgagctgtccagcacgggaatatccgccagtgcttccgccagcacgtggcgggccggcagcttgaaggtctcctcccccggccgggctttgagtttgagcgagccgatccacaggctctgatcaccggtcgccaccagcaccgcgtcgtcctgcaccgcgaggatctcacccggtgtgccgtggcgcgcatccaggtgcgcgtcgtacaggtaatactgcccgccctggatactggccagcacaccgggctggccatcggctgcgtcgatgcagcgtttgatgaagcgtgcgcaatcgtaccaactgaaggtgcgatcagcctgtgtcatgttcggctgcaaacgcccgatgacgtgggcttgggtgtaatcgagcggcaccgggacgaaaccccgggcgaacttttccaccacgtcgcggatgcaatagagggcggcgtcactcaccgcgccgttgtacagctcggatttgcgcacatcggcaggcatgtcgaattcacaggtcgaccagatcggcccggcgtccatttcctccaccgcctgcaaagccgtgacgccccagcggccgacctgctggctgatggcccagtccagcgcgctggcaccacggtcgccgacgatgcccggatggataatcaccacagggcgctcagggttgctccaaagttgttgtggcacacgatctttcagaaaggggcagatcaccaggtcggcgtctgaatcctcgatctgctggcacaccaaggctggatcggtgaacagaacaacgctgggcgcgtgccccgactggcgtaaatccagccaggcccgctgggtcaaaccgttaaacgccgacgctaacacgatgatcttcaatgaccgcatggctgactcatccttgagaatgcgcggccagaggtgctccttgagccttccctggcctttgatggaagcacaaggatagttggcgtgccaggcaggccacctgatcaggatcaatcttgtgtcagcgagtgcttgaacctaggcgcctgcgttcaaccgataggcgcatgggctggcgagtgctcccgcgcgccctctgccacaagggacgtcaggtattcgccaaacccgccgcgacacttgtagtcccgacgcgcgctggtgaccacgggattggtcgccgtccacacgatccgcgcgccaatcctctcgaggtcggccaccaactgcacatcttcatgggcaaccaaatgctggaacccacccgcgtttcgataggcatccgcactcaagcccaggttggcaccgtggatatggcgatggttctcggtgaactgatacaactcaaggtaacgcgaacgaaccgattcaccgtactcgctccagctgtccacctcgacggttccgcacaccgcatcggcgccaaagccgatctgacgcaccagccagtcggcgggcacaactgtgtcagcgtcggtgaatgccagccactgggcgccgacttcaagcaatcgctccgcgcccaaggccctggccttgcccacatttcgaacgctcacctcaagcgttgcgacacccatggccgacacgcgcgtggcggtctcgtccgaacacgcatccagcaccaccagcaattggacctgttggtgtgccagagccggatgagcaatggcgcgctggatggaggcgaggcaggcactgatgtgccgttcttcgttatgggcaggtatcactatccctatcattgacgttccctctaccaggcaaagtgtctacagctatcgaccgggccgtgaggcagaaggtttaaacaatctgaaggcgccgccaaacaatgacgtgagacaggtcgcagtgattaaacggaacgtcacaggcgccacaggctcagatggtttacgtgtttgatgcacggatgaacccgccattcctacaaacaggtcagccaacatgtctaacgattatcaaggtatcgccagtgtcatcacggcttctcgccacatgggtacaccctcggatgaacgccttaatgacacggtaaagattcaattgacctgcagcggtaaaccaacgattgcgcggttgagtttcgacatcccgcttcaatggcccggccaccccaactttgtgcggatcaacctgccggacggttcatcggtgggtggtgtgattgccgaaattgaaaagtcgaccgatggcccgggttgggtgacgtttacggtggatgactgaggtgttcccaacaggcttcaaatcacctccaggcggctgcctcgaatgagacacacaggccagtaatcgagacgcacagacaagcctattttcgcagatacattttgtaacgtcctatgattgacgcttgctcgaatcgccgcagggattgggtggagtgtgtttatcacgcccttgaatccgcagcgaagaatgattcgagttcagcaaaccaatcgatttggacagacaaaaggatgcgggctatgtcattgcgtaatttatctttactggtcaccacactggcgctgttaagtgggtgtaatgcgctcgcgggcaaaaccaacatgctcagtgatgatgacgtgaaatcccaaagcgccggcgcactgggctatgccccgacagacctgagcatcgtcaaccgtcgaaccgaaggcaccaacacctacgtgctgcttaaaaccaacgacaacaagcagttcaactgcattatcaacggaggcaatatcctgaccttcggtatgtccaacccgccttcgtgtgcgaagaaaggtgaacagatcaagagtggcccgttcgggagctgatctgtcgctggaaaaaagggccaggccacctctaagaacggaggcctggcccttttttattcgctcagatgagtttaaaagacaagatatcgggcagctgggctccggcccgttcagtctgggcaccccgaacaaaatgctcagcgactactcggccgtcgccgtacaccgtttaaagggtgcggcctacagcgtcgccctggttgaaggcagcaacgaataaaccctattgatcggagagcgaccatgcacccgcataaaaccgcgattgttttgattgaataccagaacgacttcaccacccccggcggcgtgttccatgacgcggtgaaagacgtcatgcaaacgtccaacatgctggcaaacaccgccaccacgattgagcaggcccgcaagctgggcgtgaagatcatccacttacccatccgctttgccgacggctacccagagctgaccctgcgctcctacggcatcctcaaaggcgtcgccgacggcagcgcgtttcgtgccggcagctggggcgccgagatcaccgacgcgctgaaacgcgaacccaccgatattgtgatcgaaggcaaacgcggcctggatgctttcgccaccaccggcctggacctggtgctgcgcaacaatggcatccagaacctggttgtcgcaggtttcctgactaactgctgcgttgaaggcacggttcgctccggttacgagaaaggttatgaggtggtgaccttgaccgactgcacggcgacgttcagtgatgaacaacagcgcgcagccgagcagtttacgttgccgatgttttcgcaaaccctgcaacacaccgcgtttctgcaagcactgaacgccgaataaaaaaagcggcgactcctgccgagtcgccgcttttttagtgcttgggttattcggttggcgcgtactgcatttcgccgttcccaaacgaccagtcatcgcgcttcacgtccaccaggctgatccacacatcttccttgcgcagaccggtcttggcatggatgccgtcggcgatgaacttatagaaagcctttttcacgtcaatgctgcgcccggcgttccacgtgacttggataaacacgatcttgggtgtgtaactgaccccaagatacccggccgccgggtaaaccagctcatccttggcatggcggttgatgatctggaatttgtcgtgctcaggcacgttggccacactggtcatcgcggcgtacacgacatcaccgatggccgtcgcggtttcagtggaagtgtcggcggcgaggtcgattcgaactaaaggcatggacaaatccttagtgattttcagctgaaaatgggcgtgtggctcacacactcgggccaaccgggcaacttgcgccaggccaacgagctgctggcccagggcagtgccgacggtttgcgcgagtgcgccgcgaaacttcggcatttgacgcatcggtaaatggctgaccggatgtcagtgcttattgacctgaacatagactgccgtgcacagaccaatcaaacaaacaccggcgatgtagtaagcggcgcccatctgactgtattgaagcaacagagtaacgatcatcggcgtcaggccaccgaatacggcgtacgacaagttgtaggaaaatgacaagccggaaaaccgcaccaccggtggaaaagcacgcaccatcacagcaggggctgcgcctatcgcgccgacaaaaaaaccggtaagtgaatagagtggaaccagccattgcgggtgcgtttcaagcgtcttgaacaagagcagtgcgctgagcagaagcatgaggctgccgatcatcaatacccaacccgcactgaaatgatcggccagtttcccggcgatcacgcagccaacactcaaacacacaatagcgagactgttggcctgcaaggcttgcgctgcagtaaagccatagtgggtttgcagcagcgtcggcgtcatcaagataatcaccaccacccccgccgacataaaccaggtcaacagcatagacacaccgacggcttttcgatgagcccgcagcacagtgcgtaaaggcagctctgcggccacttccttgcgctgctgcatctctgcgaaaaccggcgtctcatgcagccatcgacgcagatacaccgccatcagcccgaaccctccgccgagcaggaaaggcacgcgccaagcaaaatccagtatttcttgcgcggtgtaaaaactgttgatgagggtggcgacaaaggagcccaacagaatcccggccatcaaccctgccgtgagtacgccgcaggctaaaccaatatggcgcgaaggcacatgctcggaaacaaacacccaggcgcccgggacttccccaccaatggcagccccttgaataacacgcaagagtaataacagcactggcgcccacagaccaatctcggcataagtcggcatcaagcccatgatgagtgtgggaacagccatcattaagatactgagcgtgaacattttcttgcgccccagaaggtcgccgaagtgggcgatcaccacaccgcctaatggacgcgcaaagtagccggcagcgaagattccgaatgtttgcatcaatcgcatccattccggcatctcgggagggaaaaacaactgccccacgacggcggcgaagaacacaaaaataatgaagtcgtaaaactccagagcaccgcccaaggcggacaatgacaaggttttatagtcctcacttttaagcgggcgcgagccctctggaacacccgtctgaatagagctcataggactatctctttctgattttataggtctgacgacgcggcaaaacacgggtggagtctaagaaaggctctatagttttgaacgtcagaacaatctgaaagcagagcggtactgtcgaccgtggcgcacggttaacgcgcgctcgccgatgcgtttggggggaacacgccgtgccactagcacggcgccaggttatgcctctatcgagtttgaatcattggcgattaaaccatcggcgaatggctgaccactcgcagcgccaggccctcgtaggcatccagggtgatggtgaattcaccctcggcggtcagatcaccctcgacccgttcattgatgatgtccaccaccggccccggcgcaatattgggcagctgcagggtttcggtgatcgccgtggcgccgaagttaagcgcggtaatctgcgtgcccttcccggccggcaactcgtgaaccatgatcagcaagccgggatgctcgacgtccggcaccagaatctgccggctcgcggcgatgccataggcactgcgcaccgcgaggattttttgcagctgcgaggcaaacgactgcgggtcctgcagttggtgattgaggctgccgtacaaggttttcgaacgcggcatctgccccgccgacagttcggcctccgggttcaagtcgaccaggtcataggcgccgcgatgcacccagcgggtatcgccatcggccatcaaatgcgcgacctcatccgccgccaacggcaacgcaccgaccaggtcccaacccgacaaggcaaacaccccaggctgcatggcgttgtacatcaccagcagcaaatggatctgccggatctgctcgatatcagccggtgtaatcgcctccaggtcacgaatccccagggccgccgtgatgatgctggcggtggtgcaggacacgccattggtaacgaatttgaggttatacggcgcatgctcgccggccaggcgctcatacatctgctcgcggatatgctcgcgcaggatattgccggggaacgtctggccctggtagaggtaactgtcatgggcgtgcaaggtccagaagtgcaccagttccagggtcagttcatcgtggttctgcaaggcatgaatcaacgaaccggggtcgatccccaggctgtgcatctcgcgcagcatcaggcgcaggaactcggtgtcgcccatcagcaaggcatgctggtaagccgggcgcgtgatgaagtcataggacaggtccgcgccgccatgggacatggcggcgatgtcgtcgaccgtcaggttcagctcctgaaagctgaaccctccggccttgcgaatcgcgccgccgagcagctgattgccagtgatcgacagcgggtggctttccgaccacgcgccgccttccagcttgcgctccacacccaggaagccgttggcgtccaggcgcaggatcttcgcgcccatcacatcaattgcatgcagggcgtcgccaatgatcatctgctgcgcggcaaacgaagggtccagccagttcagcgacggctggccttccttgaagtaatgcaggtacacccagcgccgtggcttgccgtccacgcccaccactaccggggttgcgctccagtcggtttccttcacacctggctcaaagaagatcacccgctgcaactggccgacgatgtaatgcttgtcgcgcagcgcatccacctgcaaggggctgaggttctgcgcgtcacggccttcggcgacatcgggcaacatcggccagtcttcctcgcggatctccaccatgtggtaaagcccggggtagtcctcatacgccatctcggccaggcgaaaatccgcgcccttgccggtgtgcgatgggatcacgtcgtcgatgatcaccgcgttgtgcgcggcggccatgcgcgtgagcgcctgcagctgcgcctcggtgcccagctgcgggtcgatttcgaagctgatgcggtcaaaattgccgtcgatggtcggcgtatgccgcgtgccggagagcccgcccgactttttcagcgggccattgtgaatgccctggatgccgattttcgacagcgcatgccacaggctctcatcccccagcgcctccagcaccgtgccgttttcgcgggtcacaatcgaggccgggtacgcggtaaaccacaccgacgacaacgcggtagcatcacgcggccgggtctgcgcatacggctgctgccacaaccggccttggcccgaatagagcttggcgcgctggcgcgccgcgtgcagcatcgattgctcaaccagccagttcacatgattgttgtccgccgccgtcataagctcgttacctgtgtgcgtgaaaaggtcattcgtaagcataggagcgacggcgggagcgattcgttgcattaacacgggcggcttatgacagaaacccgattcggtcgccaagaaaatcattcagcgcgccgcttgaacagcacctggcgaccggacggtcatgaccggtaaaagtgctggtctgctcgctataggccttcagcaccgcacacaacccaagcgacgccagcagttgcaacaggaattgattggctatagtggacagcaggtcgtgtcgttttagtttgcaggtcatttcccctggtggtcgagcattgcgtcctaagcgtgtttaaagatcaatcgcgttactgagtgattgatcacgctgattgtaaagaacgcactattagacctcgcacccggagaacctgacatggacagcaacaccaatcgctcggctatatttcgcttttatcatggcgccaaaggatggctacttattgcagctaccttaggcgtcagcgttttccccatcctttctaatgccatcgtcggcggcgtcgacgcgcccgatgaccgttttccgttcatgacaacgattcaattcaaggattccggagcaacacctctggagcgccatggttgtggcgcctcgctgatttcacccacgtgggtgctcactgccgctcactgcgtgatcgatacagagccttcagacatcgaggttgtagtcggtcgtacccagctgagcaacctacatcagggacagtctgtggccgtgaaaactattgtctcccaccctaacttcgcgcaagcgactgtctacgacatagcgctgctgcaacttgagcgcgctgtcaccgcagttacccccattaaccgagtggccagtgctgagcgattggaagacagcgagaagacagtgactgctgctggctggggcgacactgcgctccccgcaagttctgatcggttacaacaggcgtcgatgccgcgtatctcggatgccgagtgcacagcgttcaacccaagcctgaatccggacacaagcttttgcatcggtgtcctggcagcaggaggaccgtttccaaataatggcgactcaggcggtccggtatttatcaatcagcctggaacagggtttatacagttgggggttgtaagccaggccgtcgttatcgttcgcctgtccaatcccgaggtcgcacagttcgtcaacgatacagtgaagccttatgacggctggaaatccaactttaacctggtggttgcctgtctgatggggcttgtagtgattatctggttgacggtcgccagatcactgaaacgcaatcgagtcgggtagagggcgaaacaccggttgtaaaggcccgcaaacgaaaagccacgagcattaatcggcacctcccgttgcctgccgatactgcctcggcgtaaacccggtcaatgccttgaactggcgagtaaacgcgctgtggtcggtgtagccgcattgcagcgcaacctcagtgatcggcaattcgctgtgcagcaaccggtgcgcatgttccaggcgcactttctggatcatctgccggggcgtcaggtggaacacgcgcttgcagtagcgctccagctgagccacggagatcccggcgatgcgcgtcagttcgccaaggctcacgcgccggttgaaatgcgtgcggatgtgcgcgtccacggcggccaggcgctggtacgccgggtgggtttcgctggccgattgcaggtcgaccgaaatacccgccaggccgatgatctggccgtcatcactgtacagcggccatttgtgcgtcaggcaccagccgggttcgcgcgtgccgtacaggtgcagttccagttggtcttcaagcacaaacccttgctccagcacacgccggtcctgctcggtatagcccggccccaactgcgcagggaacacttcggcgctggtcttgcccagcagcggttgcagttgcttgaggccgcagcgttgcaccagcgtgtggttggcgagcacatagcgtgcgtcgatgtccttgataaagatcgcggcattcgggagcacgtccaacagcggcaacaactgcgccacgccgtccaatagctgctgcatgttgtgggggcgacgcgcctcgaataggcgtgcaaatgcgctgggcaacatgacgtgactccgcgtttttttgagcagattgccccatgccgaagtgactgtcgagcgcggcaaactgtgccgaattcgtcatttccacacgcgcaaaacatcaatccccacgccgttgatgggttcaggatagcgccactacctgcctatccaataactcacaagaaggcgccgccatgtctgctcaaggcaaattcaagaaacaactttcactgatggacctcacctttatcgggctgggcgccatcttcggttccggctggctgttcgcggccagtcacgtttccgccatcgccgggccggccgggattatttcctggctgatcggcggtttcgccgtgctgttgcttggcatcgtctactgcgaacttggcgccgccctgccccgcgccggtggcgtggtgcgttacccggtgtattcccacggcccgctgctgggttacttgatggggtttatcacgctaatcgcgttttcaagcctggtggcgattgaagtggtcgcctcgcgccaatacgcagcggcatggtttcccgagctgacgaaagccggttccagcgacccgaccaccctcggctggctggtgcaattcgcgctgctgtgcctgttctttatccttaattaccgcagcgtaaaaaccttcgccatcgccaataacctggtgagcgtgttcaagttcatcgtgccgctgttggtgattggcgtgctgttcaccttcttcaaaccggcgaacttccaggtgcagggttttgcgccgttcgggctgtcgggtattgaaatggcggtgtcggccggtggggtgatcttcgcttacttgggcctcacgccgatcatctcggtggccagtgaagtgaagaacccgcaacgcacgattccaattgcgttgatcctttccgtactgctgtcgaccgcgatctatgtgctgctgcaaaccgcgttccttggcggcgtgccgaccgagatgctcgccaacggttgggccgggatcagcaaggaactcgcgctgccttatcgtgatatcgcgctggcgctgggcgtgggttggctggcgtatctggtggtggccgacgcggtgatctcgcccagcggctgcggcaatatctacatgaatgccaccccgcgcgtggtgtatggctgggcgcagaccggcacgtttttcaagatcttcacgcgtatcgatgaaaaatccggcatcccgcgcccggcgctgtggctgacctttggcctgtcggtgttctggaccctgccgttcccgtcctgggaagcgctgattaatgtggtgtcggctgcgttgatcctgagctacgccgtggccccggtgaccgtcgccgcgctgcgccgcaatgcaccgcagatggcgcggccattccgggtcaagggcatggcggtactcggcccgctgtcgttcatcatcgccgcgctgatcgtgtactggtcgggctggagcaccgtgtcgtggctgctcggcctgcaaatcctgatgtttgtgatttacctgctctgcgcgcgctgggtgccgaccgcgcacctgactatcaagcagcaagtgcgctcgtcggcgtggctgatcggcttctacgcggtgaccatcctgctctccaagctcggcagcttcggcggcatcggcgtactcagccacccgtttgacacggtcgccgtcgcggtctgcgccttgggcatctattactggggcgccgccaccggcgtgcctgcacaccttgtgcgcctggaacacgaagatgacgaaagcgaagccgtcagcgagccacagcacaacgcgcccttgtccccggccactcactgaatggagcgttatatgaagcgcctgcacgttatcgactcacacaccggcggcgaacctacgcgccttgtgctggacggtttccccacgctttcaggcaacaccatcgccgagcaactggagaacctgcgcaccgagcacgacccctggcgccgcgcctgcctgctggagccgcgtggcaatgatgtactggtcggcgcgctgtactgcgagccggtcacgcccggtgccacctgtggggtgatcttcttcaacaacgccggttacctcggcatgtgcggccacggcaccatcgggctggtcgcctcgttgcaccacctgggccgcatccagcccggcgtgcacagcatcgacacgccggtcggcccagtcgcggcgacgttacatgaagacggcgccgtgaccctgcgcaacgtgcccgcctaccgccaccgccagcaggtggcggtagacgtgcccggccatggcgtggtccacggcgacatcgcctggggcggcaactggtttttcctggtctcgcagcacgggcaaaccctggagatggacaacgtcgaggccctcaccgactacacctgggcgatgctcaaggccctggaacagcaaggtattcacggcgcagacggtgcactgatcgaccatatcgaactgttcgcagacgacccgcacgccgacagccgcaacttcgtgatgtgccccggcaaagcctatgaccgctcgccctgcggcaccggcaccagcgccaagctcgcgtgcctggccgccgacggcaaactcgcccccggcgcaacctgggtgcaagccagcattaccggcagccaattccagggccgttatgaatgggacggcgaacgcgtacgcccgttcatcaccggccgcgcctacatgaccgccgacagcaccttgctgatcgacgaacaggaccctttcgcctggggcatctgagcccgggccttatttaactgaacgctggagttagaacaatgagcgacaacatcttcaccggttgcatccccgcactgatgaccccgtgcacaccgcagcgcaagccggacttcgacgcgctggtcgccaagggccgcgagctgatcgatatcggcatgagcgccgtggtgtactgcggctccatgggcgactggccgttgctcaccgaagccgaacgccaggaaggcgtggcacgcctggtggcagccggtgtgccgaccatcgtcggcaccggcgccgtcaacagccgcgaagcggtggcccacgcggcgcatgcggccaaggtcggtgcccatggcctgatggtgatcccgcgcgtgctctcccgtggtgcttcggccaccgcgcaaaaggcgcatttctcggcgatcctcaaggccgcgccgaacttgccggcggtgatctacaacagcccgtattacggctttgccacccgcgccgacttgttcttcgaactgcgccgcgaacacccgaacctgattggcttcaaggagttcggcggcggcgccgacttgcgttacgcggcggaaaacatcacctcccaggacgatgacgtcacgctgatggtcggtgtcgacacccaagtggtgcacggtttcgtcaactgcaacgccaccggcgcgatcaccggcatcggcaacgccctgccccgcgaagtgctgcaactggtggccctgagtaaacaagccgccaaaggtgacgccaaggcacggcgcctggcgcgtgagttggaagctgcgctgggcgtgctgtcgtccttcgacgaaggctgcgacctggtgctgtattacaagcacctgatggtgctcaacggcgatcagggttacgccctgcacttcaatgaaaccgacgtgctcagcgatgcgcaacgccgttatgcggaaaaccagtacgcactgttccgccagtggtacgccaactggtcggccgagcagaacctggcctgacccgtgcgcgccgctgtggtggtcacagcggccaaccctcttttttgcaggacgaccccatgactctgacgggcaagatgctgatcggtcagcaagcaatttccggcgatcgcgaagcgatccgggcgatcaatcccgccaccgacgcgcctttggagccggcctacggcggtggccatggcgcgcatgtcgaacaggcatgcgccttggcgtgggcggcattcgacacgtatcgcgaaacctcgctggccgaacgcgccacgttccttgaaaccattgccgacgccattgaagctctcggcgatgcgttgatcgaccgcgccgtggccgaaaccggcctgccgcgcgcgcgtatccaaggtgagcgcggccgcacttgcgggcaattgcgcaccttcgcgcgcaccgtgcgtgccggtgaatggctggatgtgcgcatcgacacggcgcagcctgagcgccaaccgctgccgcgtgcggacttgcgtcaacgccatgtgccactcgggccggtggcggtgtttggcgcaagcaatttcccgttggcgttctcggtggcgggcggcgacaccgcttcggcactcgcggccggttgcccggtgatcgtcaaggcccacggtgcgcatccgggcaccagcgagctggtcgggcgtgcggtggccaaggccgtcaaagcctgtggtttgccggaaggcgtgttttcgttgttgtacggctccggtcgcgaggtgggcattgcgctggtcaccgacccgcgcatcaaggccgtcggttttaccggctcgcgcagcggcggcatggcgttgacccaggcagcacaggcgcggccggagccgattccggtgtacgccgagatgagttcgatcaacccggtgtatctgttccctgcggcgttgcaggcacgggccgaagacttggcgcaggggtttgtggcctcgctgacccaaggcgccgggcagttctgtaccaacccaggtctggtgattgccgtcgcaggcaacgcacttgagcgctttatcgccacggcaagccagctgctgccagggtgtgcggcgcagaccatgctgacgccgggcattttcagcgcttaccaaaccggtgtcggtgcactggcacagcatgcccaggttgtcgccaccggcgcggcggccgttggcccaaatcaaggccaggcgcacctgttcgtgactaaggccaaggcgtttttggccgatgagcacctgcaaggggaagtcttcggcgccgcatcgctggtggtggtgtgcgccaacgacgacgaagtacgccaggtctcggagcacctggaaggtcaactgaccgccacgctgcacctggatgaggatgacctggtacacgccaaagccttgctcccggtgctcgaacgcaaagccggccgcctgctggtcaacggctggccaaccggcgtggaagtgtgtgacgccatggtccacggcggccctttcccggccacctcggattcgcgcagcacgtcggtcggcacggcggcgatcctgcgcttcttgcgcccggtgtgttatcaggatttccccgacagcctgctgcccgacgccctgcaacacggcaacccattgcggttacggcgtttgctcgacggccagagagaggcctaggccatgcccgattccaacactggcgatatcgtcgtggtcggcgccggcattatcggcgtggcctgcgccctgcaattggcacgacagggccagcgcgtggtggtggtcgacgcgcaagcgcccggcaacggcgcctcctacggcaatgccgggcacctggcgaccgagcaggtgtttcccatcgccgatgtgtcgattttaaagcgcctgcccgcaatgctgatggacccgatgggcccgctgcgcctggactggaaatacctgccccgcgccctgccctggtttgtccggctgctgctgaacctgcgcccggcgaactaccggcgcacagtcgcaggtattcgggcgctgaatgaaagcagcctgggcgcctggcaacgcttgctgcactccattgaccgcgcgcagttattgcgcgaagacggttcgttgttggtgtttgagcgcgccgaatcgcgtgaggccatcgatgccttgcaacagcgcatgcagcaacaaaacgtgccggtggccttctggtcaagcagtgatgtgcgcaaaacagcgccgcagttgagcgacgcgctacaaggtgggttatttttccccggcaccgggcattttctcgacccgtaccacgtggtctgcgaactggttgaggccgccaaggccgaaggtgtgcagtttctcaagcagcgcgtcgtggacgggcgcctcacgcccgatggcgtgtcgctgttgactgatcaaggcaccctcactgcacgccaggtgctgatcgcctgcggcgcacactcggccaaactcactgctgcactcaccggcaaaacagtgccgctggacaccgaacgcggctatcacttgatgctgccccaggagccacagcgcctgccctttgccgtcacctcattcgagcgcaaattcatcatgacgcccatggccggcggcctgcgcctggccggcacggtggaattcgccgggctcgaacgcccggcaaacatgcaacgtgcctggcaactgcaccggctgagccaggggctgtttcgccacgacctcagcacgcaaggcgccacgccgtggatggggtttcggccttccctgcctgactcgctgccgatcatcgaccgggtgtgcgacggcaaggtgttgctcgcctttgggcaccagcatctggggttgacgcaggcggcggtgacagcggaaatggtcgcgcagttggccgctgcgaatgcgctgggtggcgagctgccgccgttggcagcgtatcgtttggatcgattctgagaaaaaccggcagctacgagtattcagcagcgggcctgggatgcagccaataaatcatccgccatctgctgaatctcctcgcgcatccagagcgtctccagccatcctgccggaatgccttgaacgccgtagtaggcccccgccaactgccccacgatagcggccgtggtgtctgcgtcatcaccgaggttcgccgcagcgagcacagcctcggcaaaactgtcggtgtgctgaaagcaccagaatgcagcttccaaagaggccaccgaatacccggaaccgacaacgtcatcacgagatttgtgctgatactcgccggctgcgattgccagcactttaggcgccgtcaagcctgatccagagacctgcaagactgcattcttcgaggcgccgctcaaggcattgctgatggcttgcgccagcaccacgcagcactcgattgcctcctgggccgcgtgagtcgtgcgggagctttcgatggcgaacttacgcacggtttccgggttgggaaagaacaacagcaccaccggagcaaggcgcatcagcgaaccattgccggcagaatacgggtcggtagagcccgaaaatgcatcgccgctgccctcgaaccgtgccaatgcctcacgcacggtcatgccgatatcaaagcagtctccggtagaactcaagtagccccatttccaccagttcagataccggcccatctgatccttcgcgtcaaaaccagccttgcacaacaggctttcagccaggcacagcgccatcgatgtgtcgtccgtccattggccgggcttaaggttaaacggcccgccgccgaccatatccgtcaccggcgtaaacgaaccgcggggcataaactcaaccgtggtgccaacggcgtcaccacaggccaaacccagcaaactgccgcggtagcgatctgaaagcgttatagacatcggcactccttgataagtattcgtccggtaaaaagccatccgtgcccatgctacttgaccagccgcttctccttggaggggcgatatccgaaatacgcgctatagcacttactgaaatgactcggcgagacaaacccgcacgccaccagcacatccacttgcgacagctcggtgtgctgcagcaaacgccgcgcctcggtgacgcgcaactccatgtagtagcgttgcggcgtggtgcccagttgttccttgaacaaccgctccagctggcgtcgggagcggccggcataaaccgcgagttggtcaagctccaggggctcttcgaggttggcgtccatcagcttgaccacttcacgcagtggcgcgctgacgcagacgttttccgtgggtttgatgcgccggtaacgcgactcttcgaacgacaggatgtcttcgatgccttcgaccagggctttgccgtgcaggcccttgatccagtccagggccatgtggaaggagcccgaggggctggaggccgtgaggcggtcacggtcgatcacaaaggcttcgctggtgacctgggcggccttggcgacttccgccagcgccgggcgatgttccggatggatcgcgcagcggtagccctgcaacagcccggcgcggcccaggaaccacgcgccattccacaggccggcgaggctgacaccctgttcggcgccggcgcgcaacagctggatgagttcatcgccggctttgagttcagtgcgaaaacctccgcacacaaccaacaactccagctcgcacagcgctgagagctccaggcgcgcgtcggggcggatcaccaggcccaggtcgctgatgacctcgccatcgccgcagccgaaggtacgcgtggcaaatagttcggggcgcagcaggttggcggtgataagggtgtcgagggtctgggtgaatgcgggcagggagaagtgctcaagcagcaaaaagccgacacgcgtggcggcggccggctgctgtggggtttcattgaggtagcgcaggttcttgccttgcatgccaccgctgaactggcgtctttccatcgaggcttagcccactcttattattgatgctgtgggcgccatcttagaggattgcggcaccaaatcggcgaaatcgtggcatccagttatccaggatctgcgccgaagccagcacatggtgcgcccgcccgatcagcaggcggcgtggcacaaagccgatgtagcgcgaatctgcactgttatcgcggttatcgcccaacatgaagtagctgtcggcgggtaccacgacggggccgaaatcccgcagcgcacgcaccaccggcatgaattgcacggtgcgccggctggtattcgcctgctcagtcagcttgatacccggcacagactggcctggcacaaggggctcgttgatggcctgctcatccgagtaggtggccggcacaccattgatccacagcacctcgttcttcatttgcagcgtgtcgccagggatgccgacgatacgtttgatcaagcgcacaccgtctttaggcgaggtaaaggtcaccacgtcaccgcgctgcgggttatcgagcttgagcagtgaaatatccgtgagcggcaccttgaggtcgtacgcgacgcggttcaccagcaccacatcgccttccaccagggtcgggcgcatagagccggaggggatcgggttccagtcggccaaggaggtgcggaacacgccaaaacacagccagaaaaggatggcgtaacggtatttgctcaacagacttcgcatacatcctcgcactgcaaaagcggcgcagagcaggctctacgctggccaaggtcattttttgaaacattcacgcttgctgatgaagattacattaaggcttgcccatacacctctacgcgcgggcgttaagcgctgatcttcataaacccgcgcgcttcacaagcccgtagtcaaggcctcacgccgccatctgatacggttttttctttgccatctgcgtctgtatcgaaaacggtttggggcggacaattggcgcattcccgacacccttgtcgagtgcggcaggaaggttcctgtcgccccttcccttcggaggccttatgaccaagatggcaattttcctgttcggctttttggtgctgaccatcggcattggcttgttggcgactatctcgccggtctgagccccgttcagcggaacgtcaccatttcgaaatccgccgaagtgcccgccgcctgcgccgccaattcgctgatcgcaatcgtgcgtatctgcacgccttcgttccaggggttggtgtagctcagcaggccgcttgccgggtcgatatggataatcgcaaacgcatgcccgtcgcccttggaccagtcaccgttgcgtgccggtttaccgccgaacacaatcgcagcgtggctgccgacggcactggcgtgactgagcagaaaccgcgtgatgtcctggggtgagctgtgtgcatcggccaggcgctggtggtcgccatagtggccggccaacagttccatgactttattggtcggcagcgagcccttggccgggtcgagatgaaagtactggaacatcgccccgaccaccgcagccgcaggcgcatcgcctttgccgtactggtcgaggtcgccggcttgcaggtggaacactgtcgacggtgcgcccggcaggctgacgttatagctgccatcggtattcaaggcgacgccgcgctgcaggatccgggcgcccgcctgggtagtggagaatgccttgaccacggaaatcccgacgcagtcaccttcgctggtttgattgaggtgagtgccgatcggctgcgtgatcgggttgccggccagtgccggctgccatggtccggcgtcgatcacactgcctttggcatcccgctgcaacgcgtggatgctgccctcggcgctgtaactgccatcgctgagtgaaacgacgatgtttttcacgtcagtgttgaggttgtcgcgggcaccaccatcacgcgccatggaagcctgaaaggcctgggccgccgtagtgatgtgttgacgcgtttggccatccgggcgagcaccacggctgtgatcgagttcggtgagcagttggtggtaggtggtttcgatggcgcggatgccgacagagttgtcggcataggcagtgacggacgctgccatgagtacagcaagggcgagaagacgcttcacgctcgggtatctcatcggaggattttgaagcgatacctcgaaccccacaccggttcaaccgcttcgtgctgcaacatcccgtagcaggccaggcatacagcgccgagcatgcaatagcccgccaaaacccgtcaatggcggcaaccggctactgcttcaaccgaagagcatcgggtacagggacagtaccaacaacgccgccatcgagccgttgaacaccctgacccagcgcggttcgcgcagcacattgcgcaggccggtgccacagcccacccagacacacacgctgggcaaattgaccacggcgaacaccaaggcaatcaccagcacattggtgacataaccctcagctggcgtataggtggtgatcgcgcccaacgccatgatccatgctttggggttgacccactggaacgccgcggcgccgaggaaagtcatgggcttggcgtgcgcatcactgctgtcggacatgccgcctgcggtggcgattttccacgccagatacaacaagtaggccgcgccgacataacgcagcaccgtgtaggcccacgggaacaccttgaatacttcgcccaggcccaggcccaccgaaatcaccaacagcatgaagccaatgctgatccccagcgcgtgaggcatcgaacggcgaaacccgaagttcacccccgacgccagcaacatggtgttgttgggccctggggtgatcgaggacacaaaggcgaacagcacaaaggctgacagcaggctggtggacatgaacatggcgcggcatccgaacggcagtggtatgcctgcgacagtagtgggttctggcgccccccgccccgtacagctatgggcggatcgaggaatacactttggccttgtcgagcagttcacggcagtggtcgacggtttgctgcgtagactccaccatcggcaggtgccctatgccgtcaagaatcaccaggcgtgcatggggaatgcccgcgagccaggtgtgcgcactggcgacgggcaccatgcggtcctcgcggccccacaggatcaggctcggcacgcgcacctcaggcagccagggttcaatgcgcgggctgtcggaaaaattcgcaaatatctccgccagttcctcacgtcgcttgatatagctttgcgcctcagccgccagcaatacctcgggtatggacggtggcgcggccatggtcatggcaaaaaaacggtcgaactgcgcacgcgtgtgaatcaggaatgggttatcacccctgttgaccaactcttccacttcattgggttgcggcaggttcacccccgcggccccaatcaagcccagggacaacacccgctccgggtaatgggtggccaaccagctggcgacatacgcgcccatggaactgccaatcacgtgcactttgtcgacatggcacgcatccagcaacgccaccatccgccgcgcttgcgccgcaatgctgtagtcgccacccggcacaaaggtatttttaccgtggccggcaaggtccgggataatcacccggtagtcatcaacaaaatgccgggcaaacccgagccagacgcccttgtccgcgctgaaaccgtgcaacagcaacagggctggcgcatggccgcggccgccttggtaagttgcgagcgtcatgcccttgatcggcagggtaacggccttcaaaccagaccgccgtgcttccacccaggcgatcagttcaaacagcacattgccaacgcgtgggtaggtccaccacacccacaacgcaacgatggcaagcacgccgacgatcacaagcatcaaggtttctccgacagtggcgatgggattgctttcactgaccggtatacttgctcactgcgcttgaatcggtgctgaacgcatcacaaaaggacagggaatgaaggtcatcaggttcttgctgattgtgctgctggtgccctttggcagcgacttgggcttcactatgaaaagccgcgccgggtgttcacacgcaagtttgtcgcactctgtgtgatggtggcggtgctggagttactgatcctccacgacatctacaacaaataaccccgcctcaccggttaaaacagttcccgataacgcgccgggaaccgtttattttggctcgcaagtgcgtcactcagttttgcgggcgttgcttggtcgagtccagttcggcttttttggccgttgaaatttcggtgatctgcgcagacttggcgatggccatgtcgaacgtgtcctgcatttttgcgatggcgtcggtcgccgtgcccttgagcccaccgttggccgcccaatcgaagttccacacgccggacaagttgtcggcgccggcgacgtcgtgggtttcgatggcagtgaacacatccgggtgtttttccatgtacttggccgcatcggaaacgtctgctggcaccttacccgaggcattgttggccaactgcgtcagctcctgcttggtaatggccgacttgcccgtctggcgcatgtaatcggcgattaccttgctggacttggcaatgttcaacttgtcgtcgaacgtggacggcgaggactttggcgtgttcgacccgccagacgcgggcgttacggtagtagacatcggcgctgctccctcaatggaacgaatgaaatcgtcgtgctgacgataccccgacgcggacgttagcatgggcaaagggccattccccatgcttcacaacatttcacaacggcaggctgattttcgcagcattttccgctgccttcccggccggcgtcagtcgtacttcggcggtggcggcggtggtgtcggcgccctggtcggtcgcacgtttcggctcttgcctgaattgatgtttgtggcatcgcgaaaatattttcggtctatgactgtcgtctgagttggctgttgatcattcattgtatgcctccggttttgacttcaaaaattctacccattgcacgtctgcattagcgataagcaatcgagcggtgtcctgtacttcaataatctcgccctccactacccaagctggaaagcccatcaaaaaatgccctgcctgagggtcgtcgggccaaacatccggatagcccattaaccgccgaccatccctcatatgcagtacaccccatcgatcaagatttcgcgaaaaggcaaacctccattcgctgagcgaagcttttgacgtgaaccccaagcgtctcgccaatcggtacagcgcgtcctgatgagagagaaacgcaagcgtcaatcccatcgtcacagccaaggtcactgaccaggcagtgcctgtctggtttgtccagtgccctaacgaataccagcgcccgatgaacaggcataccgcctcaagactcgccaccaacagctggatcacggccgtgcacatcaacgcctgaatgactctttcaaactgagtgggcttgatggcgtcagcgagccagtaaaaaatcaccgtagccacaaagcctgatagcaaagactgcacaacctgcagcacctcgttgacgatctcgttcattccattgcccgataaatcccaaagtcagctcacagggtaggcaactaatcgtcaacaggggactggccaacagcgcaaaaacgcagttagagaaatttcgtacgacacttagcgaacggactcgggataggaaccacggacgcagcagcaatcagcggctgctgcgctcaacccttaagcaagtaagcaaacatatgcggaacataatcagccttgcccaatggcacaccgttatgacgcaggatgttgtacgccgtcatcaggtgaaaatagaactgcggcgtgacccaattgggggcgtattcgtcgccggtcatctcgaaggcgatgccgttgggcagttcgatgacaatagattcctgcgcgcggcgctcaatcagggcacgatcagcagctgcgaggcttgccagtgtctggtcgatcagcgcaaccgcgtcgctcatcgatgtcggcgtctccagcgtggacaacgcgtgcccactgagccgatctaccgcctctcgcgcctgtgtgcaagcgtagcgaacctgggtcgccagtgtgtgcatatcaggtgcaaggcgtgaatcgagcaggttctgcgggtcgaaagccagcgccgctgcgtgtgcctggcccttggcgagcaggcctttcagcgagttcaacatctgggcgaaacagggaaccgtggtgttatagaccgacatcgtgacctccttgtctatgattaaaaacgcctcaagtggcgcgcctatctcgctggctcaccagcccttcaagcgtaaagcgtgcctgtgtcagcaccacctcctgcacgatttccatctccttctggctcacctccgcccacttcagcgcttcgagcagtttgggtttctgcactcggaacgccaagccttgggtgaatagcgccattgagtgaatcaccgtgcgctcgtcctctacggcaaagcccgacaaatgcgcgatcaattggcggataacccggccaatgcgcgccttgaagcggtcttcaaatgcgctagtggcgctttccgggcacagaccggcttggtggcgatcaagaaatgcacgccacgccgtggtctgcgggctgtcctggatagtcgacacgaccgtgccgaggatgcccaacgacacgtcgatcaaggttttatcctcggcctcaaggtctgccagcgcgttctctgcagcttccacgcaagggcccatcttgcgccaaagcaacgtgatcaaatgctcgacacacgccaggtacacgccttccttgccatcaaagtagtactgaatcgccggtgcgttgaccccggccgccgtggcgatgtcgcgcgtggaggcgcggtcgtagccgcgctcgccaaacaccacgaccgccgcctcgacaatacgcgcacgggtttcttcgccacgctgataaccaccttcggcggcaggtttatgtcgtgccatgtgcagctcctttcgaataccggaccaaaatataccagttgacaaaaattcgcgaaaaatggaatttattccaactgttataaatctggagtgacccgatgtccgctgcacctccctcccctcaggtcattcctgaagacaccgtcaacggccaacgcggcaaggctcgacgcatactgctcacaattgccaccgtcgcgctgttgatcggcctgggctgggccgcctggtggtggctcaccgggcgctttatcgagaccaccgacgatgcctatctgcaagccgacagcatcagcgtggcgcccaagatcaatggctatgtcgccgacgtgctggtgagcgataaccagaacgtcaaacgcggtgacgtgctggtacgcctggacgcacgcaaataccaggccgtgagcgacgaagccgcggcgacgattgccgcgcgcaacgccgattacgccaaggcccaggccgacctggtgcaacaggactcgaccattgccgaagcccgcgcccaactgcaaggcgccgaagccgatgccaaacacgcgcaaaccgaggtcgcccgctacgccccgttggcacgctccggcgccgaaccggaagaacgcctggcgcaactgaacaaccaactggcccaagcgcgcagcaccgtggcggccaagcaggcggccttgcgctccagccagacccgctacggcacgctggaggcgcaactcaaccaggcccaggcgcaactcggcgtggccaaggccagcgaagcgcagagccaattggacgtagatgacgccgtgatccgcagcccgctcgacggtcgcgtggccgatcgtggcgtgcgtgtcggccagtacgtacagcccggcacgcgcttgctgacggtggtgccgatcagcgcgatttacctcaccgccaactacaaggaaacccagatcggtgcgatgcgccccggccaatccgtcaccgtgcacgtggacgccctgcccggtcgcgacctgctgggccatatcgatagcctctcgcccggcaccggcgcgcaatttgcgctgctgccgccgtcgaatgccactggcaacttcaccaaaatcgtgcagcgcgtgccggtgcgtattgccctggatgtgccggacgacgcacgagcggcgttgatgccgggcttgtcggcgaccgttgaagtcgacacccgcacccacgccgcggacgccaatcatggctgaggcactcacagccgaggtggtcgcagaacaaccgcgcaacgcctcgctgaccgactggatcgccgtcgccgccggcgcactcggcgccttgctggcgacgctggacgtgtcgatcaccaactcggcactcccgcagatccaggggcaaatcggcgccaccggcactgaaggcacgtggatcgccaccggctatttgatgtcggagatcgtcatgatccccctcgccgcctggctgacgcgtgtgttcggtttgcgccgattcctgatcggcaccgccttgatgttcaccgccttttcgatgttctgcggcctctccaccagcctcggtgcgatgatcgcagggcgtataggccaaggctttgccggcggcgcgatgatccccaccgcgcagaccatcgtgcgcacgcgcctgccgccacaccagttggcgatcggcacgacactgttcggcatgacggtgatcctcggccccttgctcggcccggtcatcggcggttggctcacggaaaacatcaactggcgctggtgcttctttctcaacctgcccatcagcatcgccctgatcaccttgctgatcactggcctgcccactgaacgcatgaacctgcaacgctttatcagcgccgactggctgggcatcctcggcctggccatgggcctgagctcgctcacggtggtgcttgaagaaggccagcgcgagcactggttcgattccctgctgatctgctggctgagcatcgccacggtgaccggtttcttcctgattgctgtcgggcaattcaggtcgagtacgccgatcctgcgcctgcaattggtgctcaacaaaagttttggcagcgtgctgttgatcggcaccgccgtcggcgccgggatctacggtacggcgtatctggtgccgcagttcctgggcatcctttccggctataacgcccagcagtcgggctcgatcatgttgctgtcgggaattccagccttcctgctgatgccgattctgccgcgtatgctgggccgctacgacctgcgctggatggtcggtgccgggctgttgctgtattgggccagttgctttgtcgacacccaattgacggccgacagcgtcgggcatgattttgtctggtcgcagctgctgcgcggtttcgggcagattctggtgatgatgcccctgagccaattgtccatgcgttcggtcgacacccgcgacgcaggcgacgccgccgggctctacaacatgtcgcgcaacctcggcggcactatcggcctggccttgcttggcgtgctgatggaccggcgcagccactttcatgacgacatgctgcgcgaaggtatccaggccaacagccaattggcccaggaccacatggccagcagcgccgccagttacctcgcgcaaaccggcgatgcgtccacatcgcaattgcaggcgtttgcccaactcgccaacgacattgcgcggcaagcctcggtgatggcctacaacgactcgttttatgtactgggactcgcgatgctggcgtgcctgcccctgatcttcatcctgaaaaagcgcacggtacaacgatgactcctcgcacccttcccctgctcttgaccgtcggcctgctgtccgcctgcaccgtcggcccggactatcacggtgcgccagatgtcgcgccaaaaaccctcgcagccgggcgtttgccgcatgcccaaagctccgcgccaaacgcgcccgctgtcgcgcagtggtggagaaccctgggcgacacgcaactcaacgcgctggtcgaacaagccctgcaaaacagcccggacatcgccacggcacaggcgcgcttgcggcagtcccgcgccagcctcggcggcgcacaggccaacgcgatgcccaaagttaccggggacgcggcgatgctcaagctgcgctcgcccgacacctccgcgctgggtggcaacagtggcggcggccgtggcccgctaaacctctacctcgcaggcttcgatgccagctgggaagccgacctgttcggcggcacgcgccgcgcagtcgaagccgcacaggcagaagccgacgcctcgcaagcccaactggcggatgcccaggtgcaactggcggccgaaatcgtccaggcctacaccgacctgcgcgaccagcaagcgcgcctggcgctggtagacgccagcgtcgagattgaaaaccaggccctggacctgacccagcaacgccgcgagcgtggcgtggcctcacagctgcaactggaacaagtgctcacccaggccgaaaacaccaaggcccaacgcctgccgctgcaagccgccatcgtcgaatccctcgaccaactcgggttgctctgcggcctggaacccggggaactggatggccagctcgccagcgtgcgtgccctgcccgccattcccaccgccgtgccggttgccgacccagccgcgctgttgaaggcccggcccgacatccgcagggccgagcgtcaattagcctcgagcactgcgcagatcggcgaaaaaaccgctgattggtttcccaaactaagcctcatgggtgacctgtcgttctcggccggcgaccctgggcacctggcacgcaaggacaacggcacgtggctgatcctgccgcgaatcacttggaacgcactggatttcggccgcgttgccgccagcgtcaaaggtgccgaggccgggcgcgatgaggcgcttgcgcagtacaagagcgtggtgttgagtgcgttgcgggatgcggacgtggcgttggcgcgctacggccatcagcgccagaacgtggtgctgctgcgcaatgttgaatcttccgccgtgcgagcggcggacctgacgcgccagcgctatcgcgcaggcaccgcaagtacgctggattggctggatgctgaacgcacgcggtatcaggcgcaggagagtcggatatccggcgatgcagagttgctcaaggattttgcctcgctgcataaggcgttggggcttggatggacactgtgaacaggcgattgccaggaaatcatctaccatgagccttgattttggcggctgaggctgcccattttcgtcccctgcagaggttcaaccatgaatgccccagtcatcctgatcaccggcggaagtcgcggcgtaggcgcagccactgcgcggcttgccgccgagcgcggctacgatgtagcgatcagcttcgtgtccgacgaagccgcagctctcgccgtggccaatgatgtgaaagctgccgggcggcgcgccctggccatacgcgccgacagcgcagacccggagcacgtcgccgctttgttcgccgagatcgaccgtgagttcgggcgcatcgacgtactggtcaataacgcagccatactggggctgcaatcgcgcctggaagacctcgacttcgcccggatgcaacgtgtcttcgcggtcaacgccatcggcccgatgctgtgttcgcagcacgccatcaagcgcatgtcccatcgctacaacggcaccggtggcgtggtgatcaacatttcctcaggcgcggcacgcctcggtagccccaacgagtacgtcgactacgccgcctcaaaaggcgccctggagtcctttaccatcggcttcgccaaagaagtcgcacgggacggcatccgcgtaaactgcgtccgccccgggcacatctacaccgacatgcacgccagcggcggcgagcctggccgagtggatcgagtgcgggacacgatccccatgggccgcggtggacaacccgaagaagtggcgcgggccatactgtggctggccagtgatgaagcctcgtttattaccgggacgtttctcgatgtcactgggggcaagtgagaggaaaggatgccgatgcggcttatgatggtgctgaagaactcgggcggggaaatagatggacgacttgatacaagggctcgacgggccgaggacggctcagcaggagctgttctatgatctcgaggatgcggcggcgattatcgggtggtcggtggttgagctgacagccatggcggccaacgctaaaaccccggccgaggcggtagcgctgatgaagataggcgcgttgctgaccgctcagcaggcaaagatcggcgtgtatgccggggaagttaaggaacaacgcattaacagggcagaatgcggcctgggctgataacagatgaccttgacatgcgcgaacggctcgcgggattggataacatcaaggaattaagcttagacgaacattgcatgacagcataaatttataatcgcggtaatttccatatgctaagatcgcgaaaaaataagtgcgacagttagcggtcctacctcgagttttataataatgaaatcaagcgactcgctgtacctttcaaaactggatcacctgcgttttctcgcagcgctgttagtactggcttggcatatcatgcgacatcaacttcaagtccccaccacgtttatcccaagcttttggccgatgagcctgtttgcagaagggcataccggcgtggcgctgtttatggtgttaagtggctatatattcatgacactgtgccatgaccgagaaatagactacctcgccttcatcagaaatagaatactgcgcattgcaccgctgttcatactctggacgctcctgtacttctacattggcaatatcgaccccgccaaactcattgttgccgtcggtgcattgcttgatcataaaaccgtgcccggggtgggctggacagtcattgtcgagttccagttttacctgctgtttcctttcctgcttatattttcacgaaaaatggggcttcgttacttagttggcttgatcctcctggccgtcgccatccgttggtgcatctggtttacgctcggcaccgtgcaagacctcgcctactccacgatattcggccgtatagaccagtttttatttggcatgctcgcgtgtgcggcacttcgcaagttccccgcttatttcaaatcaccgttggttttattagcactcgtggcgctatggtcattcctctaccatcgctttgatgtgctgggaggctacttcgacaatcatggcttcccctcgcaggcctctgtctgggtttactttcccaccctggaaggcttgttttacggcctgataaccgccgcctacctgggcacggtgcaattactccccagggtgctggacaaggccattgcgtggctggggatgctcagctactcgctgtacctcaaccacccgtgggcgattgaggtagccatgaaaatcctcaagcgatttaacgtcgacatgacggatttctggacagcattaatcctgggcatggcgacggtgctgcctatcctgatcgttatgtctgcgggaacttattacttgattgagaaaccgttcctgtcgctgcgcacgcgctatttaaaaccggttgtggcacagccgaccgagcatacaagccctgtaagccagcaactcccggcataaaaaaggacggcgttatgtgaataaacataacgccgtcttgttcattcggctgcaataaaaacgcagcggcttcaggccagaactatacccccccgattttacttaaagaggacgctggatattatttttatagtcatactcaaacctgtcgccatagatagattttacaaccagcaaaaaattcaaatcatcttttaacgcgctttccattttcaacgtgttgaacgtacaccgcgcaggcgcattgacaggggtctcaatcaaacccacctcttcgccgactttaagcgaatcgttcggtctcggccctccgactataagacaagacaggtccaggccaagcggaactgccgcactcccaaactggcctattcgaccttccgccaccggcttgccatttaccgtcaccttgagcgcttctacgaaagccggtccagttccattattaataatgtacacgccccactgatccgcccttccatcaatcttgaaataggcgttaagccgcggctccagggacacgtggttatgcgcacgctgaaggtacccctgccaagccgaaaaccccaaggcacacaatgcaataaccactgttgccctattcgcaatcctttgatccatcgttcattactcccttgaaaataccgaaaccacccgaaacccactgtcgtccgagcggtacacgcaatccacctttctggcgcccaataaaaaaccccgtagacgttaatctacggggttttcaagagtggaggccgaggtcggaatcgaaccggcgtaggcggatttgcaatccgctgcataaccattttgctactcggcctcaaacgatcaatgccctgactaccgacattcaccgcataaaaacttgagtgggctacaaaaccctgcctctactctaactcattgaatacattgaagtttttaatgcttcgttgcgttcgatgggcgccattatgtactcatttgcttttgcctgcaaccccttgatttcaaaaatatttcgtattggcatcaaggggttgcacgcctgccctactccttgatgagcagttgctgatactgcgggtcggccttgatctgggcgtcggtgaagggcagcgggcgcagttttttctctgaaaacgcttgggtctggtcctttgagtatttcgattcagggttactggattcggagaatgccagcacgccaagggcttgagggccgttgtcgtcgaaggtgacgatttgcaggtagctgctgccgctgaccacttcacgtttgccgtcggcgcggggcatggtttgcatggcgttgtagatgcccagttcctgcgggccgccgtggattggggtttggccagagacctgaatatcgccccagtgggtcaggccgagtttactcacgtccgctgtggaggccagcatggcttcgcgcagggccttggcgaccggctcgcgctcgatggcaaggccgcgcggtgtggtcaggggttgggccgggtcgaaggcgacccgccaggcgtcggggagttgctgcaggtgctcaaacaggttgatgaaatgcaccaggcccacgccactgtcgaggttggcgcgctggtcccaggctttcaggctggcacacagtggttgcaaggccacagcgtcggcgccgaggtgtttggcgcagaacgccagcaaatcgggcatgacttggccggcgaggtaaacctcattgtccatgaccatgttttgcaggtcggccacgctgatcggttgcttctccagggattgcaggcgttgtacggcgaaacgggcacgtgggccaagcccgatgtggtcctggctgatcaccggcgagaagccggtgagcggcgccttggggttggccagccacgccgagtcgttggcgtgctgcacgtagtcggtgcgctgcagttgcggcagttggtcggcggcgaagatgccaggctgcgcggcacgcgggtcgacatcccaggcgcaggcactgtgggcgccgtcaagcatgatcagctgcagcccggcccgtgggtcgctgcattgcgcgagtttggcggcgctgacgttgggcaccaccgacaggttcatgtacaggctctggccctggtcgtcggcggccaccgtgttgacccacgggatgccttgcaacgtgtgcaccgaggtttgcagttccttgaggctagtggcttggttcatggcgtaccattgctgcaacacgcggtcgttgcccaggttggcgtcgcgcaggctaaaggcgtagtggttgtcccaatcgagcttgccaggccattgcaccaccgggccgaactgggagctgtacacagtatgcggctgggccttgaggctgccgtcggcttgcttgacctgcaccgtcagcgtggttttctccaggggaatagatttgccgtcgagcaggtagcgcgtcgagtccttgggatccagggtcaagcggtacagggtgaaatgcttggaggtgtcgacggtgtgggtccaggccacatgcctgttgaagccgatattgatcaccggcaagcctggcaacgctgcgcccatcacgtcgagttggccgggaatggtcaggtgcatttggtaaaaacgcatgccccccatccatgggaaatgcgggttggccagcaacatgccacggccattaaacgaacgatcacggcctacggcgacggcgttgctgccacggtcgaagctgaagcgctgctgattggccgcggccaactcaaaggcttttacgccgggctgcgtactggctgtggtttgaggcggtgtggcgcccaccagcgcttcggcgaattggccgacaccgccttccaccagcaacctgcgggtgagcttgaccaagtcttgcgccacgagcgggcgaacccacgccgcctggcactgtgcaggcgcgccctgctctttcagataacggttgtagcccgcgacgtagccttcaatgcgctgctggatctgcggtgtctgggcgttccagaacgcagcgactgcatccggtgtattcaaccaggtgaaaaacacatcgctggcgaggttgttgcgctcttccagggtggcctgttcagggccaaaaaacctggcgcgctcgccattcaccgtgaccacttcattggccagcaggcacaggttgtcctgggcatacgcgtagccgatgccgtagcccaggctacgttcgtcatgggcgcgaatgtgcggtacgccgtaggtggtgcgacggatatccgccgaggtctgtgacacaggctgccccacacaggctgccaggctcaggcccagcaatacccccgtaacacacgccctggttaccctgttgaaaataatcacatcgactccacagtcatattgaacaccctcactgggggcaactaccccaccgtaaggacgcaaaatatcgggcgtgatttagtcgcgagcggtatctatttgcgtcatcggcgctgtgacaaatctgataccgacaaaatttctacatccggcacttcatgattttgctcgctcgttcgtcttattagataagagcgccatcattttcctgatcaggctctgataaggagttttttgcatgtacaactcgcaactgcccacggacggacacacacctgccgccgaggccaatttcggcggcggcgcacaagcgttcggcaaagcgcccgaacagcaaggcaaccagcgtattcgccatttgctcaagtgtttcggtttgcgcaccagcctgattcggctgaaggtcatcgacgccctgctcaccgctgccgacaaccagcgcaccctgggcgtacgcggcgtgcacagccatttgctggagctgggcattccgttgtcgtttctcagcgtgcgtgaggtgctcaagcgcctgtgcagcgagggcgtgatcacgctcaatgcggataaaagctacagcctccacgaagaggctgccaaagtgctcgacagccgcgcctgagtcacactcagaagttaggcttgaccttgcggcgcatgatgccgttgatcaccaccacggtcaccgccacggcaatggcgatgtactggaacgtcttctcgctgataaccccggtgttctgcaggtaggacaggccaaacatcgtccccagcaccacaagggaaatcagaatcgaatatttcaaacgttgcttttgggtcatgacgggtttcctgaacctgataaatgtatccgctttgtatcgtcgagcatgccaagcacatacccggttacggggatggatgcgggtcgacagggtcatatgttacaggcgatgaaaagctttggctcgtcccacgcctgattgaccctgtcagtaccctagaggatgttgaaatgcttcgtcgaatcacactgctgattccattgctgatcatgctgagcatgagcggctgcttctttttcccacacggcggcggtggcggctggcacgaccaccgctatgacgacggccgaggctacgagcaccgctgatcgtgcctgcgtctcgctttccgggctggaaagcgagacgctcagcccgcgtgcacccagcgctggtgcaaccaccgggcaaacgcgtcgagggcaaagcccagcagcccgatcaacagcaccatcgccatcaactctgaatacgccagacggtcacgcgtgtcgagaatgtagtaccccagccccgcactgaccccgagcatttcgcacggcaccagcacaatccacaaaatgccgatggccaggcgcacgccggtcagcacatgccccactacgccgggaataatcacccgacgcagggtctcccagcgtgttgcactcaagctcttgctcaattgcaaccaacgcgggtccagctgacgcacgcccgcagcggtgttgagcatgatcggccacaccgcagcaaaggccagcaggaagtaaataggctggtcgccgacgcccatcaacatcaccacgatgggcatccacgacagcggtgaaatcatccgcagaaactggaaagccggcgtggttgccgcctccaggttgcgcgaactgcccaccagcaaccccagcggcacgcccaccagcaacgccaggaataacccgacgaagatgcgtttcaggctcaccgcgatatgcacatacagctcgccgcgcccgagcagttcccacaggctgctgaaggtcgccgccagtgagaagcgcgccgacaaaccgtcggcgtcgccaaacaccttcacccccagccaccataaaaacagcaagcctgccaagccactcagccccagcaaccagcccgggattctgccgttgttcaaacgccaatctcctcgtgtcgttcatagccatccggcaagccgaaggtctgcatgccgcccaccgactcaatggcactgcgcacaaagcggtcatccaccaagtctttggcgacgaaggccgggtcgaggtcggcaaggaatttcttgtcgccttcgatcaacgtgtctttcaagcgccgcaccaattcctcggtgtagctggggaatggataaggctggaagtcgatgcggtgctcgtcccagttggcgtgctgaatcgcgccatcggccaggtaagcggcgcggtcgccggcagccggggccaatactttgctcaacaccggctcagcatgtggcgtgtagcggttcgggccgtccttggacagcagcttcactgcctcttcgcggttgtcgcgtgtccatacctgcgccttgacgatggcattcaccaccttctgcgaccattccgggcgattggtcaggtcgtgctcgtgcatgaacaccacgcagcacgcatggttgcgccacacgtcgccggtaaagcgctgcacgcgaccgaccttgaggttttccgccagggcgttgaacggctcggcaacgatgtagccgtcgatgcgcttgctggccagggccggaggcatgtcggagggcggcaacacgatcaggttgacttcattggcggcaatcgccgtacccgctgcacgggccaccggggttaggccgttgtcacggaacagttgctgcaccaccacgttatggatcgagtaccagaacggaatcgccaccgacttgccgcccagttgtttcacctcggtaatgccgggtgataccgtcaggcccgaaccgccgacgtggttccaggccaccactttagccggcaccttgctggcgtagcgcgcccacaccgtcatcggcgacaacaggtgaatcacgttgacctgcccggaaataaacgcctcgatcacctgcgcccaactgcgcaacagcaccgggcgctcggccttgataccttcggcttcgaacaggccgttgttgtgcgccaccaatagcggcgtggcgtcggtgatcggcaggtagccgatgcgcaccggcgcgtccggctcgctggcggcgcgggcctgcaagctgctcagcagcggtaaggcaccggcggcgctgagcactgccgaaagtttgagaaagtcacggcgcgagtgggtcaggtcatccaagcacatggccaggctccagcagttcaagagggttgggttgagggcggctcgcctgccgtaaggttttcaagatgtcgatacgcagcgcgccgatggcctctacttgctcttcgcgcggttgcggcaggtcgatctgccattcgcccaacgtgcgcgccggccgattgcccagcagcaggatacggtcggacagcaacagcgcttcatcaatatcgtgagtaatcaataccgccgccgagccttgctcgcggttgaccttgagcaacaggtgctgcatgtcggcgcgggtgacttcatccagcgcgccgaacggctcatccagcagcaacacttgcggttgccgcgccaggcagcgggccaacgccgtgcgctgcgccatcccgccggacaattgcgccgggaactgctggcgcgcatgttccagctcgaccgccgcgatggcgcgatcaacgcgcaggcgccgttcttcagggctcaagtgcggttggcgagcgaaatccaggccgaaagcgacgttcttttccaggttcagccacggcaacaggccagggtcttgaaaggccaccgccacgcgcggatgcgggccgtccagcggctcgccgagcacctgcacgccaccgccctgtggcgcctgcaaaccggcgagcacgcgcaacaggctggatttgccgacgccgctggggccaaggatcgacaccacttcgcccggctgcaggagcaagtcgaacccttgcaacaccgggccactggcataccccaggcaaatcccctgggcgcttaataccgccgggctcacagcgcggcctggcgttgcaactcggtgcgcaattgcaccaggctcggcgtgacgatcggcacgaaggccgactcgcgccaacgccgggcaaacccgctgccgtgagcggtgaggtaggccttgccgccgctggcttgcagctcaagctgcaccgcactggcggcggtttcggcgagggcaatacgcagcttgaacaagggcaccggctcggcagcaaaacgcccggccagcaggccttttttcaggtcattgaccaagtggtcgagggtcacgcgcagcgcttccaactcatcgcgcaacacggtgcggcttgatcccaagtggttggccacttccgccagcgagcgccgcgccaggccaatcgacatgccgcactgcaagcccagaaacgccgggcgtacggccggtagaaatttgcgcgcatcctcatgcaacaaccactcacggctcagctcaacgccttccaggcccagggctgcggtgttgctcgactgcaaccccagcagttccagatcgcgcgagcgttgcaagcccgccaccgaatccggaatcgccaggataaacggcgcgccaccgccagcatgttcgatagctgccgcggctacaaagccgttcttgcgcaggttggtcacccaatgcaggcgcccgttgagggtccagccgtcttccgttggctcggcgctgatttgcagcgtctcgatgcccgacaaaaacttcatcgcattcgacagccccgtggccccggccaacttgccactgagcaagtccggcagcagttgctcacgcagccgctcattcgggctctgcaacaaatattcgataaaggagcgctggccccagcacacaaacgccgccgccagggaatggctggcaacgttggcgatggcgtccaccgcagcggttatatcgccgcccgagccgcccagcgcctttggcacgccgatacgcaatacattggcttctgccagccgtggcagcacttcctgtggatcgcaactgcccacatccagggcctgcgcttgaacatcgagccaacggctcaagattgggtcaagcattcgtttctccttattacagcaggtagaccatcgcctaatcagcttgccggtttttcccaacggtattgcgccagctccgggttcagcggggtacgggcaaacacgttagcgaagttgcacagggttgccaggcttacgcccaaaataacttccagggcctggccctcggagtaaccggcagcacgaaacgcctcgaaccctgcgtcgctgacatcacctcgcgtggcgatcacttcacgggtgaaggcggcgagtgtctcatagcgggcattgggcaattcaccgcgttggcgcagtgcatcgatcacctcctccggcagcttggctttgttgcgcgccacggcggtgtgaccggcgacgcagaaatcgcagccgtgggtggtggcggcaatcagttgcaccacttctctatcggccaggctaagttcggccttggcgttgaggccggagacggtgatgtaggtttccagcgcggccggtgcgttagccaggacggcgagcaggttcggaatgaaacccgaagctttcagggcgttttccagcaagggtttggcggcttccggcgcggtttccggggtcaacaacggtacacgggacatggagtggtctcctgatgggttcgtgtacccagtctgttggttataaaaaatcgcctcaataggctaaagtagcgattacttgctctagagtctttcccttagatgaattcgtccagtgcacttgtcgattggttattagacagccttgaactcaacaccagcttgttccatgtaggccgctactgcggcgattggcacgcgagcactcatgggctggccagcgcgagtttccacctggttgtgcaaggccagtgctggctgcatatcgacggtgaaccgagcccgcaacacctgaacaatggtgacgcggtgtttctattgcgcgacttggtttatcagctgtctggcgaagctacggcggcagccgcgcaggaatgcccgcgccgcccgatgctgccgctggacagcaccgccaacgatggcgtaggcctggtctgcggtttcttccacttccattccggcttgtcggcgctgatcgtcgacaccctgcccacctggatcatcctgcgcgccggtgacccttcactgaccgccgcacgcaacctgttcgaactgatcctgcaggaatgcgaacgcaccccggcgccctcttccgcgctgctcgaacgcctttgccacttgctgtttctgtatgtgctgcgccagcaagtcctcgacaacaccgaactgggtggcctggccgcactgggccggcagccggcgttcgccaacctgttggaacaactgatcgcccaccctgccgatgcctggacgctggaaagcatggcggcctgcaccgggctgtcgcgctcggcgtttttcaaacggtttaacgaactgtgcggccaatcgccggggcaagtgctgctgctgatgcgcatgcgccacgcgtgccagttgttcaaggaagaccagacggtggcggatgtagcgctggcggtgggttaccaatcggtggcggcgtttactcgggcgttccataaggtcaccgggcagcagcccggcgcctaccgcaaggctcaggcctgacgctgcagcccggtgccgggtcgcgcgcacagctcaaccaaccaatccacaaacacccgtacccgctgcgacaactggcggtgcggcgggtacagcgcggtcagcgccattgtaggcaccggcagctgtggcagcacgtgcaccagcgtgcccttggccagttgttgcatagcgtgatagtgcggcgcctggatcagcccataaccggcctcgcatgcggcgaaatacgcatcggagctgttcaccgagacaaccttcggcaagttgaccgggcgtagctcggtgccaatctggaactccaaaccaaaccgtttaccgctggcgctggagaggtactcgaccatctggtgcccggccagatcgtccaggctcgcgggcacgcccatgcgctcaaggtacgcggggctggccaacgtcagttgatccatcacggccaggggccgcgccaccagcgattcgtccagtgccaggccaccgcgcaggacacagtcgacgccctcgcggatcaagtccacggggcggtcgttgaggccgatctccagttcgatcagcgggtagcgtgcggtaaaatctggcagtgcgggaatcacgatcaaccggccaatgcctgagggcatgtcgatgctcagggtgccgcgtgggttctggcgactcaccgaaaacaccgcttcggtttcttccaggtccatcaataactgcacacaacgctggtaatacgcggcgccgtccagggtcgggctgacctggcgcgttgtacgctgcaacagctgcacgcccaggtgcgcttccagctgcttgatcaggatggtcaccgatgcccggggcagttgcaggctgtcggccgccttggcgaaaccgcccaattccacgattcgggtgaacacgcgcatggcgttaaatcgatccaaagccgggctaccttgttggattgtttagaaaatcataatagtgatagcggttttagccgctttatccccggtttgtcgaggagaacaatagggcctttcccaccactggagctgctccgatgcacacacgtcaactcggcaagaacggcccgcaggtctccgccatcggcctcggctgcatgggcatgaccgacttctacaccaccggcaccgatacacaggaagccatcgcgaccctgcaccgcgcgctggaactgggcgtgaccctgctcgacactgccgacatgtacggccctcacaccaatgaaacactgatcggcaaggccatcgccggcaagcgtgaccaggtgttcctggccagtaagttcggctttgtacgtgacccatcgaacccggctgtacgcggcgtgaatggccgccccgagtacatccgccaggccatagacggcaccttgaaacgcctgggcgtcgaaaccctggatctctactaccagcaccgggtcgaccccgaagtggccatcgaagaaagcgtcggtgcgatggctgagctggtcaagcaaggcaaggtgcgttatctgggcttgagcgaggcatccgccgccagcctggagcgcgcgcacaaggttcatccgatcagtgccctgcaaagcgaatattcgctgtggagtcgcgaccaggaagacaacggctgcctggctgcctgccagcgccttggcattgcctttgtgccttacagcccattggggcgtggtttcctcaccggcgcgctgaagagcccggatgacttcgccgccgacgactaccgccgctccagcccacgcttccagggtgagaactttgcaaaaaacctgctgctggtggagcaggtgcaagcgctggcggctgaaaaaggcattaccgccgggcaactggcactggcctgggtactcgcacaaggcgattacctgatcccgattccggggaccaagcagcgcaagtacctggaacagaacgtggcggccgtagacgtcaccttgagccctgccgaattgacggcactggcgtccattttcccgacgggcgctacggcaggttcacgctaccctgaagccgcaatgggcctgatcaacaggtaacccaggtgtatttgccggcggctggatcggtcgccggtgccacgccagcacgaaatacccgaagccgacagaaaacggaaagctgacccacagctgacaaggtgatcgctgatatacgtgcttcgacatatagcgcattgaatccaacgcgggcgcacgggaacgctttgagggcagacctcaacttaggggttacccagccattcacgtaaggacgccaatatgctgccagcactcggccattcaaaccaccccggccaaactgcaacgcgcgatactcccacgccgtccctttatgatccgccgtccgatctgaccccgggcagggttagccgcagaaaacatacactgcacgtcgacggcgacatcaagatcagccggctcattgattgggatgcaacggacccactctcacccagggttgcgcaaaaccggcttctggtggagaccggtgacaatgcagactatgttcatgtgcgcagtttgccggacggcaggatgcaaatctcggtcaacggcaagccctactatttcgacaccgccgatcatccagacttcgaacaaaccctctggatcaaaaccaacggcggcgacgacaaggtcatcgtcgacgatgaaatcaaactcgcattggacgtggaaggcggcgatggcaaggacttcatccaggcaggcggaggcaggaccaggctctatggcgggcgcggcgcggacaccctgaagctgggcagcggcctgggttacgccgaaggcaatgacggcaacgataagatcacggggggaaccggcaacgcggtgatgtacggcaataatggcagggacgaactcgatgccggttctggccccgcgaccaagcagagttacctggacggcggcaacggcaaagacctgcttaaaggcggtagcgggcacagcgttttgcatggcggcaacgataacgaccgattggtgggcggcgatcgcacgaccttctacaccggtaaaggcatcaaccgtatcctgaacaataagcccgacgaccttatttacgccggcgccaatgataagttcaaccgcaaactgggctcgacggtcaccgtggtaaaacccagcagcgccggggagcaggctttcacggtgctgggtgacagggacttccgccaacgggtcagcgatgacttggaattcctgcgcagctcgcctattggccagcaggccctcgctaccctggatgaactggccttattgaatggcggcaagatagccatcctgccgaagtccgccggcgctcagggctaccaattcggcagctccgcactgggtgacttgccacctgaagacgagggcgatgaagtggacgtggaagaggaagaaggtccggaagacaacccggcccatggcaccctcattgatggcgttcccggtgcgcgtgctgaccgtgcgaagctgttctttgaccgccactctgtccttgaaacggctgaccgcaccaatacgatcgtccccattaccaccttctttcacgaaatagcgcatggttacaatggcgccaccggcacattcctggcgggtacgaccgaagaacggctggcatccggcgaagtggaagcggtccccaatgaggagtatcaagccatcgggctacccagcgatgctgaaccgtttgacttggacaacaacccctcgacgcccccgactacggtcaatccgaaaccgttcacggagaacgcgctcaatcaagaaatgggcaaaccgctaaggaaaagcaaaaatatgcagttcagtgagcagggtatcggtgaataaccacctgaatattgaacggcgaggcaggttcttcaacgctggatgctgccgccttttaatttcgcaccaccgtacctaaagctccgccttgccaagccgatagcccgacgaagctctaacaaagccgcgtcgataataaacgcttcgtaaggacgacccccatgcccccattgcgctccattcaaacccgctacaccgtgtttctggtgctgttcgtcctggtgctatttgtgttgaccgtcgtgggtattggccagttggtcgcccccacgctcaaacacaccgaagaacaggtggtgctcaaccgcatcgccgaagtggccgaacagatccagggcgaactcaacaaggttcaagcccagcaacgcagcatcacccagaccatcccgctgctcgacagcgatgccatcgacaaggtgctgcccggcctggtggaccagtatggcgaactgaaagtcttcggcggcggtatctggccactgcccaaccagcgcacgccagggcgtaacaagcacagcaccttctggcaccgcgatgcctcgggcaagctggcggtcaacaccttctggaacagtgacgccgcgcccaattattacgaccagagctggtacaaaggcggcctcgcctcgccacgcggccagtgcgcctgggcagccgcctacaaggacgacgccagccaggagccgcgcaccaactgcgccatggccatccagcgtgacggcgcggcctacggcgtcgccaccatcgacgtgaccctgggctttttcaatgacctggtcgccagcaaggaaaaagacatcggcgggcagatgctgatcgtcgaaggcgacggcaagatcatcagcaacagctcacgcatcagcggcccggtggtgttgaagaacatcagcgaactggccggcacctcggccttcgccgcccaggtcagcaaagccctcgcccatcgcgaccaggcgctgcaacgcagtgagttcgacaaccagggcgtggccagcaccttctacatgcgcccgatcgagggcacgccgtggttcctcgccaccgccctgcccacctcgctgatcaccgcccagcgcgatgacgtactcggcaccctggccatgctgcaaattcccatggtgttgctgctggtgctgttggcgttctacgcgattcgccagttggtgcagcgcatgaagtcgctgagaaccaacatcgacgcattgtcggccggcgatgccgacctgacacggcgtatcaccatccgtgccgaagacgaaatgggcgccatcggccattcggtcaaccgctttatcatctacctgcaaaacatgatcggtgaagtgacccaggccaccggtgccatgtcgtcggggcttgagcagttgcagcagacctcggcgcagaccaaccggattctggtgcggcatgcctcggagacggaccagacggtcaccgccatcaccgaaatgagctcgaccgccgacaccgttgcgcaaaacgcggctgaaaccgcctcgttcacccagcgcgccaacgaacacgccgaccgctcccgcgtcgtcgtcggtgaagcctccaacagcgtcagcgcgttgatcggcgaagtggccagcgccacccacaccgtggaaaacatgcgccaggacgctgcgcgcatcaccgaaaccctcggcgtgatcggcgccattgccggccagaccaacctgctggcactcaacgccgcgattgaggcggcacgggccggcgagcaaggccgtggttttgcggtcgtggccgatgaagtccgggcgctggcggcacgcacccaggccagtacctcgcagatcaatgagatgctcgcacgcctgaccacgggggtgagttcgtcggtggcggccatggaaaacacccaggccagttgccagtcggcagcggatgccacggcacgcgtcaacaccggcctggacgaaatggccggttcggtcagccatatcaacaacctcagcacccagatcgccacggccgccgaacagcaaagcgcggtgaccgaggaaatcaaccgcagcatggtgcagatccgacatatggtcgaggaactggtggaaagtgggcatgccactgaaaccaatacgcaaagcctgttggatgccaatggccgggtgattgcgttgatgagccgcttcaaagtgcgctgataaatgcgtgaaacactcccgtgcaaaacgcgggagtgggactattctgacagctcctagtgcaaagtctcgccacacaggaggtgtgtcatgcacgctatcgagcattcgagccgcttggagcggatcagccaggaacgctttatcaacgcccctatcgaggtcgtctacgactacgtgacccagcccgaccgctggcacgagtggcaccccacctccctcagtgccgacaccggcaccaccggttcactcccggccggcacccggtttaccgaagtcatcgacctgctgggcgtgcgcgtgccgatgagttatcgcgtgcaggttgcccgccccgcgaccgagttcaaaaccgtgttcacctccctggccgtagacggctccatccactacttcttgcaggcccatcgcggcggcacgctgttcaaacgcgtattgacctatgaaaccgagctgcaactcgccaccttgcatgagcgcatggtcgagctgtcggccatagcgctggaccagctcaagcatcggctcgaaaacggcgccttcgtataatttagaaacattactgaaactgtgactcacctgtgggagctggcttgcctgcgatgacatcgtcatgatcgccgccatctatcggctacctcctacacgcgagcccccctatgaaaaacaccgtgcgactggccctgctctcagccctgctcacctccagcctggcccaggctgccgacctgatccctatcgacgtgcaccgcgacgccaactgcggctgctgcaaaaagtggatcagccatttgcaaagcaacggcttcaaggtcaacgaccatgtggaagccgacatgagcgccgtcaagcagcgcctgggcgtggcaccgcgcctggcctcgtgccacaccggcgtaatcgacggcaagttcgtcgaaggccacgtacccgccgaacaggtgatggccctgcgcaaacgcgacgacttgctcggcatcgcggcgccgggcatgccaatggggtcgccgggcatggaaatggacggaaaaagcgatgcctatcaggtcatcggtctgacccgtgaaggtaacgacgtggtggtggccgactacccggcacgttaattaatgctcgccggttacctggggttatttttcgccgccttcggggccgccacgctgttgccgatgcaatcggaagcggtgctggtgggcttgctgatcagcgggcattacagcctgtgggcgctgctgacgattgccaccgtgggcaatgtgctgggctcggtggtcaattggtggctggggcgctcggttgagcgcttcaaggaccggcgctggtttccggtcagcccccgacacctggaaaaagcccgcacgcactaccagcgctgggggcattggtcgttgtggctcagttgggtgccgattatcggcgacccactgacgttggtggcgggcgtcatgcgcgagccgttctggcgcttcctgctgatcgtcaccttggccaaaggggctcgatatgccgtgttgacgatggtgacggtgagccagttcgccggcgcataactcagtaccgttggtcgctactgtcagttttgacagctatccgcgccaaccgtctgcggcttaatttcctactcgtatgccgggcgacatggacgttttcgagtaggaactttccgttttgatacgtctttgagctgtgcctatcggcctcccccaatggttaatcctcgattaatcgttcgccaacagcatccgatgtttcactgcggagacacttcatgcaacccaagcgcgcgctctatctcactctcttgttacttgcggccaccctcaccggctgtgccaaccaacagaaagacacctacggccccgagctgcagggtttcaaatacccctacccagtcgagcggttcaaattctcgtcccagggccaatcgttgcaaatgggttacatggacgtgaaacccacgggcacgccgaatggccgcagcattgtgctgatgcacggcaagaacttctgcgctgccacctgggaaggctcgatcaaggcgctgagcaacgccggttaccgcgtggtagtgccagaccagatcggcttctgcacctccagcaagccggaccactaccagtacagcttccagcaactggcactcaacacccaccaactgctggataaactcgggattaaaaaggccacgctcctggggcattccaccggcggcatgctcgccacccgttacgccttgatgtacccaacccaaaccgaacagctggcgatggttaacccgattggcctggaagactggaaagccattggcgtgccctaccgcacgatcgaccaatgggcgcaagccgacagtcaattgacctacgaaagcgtgcgtcgctatcaacaggccaactactacctgggacgctgggaacctgcgtacgaccgttgggtggacatggtggtggggctgcacaacgggtccggcaagcgggaagtggtgtggaactccgcattgatctgggacatgatcttcacccagccggtgtactacgagttcaaggacctgaagatgccgaccctgctgatcatcggcacctccgacaccacagccctcaaccgcgacctggcgtcagcggaagtcggggcgaaaatcggcaactatcatctactgggcaagcaagtcgccaagttgattccgcgcgcaacgctggtggaattcgccgatcggggccattcgccgcagatcgaggaccctgaccagtttcatgcggcgttgctgcaaggtttgaaagccctgtaacccagcggggcgccagcgatttcgcggcgccccgttaatccccgcttaatccttgcgccacagcatccgggcactgtttgcggagactgcccatgccactgatccgatcactgtgcgccgccagcatgctggccagctgtgcccttcccgccttcgccgccaccgaaggccccgcctacggccccgagctgcaaggcttccagtacccctacccggtcgaacatttcaactttcagtcccagggcaaaaccctgcaaatgggctatatggacgtacccgcccagggcaaggccaacgggcgcagtgtggtgctgatgcacggcaagaacttctgcggcgccacctgggatgactcgatcaaagccctgagcagtgccggctaccgcgtgatcgcgccggaccagatcggcttctgcacctccagcaagccggaccactaccagtacagcttccagcaactggcactcaacacccaccaactgctggataaactcggcattcaaaaagccacgattgtcgggcattccaccggtggcatgctcgccacccgttatgccctgctttacccggcacagaccgagcaactggcactggtcaacccaatcggcctggaagactggaaggcgctgggcgtgccgtatcgcagcgtcgaccagtggtatgagcgcgagctgaaactcagcgccgaaggcattcgccaatacgaactcaacacctattacgtcgggcgctggaagcccgagtacgaccgctgggtcgatatgctcgcgggcttgaacaaaggcccggggcatacccaggtcgcatggaactcggcgttgatttacgacatgatcttcacccagccggtgtactacgaattcaaggatttgcagatgcccaccttgctgctgatcggcacgtccgacaccaccgccatcggcagcgatatcgcgccgccagcggtcaaggccaaactcggccattacgatgtgctgggcaagcaagcggccaagttgattccccacgccaccctggtggaattcctcggccttgggcatgcgccgcaaatggaagagccggcccggttcaataaaacgctgttgcagggtttgaatgccctttaatccaacctttttcgaggcactcgtgaatgtcggtacagatcgcagtcattgatgattggcagaatgtggccagtagcgtggtggattggtcggtgttgaacgcagtgggccaggtgcacttcctgcacgactacccggcggacaccgcaacgatgatcgagcgtttgcgcggcttcgaggtgatttgcgtgatgcgcgagcgctccactttcgacaaagccctgctgcagggcctgcccaacctcaagctgctggtaaccggcggcatgcgcaatgcggccatcgacattcctgccgccaaggccctgggcatccaggtgtgcggcaccgacagctataaacaggcggcgccggagctgacctgggcgttgatcatggcctccacccgcaatttgctggtcgaagccaacgccctgcgggacggcggatggcaggtcgggctgggcggcgatctgtatggcaagaccctgggcattctcgggctgggcagcattggccagaaagtcgcgcagtttgcccaggtgttcggcatgcgcgtgattgcctggagtgaaaacttaacgccgcaacgcgcagccgaagcgggcgtgacctgggtcagcaagcgtgagctgttcgaacaggccgatatcctcaccgtgcacttggtgctcagcgaccgcagccgcggcctggtggatgccgaggcgttgggctggatgaagccgacggcacgcttggtgaacacggcacgcgggccgattgtggatgaacaggcactggtctcggcactgtccgaagggcgactggcgggggcggcgctggacgtttatagcgaagagccactgccggttgatcacccgttccggcggttacccaatgtgttggccaccccgcatgtggggtatgtgagcgagcagaattaccggcagttttatcagcagatgattgaagatgttcaggcctgggccagcggcgcgcccgttcgcgtgctgggctgatcctgcgtcgcaccaatttgtggcgagcaggcttgctgagggaagcagacttgttgtggcgagcaggcttgccctgcgttggagtgcgaagcgctcccaataaggcacactcggtacacctgccataccgaggctgccgacttcagggccgcttcgcgccccaacgcggggcaagcccgctcgccacaacaagcccgcttgccacagtaagcctcattgccacaacagacctgctacccacaataaccccgccaatccccgcaaatcactgcaagtttcaaccttgcatatcgttacaagttttttgtcctacaaaaatgccttgtaaaccctacaggctctggaatctgtcctagactgatgaccgatgggtccgttccaaaacaaaaaccccgcaaaaaatctaaactttccaactctgccataggtccagtttttaagggaggcgagcgcacgcggttcacaccaaatgcccgtccatccactcttttttagcaatgggtgcaactggcatacgccttgccagtttgtacagtgcttgtgcgcctggccgcaggatgcggtcatcggagctaatggcagcgggccattagccgaccagacatgtgggagagaactatgatcagtgctgcagtagatactcagggagagcgttttagtcagccggtagggggaccgacttcgttggtcgacctgcccaacactgtgcggccgatcgtgagtcagaaccctaatcgaaagaaagtcttgtttgtgacctccgaattcgccgatctggtgaagaccggtggcttgggcgacgtgtctgctgccctgccccgcgccatggcgcatttgcatgatgtgcgcgtattgatccccggctacccgcaggtgatggagagcgataacccgatccacatcatcggcgaactgggtggccacgcggcgctgccgccgtgcaagatcgggcgcatggacctcaaggacggcctggtcatctatgtactgatctgccccgaactctacgagcgcgaaggcacgccctacggcgccaacaacggccgcgactggcccgacaaccatattcgtttcgcccgcctgggcctggccgccgctgacatggctgccaacctcgcgcagatccactggtgcccggacctggtgcacgcccacgactggcccgctggcctggccccggcgtacatgcactggcgtggttcacgcacgcccaccctgttcaccattcataacctggcctatcaaggcgtggtcagcctggcctccacgccggagttgggcattccgccacatgccttgcaacaagaaggcatggagttctacggcaagatgtcgttcctcaaggccggcatggcgtattccagccatatcaccacggtgagcgccacctacgcccaggaaatcaccacgcctgaattcggctgcggcctcgatggcttcctggccagcaagacccagcaaggcctgctcagtggcattcccaacggtatcgacgaaagctgggaaacctccaccgacacgcacctgacccacaacttcaatatcggcgactgggacggcaaagccgtgaacgccgcccatgtccgcgagctgttcggcctgcatgactccaccggcccgctgttcgctgtggtgtcgcgcctggtctatcagaaaggcctggacctgaccgaagcggtcagcagctttatcgtcgaaaacggcggccagattgcgattatcggccgcggtgagccagaagaagaaaatgccatgcgtgaactcgccctgcgcttccccggccaggtcggcgtgcgcattggcttcaatgaaaccgacgcgcgccgcatgttcgctggcagtgacttcctgctgatgccttcacgttacgaaccctgcggcctgagccagatgtatgcccagcgcttcggttcgttgccggtggcgcgtaataccggcgggctggccgacaccatcgaaaatggcgtcaccgggttcctgttcaatgaatccacggtcgaaagctacaaagaggcactgagccgcgcgttccgcgtgtttgccaataaaggcttgctcaacgccatgcgcagccgttccatgacccaacccttcaactggtgccaggcggtggaaccctacgccgaactgtacgaacaactggtcgctaaagcactggggaaatccgctaaataatcaagggagggcttcatagatgccgtcacggactctggaaacctggccccacggcgcaatcatgctggacgcgcaacacacgcgttttgccttgtgggcgccagacgcgttttatgtcagcgttgaattggaagacggcaagtccatcgccatgctgccccaggcagaaggctggtttgagatagagataaagtgcccggcgggcactcgctaccgctacaacatcgacggcgaaatggatgtacccgacccggcgtccagggcccaggccctggacgtgcatggttggagcgtggtcgtcgacccgctcgcctatcaatggcgacactgcacctggcaaggccgcccctggcatgaggccgtcatctacgagctgcatgtcggcgtactgggtggctacgctgcggttgaacaacaactgccacgcctggccgaactgggcatcaccgcgattgaactgatgccattggcgcagtttcccggcgagcgcaattggggttacgacggcgtactgccctacgcgccgcaatcctcctacggcacgcccgaacagctcaaacagctgatcgacagcgcccacgaacacggtttggcggtgatcctcgacgtggtctacaaccacttcggccccgacggcaattacctcggccagtacgcccagggcttctttcaggaagacgtgcacaccccttggggcgccgggattgattttgatcggcgtgaagtgcgggatttcttcctcgataacgcactcatgtggctgctggaataccgtttcgacggcctgcgcctggacgcggtgcacgccatcgacaatccggggttcctcaaggagctggcacaccgggtgcgccaacaggtggacaccggtcgtcacgtgtggctgatgctggaaaacgaactcaaccaggccagcctgctgacgcatgatttcgatgcgcagtggaacgacgacttccataacgtcttgcatgtgctgctgaccggcgagaccgacgcctattacagcgacttcgccgaaaacccgacagacaagctcgcacgctgcctgggcgaaggtttcatctaccaaggccacaccactcgccacggccatgagcgtggcgaacccagcggcgacttgccacccagcgcctttgtggcgtttttgcagaaccacgaccagatcggcaaccgcgccctgggcgagcgcctgcatcaattgtgctcgccccaggcgctcaaagcggccaccacgttactgctgatgtcgccgatgatcccgctgatgtttatgggcgacgaggtcaacgccgaggcgccgtttctgttctttaccgaccaccatggcgacctggccgaagccgtgcgcgaaggccggcgcaacgagttcgccgactttgcggcgttcaaagacccggagcggcgcgaacatatccccgacccgaatgccctgccgacctttctgcaatcggcacccggcttcgccgagaacgcccacagccagttttaccggcacctgctgagcttgcgtcacctgcatatcgtgccgcacctgcccggcagcgtggcgctgggcgcacaggtcctggctgacggcgccgtcaccgcgcgctggcgcctgggcaacggcagcgtgttgcagattgacctgaacctgggcgacacgccgctggatcaccccgcgccgccgcacctgctattcgagacgcctgccacggacgaggcgcatttggcgccgtacagcgcacgcgtcgccctattccctgttggagagcacctttgagcgaagcgaacctggaaatactcgccagccgcgcgggcctggccgtcgattggatcgacgcaaacggccgcccgcaacatgtgaaacccgacgccctgcgtgccgttctcaaaggcctcggccacccggccgataccgacgccgagatcaatgccagcctgcgcgaactggagcaggtgcaacaggacaaacacctgccaccgttgttgaccgtcgacaccggcgaaggcctcgacctggcgcgctacttcgccgcagatacgccgtgccgggtcagcctggaagacggcgaaaccctggagttgcgcctcgacggcgatggcgtgctgcccggcattattgcgctgggctaccaccaggtgcacatcgatgaccagacgttcaccctggccgtggcgcccacgcactgctacagcgtggccgaagccgtggacagccaaccggcgcgcgcctggggcctgagtgcccagttgtatgcgctgcgccgcctgggtgacggcggttttggcgacacccaagccctagaacacctggcacgctccgccgccgagcgcggcgccgatgccttggccatcagcccgatgcacgcgatgttcagtgccgacaccgagcgctacagcccctactcgccttccagccgtttgtttttgaatagcctgtacgcctcgcccgcctgcatcctcggcgagcgcgaagtgcgcaacgcgatagacgccctcgggctggcggatgaattgcacgcactggagcagcacacgctgatcgactggccggccgcggccaaggccaagcagcgactgttgcgcgccttgtacgaagacttccgccacggccagcaccctcagcatgccgacttcctgagcttccgccaggccggcggtgaagccctggaaaaccactgccgctttgaagccgtacaagccgtgcgcgccgctgccggggaagacctcgactggcgtcactggcccgaagcctggcgcagcccgcagagcccggcgctggtggaatttgccgcagagcacactgaagaaatcggcttttacgccttcagccagtggctgatcgcgcgctgcctggaacgtgcgcaacaagccgcgcggggcagcggcatgggcgttggcctgatcgccgacctcgccgttggcgccgacggcggcggcagccaggcctggagccgccaggatgaattgctcgccaacctcacggtgggcgcgccgccggatattctcaaccgcgccggtcaaggctggggcatctcggcgttttcgccggaaggtctcaaacgccatggtttccgcgccttcatcgagatgctccgcgccaacttcgcccacgccggcggcttgcgcatcgaccatgtgatgggcctgcagcgcctgtgggtgatgcccatggacgcctcgccgcgcgaaggcgcctacctgtattacccggtggacgacatgctgcggttgctggcgttggaatcccaccgccaccaggcgattgtgctgggtgaagacctcggcaccgtgcccgacggcctgcgcgaaaaactcagcggccgctcgatcctgggcatgcgtgtgctgctgttcgaacaaggccacgatggccagttcaagccgatcctcgactggccggacaatgccctggcgaccaccagcacccacgatttgccgacgctcaatggctggtggcacagccgcgacatcgagtggaacattcaactcggcctgattgacgcgccgaccgtggagcaatggagcgagcaccgcctgcgtgaacgccaggcgctgcgccaggccttgagccaggacccgcaaaatttcgtcgatgagatccgcaacgacaccgaccatatgatcgacgccagcgtgcgttacctgggccacacccgtgcgccgctggtgctgctgccgctggaagatgcgctgggcattgaggaacaagccaacctgcccggcaccaccgacacccatcccaactggcgtcgccgcctgccgggcgaggctgccagcctgctcgacaacgccggcgccgctcgccgcctcgaactgctggccgtcgcgcgcaaccaagcccatgagcgtgaccgatgaaagacctgcccctgcgcgctacccagcgcctgcaatttcataaaggcttcaccctggatgacgcggtgccactggtgccgtactttgcccggttgggcatcagccacctgtacgcctcgccgctgctcagcgcccgggccggctccatgcacggatacgacgtggtcgacccgaccaccgttaaccccgagctgggcggcgaagcggcgttgcgccgcctggtcgcggcgctgcgtgaacacggtatgggcctgatcctggatatcgtcagcaaccacatggccgtcggcggcgccgataacccgtggtggctggacgtgctggaatggggccgcttgagcgcctacagcgagtttttcgacattcagtggcactcgcccgacccgttgctcaagggccagctgctgatgccgtttctcggcagtgactacggcgaagccctgcaaaccggcacgctggtgctgcagttcgacgccgagcacggcgcgttttacgtcgagcattacgaacaccgcttcccgatctgcccgcgagattatgcgctgatcttcggagacgacgacctgctcaagccgttggctgatcgcttcaacgccctcgcctatcaggacgacgcgtaccacgaagcggcgtggctcaagcaggcactggccgaacgtgctaccgaaagcgatgtgctgcacgccattgaacagcgccttagcgagttcgacgggcgccaaccggaagggtttgcccgcctgcatcacttgctcgaacagcaaacttaccgcctcgccagctggcgcaccgccgcggacgacatcaactggcggcgctttttcgacgtcaacgagttaggcggcctgcgcgtagaacgcacggccgtgtttgaggccacccacggcaagatcttcgaactgatcagcgagggtctggtggatggcctgcgcatcgaccatatcgacgggctcgccgacccgcgcggttactgccgcaagctgcgccgtcgcgtggattcgctggcgcccgagcggcacctgccgatcttcgtggagaaaatcctcggcgaaggcgaaaccctgcgcgaagattggaaagtcgacggcaccaccggctacgagttcatgaaccagctgtcactgctgcaacatgatcctcaaggcttcgaaccgcttgccgagctgtggacccgccacagcgaacggccttcagcgtttatcgaagaagcctggctggcgcgccagcaaatcctcaacggttccctggccggtgactttgaaagcgtggcccaagccctgctgcaagtggcccgcgatgatgtaatgacccgcgacctgaccctgggcgctattcgccgcgccttgcaggaactgatcgtgcactttccggtgtaccgcacctacatcagtgcgcgcgggcgcagcgaacgcgatgatgtgtttttcctgcaggccctggccggtgcccgcagcaccttgagcgaaggcgactggccggtgctcgatcacctggaaaaatggctcggcggccaaccctggcgcaatcgcccagtcggccgtgaacgcaagatgctcaagcatgcctgcgtacgcttccagcaactgacgtcgccagccgccgcaaaggccgtggaagatacggcgttctatcgctcggcggtgctgctgtcgcgtaacgatgtgggcttcagcaccgagcagttcagtgcccccgtggaagcattccacgcggtcaatcaacagcgcctgcagacctttcccgacaacctgctggccaccgccacccacgaccacaaacgcggcgaagacagccgcgcgcgcctggcggtactcagcgaatgtgcgccgtggtacgccgagcaggtcgaacactggcgcaccctcgcggcaccgttgcgcgacgacgccaacagcccgtccgccggtgacgagttgatcctttatcaagtgctgttgggcagttggccgttggacgccaacccggacttgcaggcctatcaacagcgcctgtggcagtggcaacaaaaggccctgcgcgaagccaagctgcaaagcagctggagcgcaccgaacgaggcctatgagcacagcgtcgaggcgttcctcacgcgcctgctgaccagtgaagaaggcaacgcattgcgcagtgccctgggcagcgccgcccacgccatcgcggcggccggcgcggtcaacagcctggcgcaatccttgcttcgtatcaccgtgccgggtgtgccggacctgtaccagggcgctgagttctgggacttcagcctggtggacccggataaccgtcgaccggtggatttcaacgcacggcaacgcgcgctggatgcaccaccggacgtcggcgagctgttgtcccactggcgcgacgggcgtatcaaacaggcgctgattgctgaggttttagccttgcgcaaggctgatcccgcgatcttccgcagcggcagctacacaccgctggaagtcatcggcaaacaggccgatcacgtcgtcgcattctgccgcgagcatcacggtaaacgcctgctggtggtggtgccacgctggcctcatcgcctgctggaaaacggtgaacagcctcacatcaatgcgcaggtttggggcgatacgcgggtgaaattaccgttcgccgcgacaacacaaaactggaagggactttttcatacaggcgcagtcacaccaaacaaggagctgttgatcagcgctgccctgggggatttcccggtcaatgtctttatcaatcctgatgatcaagaaagctgaaaattttctgtgaggagttttgtgatgagtactgaagacaaacgcattcgcgagttggcgcatcagatctgggagtccgaaggtaagccccacggggaggacgcgcgccactgggagatggcacgcaagttggccgaagcggaagcgctgacgccgagcaagcccaagccagctgccaaacccaagaccgcgcccaagcctgcgccaaaagccaagcccccggcgcccgccgcgagcaagccggccccaccggcggcgaaaaaaccggcagcaccgaaaaaacccaagccttaacgctttcgacctcacgggccgcctgccgacactgtcgtcaggcggtcacttcacttttcatgcgtcagctgaacgatcgtcggcacggtcgcgctcggcccgaaaaaagacctttgcaggagcaactcaatgagcaaacccgataaaaaccaagcgacgacggaaaacgagccgtcgcggattcgtgaaggtttgcccttccccctcggcgccacctgggacggcctgggcgtcaacttcgcgctgttctcggccaacgccacgaaggtcgaactgtgcctgttcgacgacaccggcgaaatcgagctggagcgcatcgagctgcccgaatacaccgatgaaaccttccacggttacctgcccgacgcccatcctgggctgatttacggctaccgcgtttacggtgcgtatgacccggccaacggccaccgtttcaaccacaacaaattgctgatcgacccctatgccaaacagctggtgggcgaactcaaatggtccgaggcgctgttcggctacaccatcggccacccggatgacgacctcagtttcgacgagcgcgacagcgcgcccttcgtgcccaagtgcaaggtcatcgacccggcgcacacctggggcaacgaccaaccggtgcgcgtgccgtgggaccgtacgatcatctacgaaacccatctgcgcggcatcagcatgcgccacccttcggttggcgagtcggtgcgcggcacctgcgccgggttgatggaagacgatgtgctcaagcacattcgtcagttgggcgtgtcgtcggtggaactgctgccggtgcatgccttcgtcaacgaccagcacttgctgcaaaaaggcatgaccaactattggggctacaacagcatcgccttcttcgccccggacccgcgttacctggccagcggcaagatcgccgagttcaaggaaatggtcgcgcacctgcacgaagccaagctggaagtgatcctcgacgtggtctacaaccacaccgccgaaggcaacgaacgcggcccgaccctgtccatgcgcggtatcgacaacgcctcgtactaccgcttgatgcctgacgacaagcgcttctacatcaacgactccggcaccggtaacaccctggacctgagccacccgtgcgtgctgcaaatggtcaccgactccctgcgctactgggccaccgagatgcacgtggacggtttccgcttcgacctggcgaccattctgggccgttaccgcgatggtttcgacgagcgccacagcttcctcgtggcctgccgtcaggacccggtgctgcgccagctgaaaatgatcgccgagccctgggactgcggccccggcggctatcaagtgggtaaattcccgcccggctgggtcgagtggaacgaccgtttccgcgacaccgtgcgcgcgttctggaaaggcgacgacggccagctggccgatttcgccgcacgcatgaccgcctcgggcgagatgttcaaccagcgcggtcgacgcccctacagctcggtgaacttcatcaccgcccacgacgggttcacgttgcacgacctggtgtcgtacaacgacaagcacaacgaagccaacgacgagaacaaccaggacggcagcaacaacaacctgtcctggaaccatggcgtcgaaggccctaccgacgacccggaaatcaacgcgctgcgcctgcgccagatgcgcaacttcttcgccaccttgctgctcgcccaaggcacgccgatgctggtggccggtgacgaattcgcgcgcactcagcacggcaacaacaatgcctattgccaggacagcgaaatcggctgggtcaactgggatctggacgacgacggcaaagcgctgctcaagtttgtgaaacgcctgatcaagctacgcctggcctatccgatcctgcgccgtgggcgcttcctggtcggcgattacaatgaagacatcggcgtgaaggatgtgacttggctggcgccggacggcagcgagatgagcattgagcagtggcaggacagccagggccgctgcctgggcatgctgatggacgggcgcgcccaggaaaccgggattcgtcgccctggtggcgatgctaccctgctgctggtggtcaacgcccaccacgacatggtcaacttccgcctgccgcccgtgccggagggtgaattctggacctgtatgctcgacaccaatgagcctgcggtgcgtggccaggaacgctttgatttcgagcacgagtacgccgtgaccggccgctcgctgttactgtttgaactgcagcacgacgaggtgtgagatggccctgcatggattccttcaaggctaccggagctatgcggacacgcaggccttgggtaatgcactgaaggcgcttcaggaagaaggcctggaccaactgccattgcccggcagcggcgagacattggcgcgcttcagcggcctcgcccaagtggcggggcatgacttgcgcctgtgcaagctgttcgaaggccataccgatgccttggcgatcatcgccgaactcgacagccccttgccgccactgggcagcatttggggcatgtgggctgccgagccgccgacggccaaggtacgtgtgcgtcgcgacggccaccggttgctcgtcgaggggcgcaaggcctggtgttccggggcggccgtggtcagccatgggttgttgaccgcctgggatgaagaggaccgccagcaattggttgccgtggacatggaccagcccggcatcaccgtcaccaatgaaggctggaacgccgtaggcatggcggccacaggcagcgtagagattgtgtttgacgcggccaagggcatcgcggtcggcgggccgggggattacctctcccggccaggcttttggcacggcggtgtcggcatcgcagcgtgttggtatggcggcgcgcaacgcctggccgaagtgttgcgcgagcaatgcaccaaacgccctgaaccccacgccctcgcccacctgggcgcggtggacagtgtgctgaacagcgccgcgtgcgtactgcgtgacagtgccgaacagatcgaccgcgacccgcgggccgatgcgcgcctgctggctcagcaggcgcgcgcctgcatcgaagataccgtcgaacaggttattcagcatgtcggccgcgcggtcggcgccgggccttattgcaaagacccgcacttcgcgcagttgatggcggatttgccggtgtacgtgcggcaaagtcatgccgaacgtgatctggcggccttgggtgaattggtcgccggcgattccacacggaggtggcatttatgaaacctaatccgattgttggccagggcacgccgctgcatcagtggcaagcgtcatcccatatggctgagctgccgcagatcagcgtcgagcaactggtgcccgaaggtcaccgcgcggtggtcatcgccccgcacccggacgatgaagtgctcggctgtggcggcctgttgcaaggcctggcctcgctcgggcggccgattcagctgatttccgtgaccgacggcagcgccagtcatccaggctcccggcgttggccggtggaacgcttgagcgtggtgcgcccgcaagagtcggcccaggctctgcaccgtctgggcttgccgctgcacagcctgaaatggctgcgcgcaggttttgccgacagccaggtggcagccggtgaagagcacttgtgcgcctttatacaacgctacctcaagcccaccgatgtggtattcaccacctggcgcgaagacgggcattgcgaccatgaagccgtcggccgcgccagtgccaaggccgcccaggcggtgggggccacgctctacgaactgcccgtgtggacctggcactgggcaactcccgaagacagccaggtgccgtggcatcgcgcgcgtaaaatcctgctgacgcccgaggcggtcgcgcgtaaacgccacgccattcacgccttcgccagccagctggaaggcgacccgcagatcggcctgccaccggtgctcgcgccctacgtggtggagcgcctgctgcaaccttttgaagtggtgtttgtatgagcgttgccacgccctatttcgatcaactgttcgccggcaatgacgacccgtgggcgtttcgccaacgctggtacgagcggcgcaagcgcgccctgaccttggcgttgctgacccgaccacgctacacctcgatattcgagcccggctgcgcgaatggcgagctaagtgccgaactggcgccgcgctgtgatcgcctggtgtgttgtgacacggctgccgctgccgtggcgctggcgaaaaaccgcttgctggggtttgcccatgcgcaggtgcaccaaagccgcttgcccgaacaatggccgacggagccgttcgaactgatcgtgttgagcgagctgtgctactaccttgatgccgaagatttgcaccgtctgattgattgcgccctcgcctcgttgaccgacaacggccaactgctggcctgccactggcgcccggccatcgacggctgcccgcaaaccgccgaacaggtgcacgcactgctgcaacaacgcctgggcatgccgcctgttgcgcagcatcacgagagcgatttcctactcgacttatggagccgcgacggcacctcggtcgcttcccacgagggcttgcgatgatcggcattctgatcccggtgcataacgaagaagccctgttggccgagtgcctgaacgccgccctgattgctgcgaaccatcccggactgcagggcgaagcggtacagatcctcgcggtactcgacagctgcgacgatggcagtgccgccatcgcccaggcctatccggtgcaaagcctgcacgtacaggcccgcaatgtgggccatgtgcgcggggtgggcgcgcgccatctgctgaatctgggcgcacgctggatctcctgcaccgacgccgacagccgcgtagcgcccgactggctggtggcgcaattggcgctgggcgccgacgcggtgtgcggcacggtcaccgtcgatgcctggagcgaagatttcgacccggcagcgcaaattcgctacaaccaggcgtatgaggcacgcgaaggccatcggcatgtgcacggcgccaacctgggcgtgagtgccggcgcctatgtgcaagccggtggttttgagccgttggcgtgccacgaagatgtgcaactggtgcgtaacctggaacgctgcggcgcctctatcgcctggagccacaccccgcaagtcatcaccagcgcgcgcctcgattgtcgcgcccaaggcgggtttggcgactacctgaaaagcctgatgcaggcctcctgaaaaaaatcgacattacaagatgtaaaagcgaccaatccttgactatgctgacattgcctcgctggcactccagggttggagtgtcgcacccgcgcagcggagtctgcgctgactaaaagagcgtcgtcccgtcaacggggtacgacccagcaccatttgacaaggatgtgacacccatgaagcctgcctccttaggcgagggccgccgcggccccgcgcaaatctggaacagcgccccgcagttggcgcaaatccccaccgtcgcaccttcaacgctcgtgccgcccggcgcgcgtgtggtggtgatcgccccgcaccccggcgacgaggtgctggcctgcggcgggttgctgcaactgctcagcagccgcgaacacccactgctgctgatttcaatcaccgatggcagtgccagccaccccggctccaacgcctggccggcgagccgcttgagtgtgattcgcccccaggaaagtgccgaagcgctgcgtcgcctgggcatgccattgcacagtttgaagtggattcgcggtgggttttgcgacgacgccctggcggcccgcgagcagccgatgagccaatttattgcacgctacctgcaacccggcgatgtggtgttcaccacctggcgcaacgacggcaatgacgaccacgacgccgtcggccgtgccagcgccaaggcctgcagcctgattggcgcgcgcctgtatgaattgcccatttgggcctggcattggccggtgcgcgaaggtgcggtgatcccgtggcagcgtgcgcacaaggtgcgcctggattcctggtgcgttgcgcgcaagctccacgccgcccatgcgtatgcaagccagttggtcggcgacccgtcaatcggcctggcgccgatgctcgcccaggagctgctggagcggatgcgcgagccctatgagatcgtgttcgcctagggcgcgaggcgtatgtatcacagtgtgtaccgcgcagccgaggatacacagcgtttaacccagggcacttcctgaaacatgcccgatacagcacagcggtcaactgagcaccaggcacacacccgccgcaggaggctcgccatgcacactcagttgactcaccgctccaaactccgcccgctgttcctggcatttgcactgttgccgctcggcgccgtgggcctggcccacgccgagatgcccgagccgcccacgcccgtcagccatagccaaaccgcgtttggcacgcttaaacacatcaaggccggcgtgctcgatgtggcctatgccgaggtcggcccggcgaatggccaagtggtgatcctgctgcacggctggccctacgacattgacagttatgccaacgtcgccccgctgctggcggccaagggttatcgcgtgctgatcccctacgcccgaggctacggcgacacgcgttttctgtcggataaaaccctgcgcaacggcgagcctgcggcattggcgcaggacgtgattgacttcatggacgcgctgaagatcaagcaagccgtgctgggcggctacgactggggcgcgcgctcggcggatatcgtctcggcgctgtggcccgagcgggtcaaggcgctggtgtcggtgagtggctacctgatcggcaatcaggctgcgggccacaaccctctgccgcccaaggccgaattgcagtggtggtatcagttctactttgccaccgagcgcggcgctgccggttaccagaaaaacacccaagattttgccaagctgatctggcagaccgcctcgccgaaatgggcctttgacgatgctaccttcgcgcgcagcgccaaaggcctggacaaccccgaccacgtcgccattacggtctttaactatcgctggcgcctgggcctggtgcagggcgaagcccactacgacgcgctggaacaacagctcgctcagtcaccgagcattggcgtaccgaccatcaccctggaaggcgacgccaacggcgccccacacccgcaacccgaggactacgccaagcgcttcacgggcaagtatgcgttccgcctgatcagcggcggcattggccacaacctgccgcaggaagcgccggcagcgtttgcccaggccatcgtcgatgcggatcacctgtaaggtttttcgcccccctcttcacttcatggcggcctgcacagtgaaacgcttacgcacgtgcgacaactgataggcaatccccagccagataaaccaggcgggcatcacacacagcgccaatcgcgtgtccggtcgcaaggcgagcaggcacagcacaaagccgagaaacgccagggtaaaccacgccatcggcacaccgccgggcattttgtagatcgattgagcgtgcaagtccgggcgttttttgcggtaggcaatgtaggacgcgaggatagtcgaccaggtaaaaatcaccaggatcgccgacaccgtcgacacgatggtgaaggccgtcatcacctccggcaccacaaacagcaacaccaggcccagcagcatcaacagcgtggtgaacgccaggctgaaaaacggcacgctgtgggtcgacagccgccgaaatatgcccggcgcgtcgcccaggtcggccaaaccgaagagcatgcggctggccgaaaacaccccgctgttggccgatgaagccgccgacgtcagcaccacgaaattcacaatgcccgccgccgcgggaaagcccgccaccaggaacagctccacaaacgggcttttgctcggcgacacgtgctgccacgacgtcaccgcgatgatgcacgccagggccaacacgtagaacaggatgatgcgcagcgggatcgagttgatcgccttgggcaaagtcttctccggcgcgcgagtttcagcggcggccgtgccgatcagctcggtgccggcgaaggagaaaatcgccatctggaagccggcgaaaaagccgaacagaccattcgggaacgccgcctgttgatccagcaagtgactcaacgaggcggtgacgccggtgggcgacacaaacgcactggcaatcagcaccaggctcacgctgatcagcgttaccacagcgatgatcttgatgatcgcaaaccagaactccacctcgccgaacagcctgaccgtgagcacgttcaacgcgaacagcgtgagcaacatgcccccggccggcatccacgccggcacaccgggaaaccagtactggaaaaacccgcccaccactactgcatcgcccaccaccgccacgctccagctcagccagtacgaccagccgagaaaaaacgccgcgcgcggccccaggtaggcaccggcaaagtcagcaaagctcttgaagttcaggttggataacagcagctcgcccatggcgcgcatcacgaagtacacgaagagcccgatgatcatgtagatcaggatgatcgaggtgcccgacagcgcgatgattttgcccgaccccatgaacaggccggtgccgatcgcgccccccatggccatcaactggatgtggcggttgctcagggtgcgttgcaacgcaggcttttctgtcagcccgggcgtggttgttttcatcacaaaacctcttgttatgtttttgagttttggcagaaaaaagaatcagcggttttttgttcttgggttcaggcggtcttgctttcgaaaccgtgcagcacgttgacggcattgatgccgatctcatcgaccatgtagccgccctccatcacgaacagcgtgggcacgccgacgctggcgatgatttcgcccatgccgatgaagtcctggctgtccaaaaggaagtggctgatggggtcgtccttgaaggtgtcgacgccgagggaaatcaccagcacctcgggggcgaagtggcgcagttgccggcaggcgtcgagcaacgcgatggtgtaatcggcccaggcggtgtttttcggcaacgggtaattcaggttgaagccttccccggcacccgcgccgcgctcgctgctgaacccggaaaaatacgggtaggacaccgccggttcgccatgcagggaaatgaacatgacgtcggcgcgctcatagaaaatattctgggtgccgttgccatggtggaaatccacatcgagcaccgccacacgccgggcgccttgggtgatcgcctgttgcgcggcaatcgcggcgttgttgaggtagcaataaccgcccatgtattcgcgggcggcgtggtgcccaggtggccggcacagggcgaaggcgctgtgatggccttcgtcgatcagggccaggccggtgagcgcgatgtcggcgctggtcttcactgcgtcccaggtggtgcgggtgatcggcgagccggcgtccatggcgaagaaacccagcttgccgtcgatgaaatccggcacctgttggttggccaggtcgcgcaccggccacaccagcggcagtgcgtcatggctgcggccaatcgcggtccattgcgcccaggcggtttcgaggaaggacacgtagcgttcgctgtgggcattgacgtaacacgcgcggtcgaaggtgcgcggcacgatgatatcgcccagcccgacctgccggacgcggtcgtgcacggtgtcggcacggctgggttgttcgaatgagggcttaagcacaccgtctttcaattcggtgccatggtgcaaacggtgggcatcactaaaaacagtcagcatttctcaacatccccgagtaaaagacaggctctattttgttcgggcgaggctgggctttctttgcttttagttcgcgcactgttaggtttatcgggaatatttaccccggcgagagcaaattatgaaaaataaaaccaaacaggtcgcgcttgacgacaccgatctcgccatcctcgcgttactgcaggaagacgcgagcatttccaacgcccaactgagcgagcgcctgtccctgagcctgacgccgtgctggcgtcgacgtaagcgcctggaagaagaaggcgtgatcaaggactaccaggccaacctggatcgcaaactgcttgggctggacatcatggccttcgtgcatgtgcgctttgccatccacaccgaccacgcgccggacgcgttcgaggcggtggtcaaacaactgcccgaagtgctggcctgtcacaaaatcactggcgatgcggactacctgctgcaggtgctggcggcagacctggacagttacagtgagtttgtcgagagcgtgttgcgccgtcagttggggattgcgtcgatccaatcgagcctggcgctgcgtgaggtgaaggcgacgagtcgggtggctataaccgcggcgaaactcacgtaagtgttttttaaaacccgcttcaaaaatcggctggactcgagagattggcaaagataacatcacatagccatcactggttaaacttggtcattcagacggtcaccacaacgcgttgtattagccgaatttcaggaagcgtaaattaaaggtttcaaggaagtcaccatgcaacagattaatgaggcgcagcagcttgagtatatattcagtcaaacagcagtaaaagagctgaaacgcaagataaaatcattcgaatctctgtacccgactctgcgccaagatactatctatacccatcttaaagatactctacttattgatatacctcctttaagagcgtcctctttttgcggacagctgagaacgcttctccccagtgcaaccctctggcgaagccgaaaagtaaatgaatttaaagaaacactagacgtctcaacgttttgggcaccttcaccagagaaggtgagtgggtacggacgcatgaacagaccgtcgcagggcgtcttatacaccgccgagcacctgcttacgacactggctgaaatcgacctcagtaaagatgaaaaatcccttctcattgtctatcgagtaaagtcaccccttgaatttatcggcctgtacagtgattttgacaagcaactttccgcgtcagccactaaaaaactcaatatcatcaaccgcttcatcaaacgaagtttgttggcaaaaggtgaggccgcctatttattcagcagcgagtttgtaaacgaattcttgaaaattgaaacagacggatggttctatccctctgttgcgcgccatggcggtactaattactgcatccacccccacgcggcggataagttcgaactgttgaaaatatataccacgcagggcgtgcgtccaggcatagctggccccttacttggggtatacgaagctgacgcgtcaggcacgtatcactatcgggcggacccggtgtacgccaatgcagactatgaggcctttggctctgtgtatggaggcgatggctcggacccagacaaaacgccactccacgaacggaatttaattgattaccccgtcatagtcacccgttgaattgcaaatgagttcacacaaataacgacgtatttcgagacgactcaaccatgaacaaaaacttattagaagctcggctgatcaccagtttgacagacgcctacgcacgcacttcagccgtggcgttgcacaggatgcgttgggcgaattggacactccttgactccgaagagccaccgcagtatttaattgatgatgatgaaacacttttaaaaccgttcgagcagttgactgacagtatctacttgacgacgctggccttgctcgaagttgtaaatatgcccattctcatcgatcaatgagaacatatattcggacctacgcttggcgcgcagccgacgcgaacaatttttgaggtagacactgaaacgggcgaatattacagccccttcctaactgacttaagccgttttttagcatccatcgggatttctactgacgccgaagcctattacgcacaagcgggggtcaagtacctcgaaaacatactgaataacaccgccatgattatccacaacagtgggaacgccgtatcgtcggaggcgcaggtttacaacagtgtcaagcaggtcatcgaagcggtttttcctgacaccgccaaacctagatccaatttcatcaagctggcacaagaatataaaccagacattctgatccccagcattgcaacggccgtcgaatacaaatacgcaacaacgccggaaaaactcaaggcaacgatagggcaaatcgcagaagacgtgcttggctataccggggatgacgactaccgactgttctacgcggtgttttatgtcaccgatgacttaataggcaaggaacgctttaacgccatttgggaagaaaagaatttccctcaaaactggaaggccttgtatatcgttggccggtaggcgtaaccgcgctagttgacaggcttttaaatagcaaactacctatttacccacactcatggagcgactgtgacgcacgtctttgccccctcggaatccacccttccacccgcctcgccgtcggaattccgcttcctcagacgcctcgggatgttcgtcctcgcggcgttgattatgctgctggcgcccattcccggcctgttgctggtgccaccagcgatgcaaagctacttgatgttcgtgaccagcctgggcgtgatcgggttgctgctgtgcggcctgttcgtggtgcaacaccggcataacctcgctgctaggttttacggccagcacatccgaaagactttgcgcctgggcgcgattgccctgatcgccgcgtatgccctgttcgggttgctggccaccgcattggggttaccgcgtgaagcattcatggctgagctgtacagcggcctgacccagtggcaaaccctgatcaaattggcgtcgctgattatcctgccaccgattgccgaagaactgatgatgcggcactacctgctgcgcctgtttccctacgagcgcagtgtggcctggaagtggacggcggtgatcgtgagctccgcactgttcgccagcctgcatacccaatacggcagttggaacacgttggtgttgatcttcgtgctgggttgcctgttcgcctgggcgaggattgccagcggcggcttgctggtgcctatcttgctgcacatgctggcggaagtggtcgggtcgagcctcgactggacctggacctgggccgggctttacggctgatcccaggcattcttcggaatgggcgtaacacggggtgtttacgcccgcctcccgcagtaaagcggtaaaacgcctcccgccgaaatgtgaaaaattcgttaactaattctcccccaaggctttttcctacggtctcaatctgacaaactgatgcgaataattcttaacatcattattattcgccagggacggcgcttcggggagagtctgttccatgtctgtgcaacaaccaatcggcaagcgttttacacctaatttgatcgcgatggcggtctgtatcgccagctcacaagcggccttcgccgccgatgcgcaacaaccgtcagccgtggtggaactgggcgcgacgcaaatcaataccgagcaacaactcggcgccaccaccgaaggcagccagtcctacaccaccggctcaatggccaccgccaccaagctgccgctgaccttgcgtgaaaccccgcaggccgtcacggtcatcacgcgccagcgcatggacgaccaggcgatgaccagcatcaacgacgtggtcagggccacgcccggtttgttcctcaactactccaacggccctgggcggcagtcctacaaggcgcgcggtttcgacatcgacaacctgatgtatgacggcatcccgaccggctacaacggcgttgacgtaggcgcccagccaaacctggcaatgttcgaccgcgtcgagatcgtgcgcggcgccaccggcctggtcaccggcgcaggcaacccatcggccgccatcaacctggtccgcaagcggccactggacgagcagaaagtcaccctcaccggcgccgccggcagttgggacgactaccgtggtgagctggacgcctccagcccactcaacgacagtggcacgtggcgcggccgggtcgtcacctcttaccgtgacgccaacagcttcatcgataaggtcgaggaagatcacggcctgttctacgccgtcaccgaagccgacctgagcgaagacaccaccctgaccctcggcttttccaaccagaaggacaagaccaattacttctggggctcttcgatggtcggccaggatggccatcacctcgacctgccgcgctcctacaaccccggcacccgctgggagaacaaggaccaggagatcaacaccgtattcgccgaactgcgtcagcgcctggccaacgactggagcctgcaggttaacgccaactacgccgcacaggacgcgctgttctccggctcctaccagtcgcgctgggtcaacaacactccggcgcgcacggtttaccaggccgcctacgatgaaaatcaggccggcatcgacgcgttcgccagcggcccgttccaggcgttcgggcgcacccacgaactggtggtgggcgccagcaagcgcatctacgacatgaccacccacaactacagcccgtacgacatgaactggccgctgacggcgggcaaaccggatttcgtccacaccaacaaccagcgcgaagtcaccacccaggaaggcgtctacgtgaccacgcgcctgagcctggccgacccgttgaagctgatcctcggcgggcgcctggactggtacgactacgacaaccgcgatggcgacggcgactttcatgtcacccgtaacctcacccgctacgccggcttgatctacgagctggacgaccatcactcggtgtacctcagctacagcgatatctttacgccgcaaagggacaaggacacgtccggcaacccgctcaagccgattgtcggcaaaaactacgaggtgggcatcaagggcgaatacctcggcggcgcgctgaacgcgagtgtggcgctgttccgcgtcgaccaggaaaaccgcgccgtgccagtggtggtgccgaactgcccgcaggccgcgtgcagtgaagcctccggcgagatccgcagccagggtatcgacctcgaactgcaaggcgcgttgaccccgaactggcaggtcggcggtggttacacttacgcgcgcacccacaccatcaaggatgacgccaacccgcaactggtcaacaagcagttcgacaccgacacgcccgagcacctgttcaaactcaccacccgctacaacttccagggcccactggaaaaactgcgcgttggcggcaacgtctcctggcagagccgcctgtacaacgacctcaaagtggctgacggcagcacctaccgcctgcaacagggcagctacgcggtcaccgacctgatggccggctacgaggtcagccagcacctggacctgcagctcaacgccaacaacatcttcgaccgccgctactactcaaccatcgccaacgacgtgagctacggcggtgatgcttacggcaacccacgcaacatgatgctcaccgccaagtacagtttctgacctgccctgccccttcggctatccattcggatagccgctcttaaagtcccgctcagggatgccgataacaccatggcatccctgcatctgaaagcaatcgaacacctgcttcactccaccggcgtcccgtgtggcacgccgcatgcttagctgtttccggctcgaccacatggagtaagagtgaatgccgacccgcacgcgttttttcgagcactaccgcaaggctgaccgcatcatgctggcgctggtgtggctgatgttcctgttttccgtaggcctggcgttctggcacgacacactgctgcaggccgtgatcgtcggcggcggcaccagcgtggtgctgacagcactctatcgcgccatcgccggcacccgcctgatgcgctgcttgttgggcgccggcttgatggtgatggccgccctgcacatcaaccaggcgcaaggcgtgatcgaatcgcacttcggtattttcgcgctgctggccgtgctgaccttctaccgtgactggctgccgatcctggtggcggcggcaacgatcgccgtgcaccacgtggtctttcatgcattgcaacaccaaggcttccccgtgttcgtgatggaacaccatggcggctggagcatggtgttcgtccacgccttctatgtggtcatggagaccgtcgccctgctctacctcgccattcacagccagcgcgaagcggtcgaaagccaggaaatgcttgaaaaaatgctcgccgtaaccacccaactcaccgtcgaaaccgcccaaggtgaaggcaaggtgcatgtgtcgctggccaagcgtttcgaccacttcctgcagcaaatcacccaccttatcgacggcgtcgcccgcgactcccacggcctcggccaactcggccaggaactggccagcgccagcggcaccctggaaaaaggcgcacgccatcagttggccgaaatcactcaaatgaccggctcgatgcagcgcatggaagacgccatgggccacatcaccgtgcacgtcgaacaggccgtcgaacacgcaggccaggccagcaaacaaatcgtgcgcggccaggaaagcgtcggccgcgcccagcacgaaatcagccaattggcctcacgtatcaacggcaccaacgagaccgtgcaaggcctggcggtgcaggcagaacaaatcggctcggtactcgaagtgatcagcagcatcgccaaccagaccaacctgctcgccctcaacgccgccatcgaagctgcgcgcgccggcgaacaaggccgaggctttgccgtggtcgccgacgaagtgcgcagcctggcgcagcgcaccgccgtgtccacccaggaaatcaaacagatcatcgaaggcttgcaacacggcagccgtcaagccgtcgaggccatgcacgacagccagcaaggcgtggagcgttgcgtgcaagacagccaagtggcagtggaaatgctgcaagcggtgggcgccgacattgcgcacatcgacgaactgaacgggcggatcgtgacgaccacccgcgaacaatccacggcgaacctggagatcgtcgggcggttgcagtcggtgcagagcattgcgcaaagcactgccgatgatgtggagacactggcgcgcagcagtgagcggctaccgccgattgcggtgcggttggatgcgttggggaggcggtttcatcagtaggctttacctggcctcacctatttcgccgactcaaactgaacattccccctccacactgaaaaggaaaaaccatggcccaagacatctacctatatgcaatcgcctccggagtgctgggggcggtgtcttcctatttgctcatgcttttttccggcttcgaaaaattgccttcgagtgttcccgatcaaagtaaggctattgtgattcagcgcctctattttctcttgggacgcatgctttttggcgcagtcactgccgtaatattaatatttttcttaatggactcgtaccttgcccacgagctctccaagtacaaactatgcggttatacaagcctggcaggtttcagtgtgtccaccctaagccagctctctaaagcggttattcctcagtggctggcaaggcgctagattgccagttcaccctacggaactggcaaatgccccaggtgagcgttaactcccagatcactcgaagccgccagccgttcggctgcacgcggaaacaggttcaacgcattacgaccgttaaactgaatttgctcaggtgtgagacaggcctgttagcatgagtttgttcgccattttcgttcaccataacgcgtagattgtccaaccgccccactccccttatcctcaacactccccgcccagcccacaccggagccgccatggacctcgccacgctcgccctcttcctccccgcctgcttcgccctgaacatggcgcctgggccgaacaacctgctgtctgtgagcaactccacacgctacggctaccgcacttcatgcctggcgggcatcggccgcttgctggccttcgccggcatgatcgccctcgcctccgcagggctggcggtggtgctgcaaacctcggagctgctgttctacgggatcaagattctgggcgcggcgtatctgttttatctggcgtttcaattgtggcgggccaacccgcaagcagaggcggaatcagccgcgtcgaaggtgggattgtgggcgttggcgcgtcaggagtttctggtggcggcgggcaacccgaaagccatcctgattttcaccgcgttcctgccgcaattcgtggtgcccggccagccgatcacgccacaatttgcgctgttgggcgcgatgttcctggtgctggaatggatcgccatcagcgcctacgcctatatgggcctgcacatgcgccgctggtttgccgagccgaggggcaagcggatattcaatcgctgctgcgcggggctgttgtcggcggcggcaacggttttgttgatggcgcgtcgggcctgattattcgaattaacggccctgcgcttcagctgtagagcgcctgcacacagtggcggtgctcaggcgaaagaatgtgtgaactcagtgtgttacaggctgacggagtcggtcatactgttgcgcactgccacagtgactactttttacctatcacgcaaacgcatgcgccggacgttggtcgatcattaaatggacttaataaaagcaccttccttgcacttcgaacttaaatttggttcgccgccagccccgacattcgaaaaattcgatcccgctataggtgttgacggttactgcgcagccatacgcaagtacctgatccccgattcgacacccgacacgttcagtttcgcggcgttgcccttggaatcacgtacttattgtaaagggtctattttttcaagggtgcgtagaatacgaaatgaaaagctggaaacactcttaaaaaaccctctagcggtcagcgatttttttcctccagcgtccgaaactgtacaaacccgtgctggccgtttcaatgccgtaggagaacgtacgctatatttggccgaccatgcgtttgtggcactgaaagagtgcgagatccagccaggcgaacacttcctgttcagttatttcgtactcaaaaccgatatgcatttcgtctacgccccacctgaatcctcaaaatacacaaaactgataaattcattactcaagagcaaagatgagagtttttacccagtcatcacccgcatttataatgagtatctcaagtatgatacgcaccacggaatcgcttatgactccgtaaaggtcatcgaaaaattcaacgacgcaaaatggggagaaattagctctgttacaaaccttgcgatggatgaggacaagctacctgccgcctacctgcaagtcggttggcttgcccaatgcgatgagcattatcgaccccactatttgaaaatgcttttacccgacatcaagaagaaaaaaaggctcacgacactgacgtatcaccataataaatcacggttcatggctgaacataacaaggtggaacagagggtcgctcagcttagaaacacgactataagttccatcaaacgcaacaactatgaacaggtcaacacgacgcctttcaaactactgcaccaaatataaaacgcatgagcgactgaagcaacacaccgtgcgtaagaacttatcgccacaacaacgaacaccctcaacggaggcataatgcaatttgcagtagcactcatcgagtacttgatttcgggcgtcgtcgcatcggcttggctgacagcggtacttcttaaccactacccactgctgctacacacgatcaatgaccataaagatatactgattctggtgtacctgcccattgcctatatcttggggatttatgtcgatgccacatcctcatatattatacgcagagccaaagagctactcagctggcttaataaacaggtgactctttcaccgacaatactgaataggctaaagcggatatatcgttttattgtaggcacacccaaagcagagccttacaagaacaccgccgcgatcatggcttactcccctgcggatgctgtaagaacgatggaagcctatgtcagcagggaccgaattgcccgcggcacggcactcaatgctttcgcgggtgctgtggtcgcgtgtttttatgcgccgtttgaagacaaaaccctggtaacgacaatctgcctcgtcgcattcgtgtactcgatcatgatgcataggcgactaagccgcctctcatcaagtttcaaggaggtggtattgaaaaacctgaaaaaaaagcacgcgcccgccgagcagcgcgaggaagaatgagcgcttttaaccgaggagcacgcggcatgacccgaaaccagctcgccgacctttaccgcggctacatcgactgcctcaaccgccaggactgggaacacctcggtgccttcgtgcacccgcaggtgacctacaacgccaccaccgtaggccttgccggttaccgcgcgatgctggagcgggactttcgcgaaatccccgacctggtgtttcgcatccaattgctggtctccgacccgcccacggttgccagccgcttgaatttccacgtcacgcccaaaggtgaatttttcggcttgccgatcaacggcaagacggtgaccttcgatgagaacgtattctacgaattcgtcgatgggaaaatcgcgcacgtctggtccgtgatcgataaggcggcgatcgaacaacagctttaacggatggagccgcttgtggagaacccgcttttcaccttcaccacccagccttacccgccacgccagcgctttgaagtgtggcgtgaagaagtgaatgcaatcttcgatatcaacatcagcgaaccggaatcctcggcgttcaattaccgcctggccaccggttatctcggttcgttattgatgggctgcggtgcctgggacggtgacggcgcgccggtgccgtatcgggtcaagcgctccacgcagatgattcgccgtgacagcctcgaccactactacctctgcctgggcctgtcccacacgatcaatggcacagctggccgcaccactctggcggcgagtaactcgcaaatctacatcctggacctggcccgtgaactggattgcctgatcacagccggcgacacggtaatcctcactattcctcgcgacttgctggcgcccagcctcaattacaaagacgtgcatggccaggtgctgcaaggcggcttgagcgaactgctcgccgaccatatgcgcgcgttgcaacagcgcctgccgcgcctcacgcccgatgaaatcccccacgcccaacaggtgactctggccatggtctcggcggcccttgcgccgtcggtggccaacctgcaaagcgccgagcaggccatcgaccacaccctgttcaaccgcgcccggcgcgtgatcgaacagcacctgcgcagccccgagttgtcaccgggtttcctgtgcaaacacttgggcatttcgcgggcgcaactctaccgtgtgttcagccacgaatccggcgtggcggcgtatatccagcaacgccggttgaaccgcgcgcggatgattatccagagtgaatccggcgcacggcagcgggtatcggggttggcgtttcagttcgggttcaagagtgatgcgcacttcagtcgcaccttcaagcaagccttcggttattcaccgcgcgaggctcgcgagttgcacactgctgcccaggggccggggcgcgagagccggcacaccgggttctcgttacgcaacatcctggggcagatgaaaccgggttgagacgcccaggcaagtcattgagacgcggagacaggaagtttttttccgcgtttttttcaccgttttatgattggccgatgttttaaagccctgactaaacggagaaaatcatggcccgtcgtaccgttatcgcaacgcttgccaccgccctcctgctgaccggttgcgccaatggcgtcaacggcctcaacagcttgaacaacctgtcattgccgggcattcagggcaaggccgggccggatatttcgctgttcgacaccacgtatgtcaggacgcacatcatttccggcaagaccaccgcccaagagctcaaagccctgtatggcgagccgcaagaccagtcgatttcctccgacggcaccgaaacctggaactactcgccctccaccacccagaatgcgtccatgcgccacttgctggggctggtgtccaaccgtatccccggcaatacctacgacaacgccctcgacacccggcgcaccgccatcgacaacattgcaccgcagcaacaaagccgccgcctgaacatccacctcaacaatggcgtggtcagggactacagcatcctgtaacagcagcgcccggcacaagattggcaagcgggcttgctgtggcgagcgggcttgccccgcgttggagcgcgaagcgctcccaattcagccgcctcggtactgctgacagatctcattggcaggttctggggctgctgcgcagcccaacgcggggcaagcccgctcgccacatcaagccctctcgccacaacaagcccgcgcgccggagcaggttgtggtcggcagttgaagcgggggttgacacattccgtcacatccgctgaagatggaggccttcttcagggtgtgtcagcgcatgtctgcatcgtctttcgttaacctttgtgccattggcttgaatgccaaggcgcaaggttgcgtggcgcacgccctcaaatcgaagaaacagtcgctcatgtgaccggggcgcgctgtcccgtcagatgagctgacaggacattgagcgcgacggacctccctccctttgcacaatccctctgcccttctgacggtgacttcagcggtcaaccatcaggagaaagtgcatgtcatcgtttcaaggtatctgggttcccgtggtcacgccgtttcatgacggcgccatcgactttatcggcctgcgccgcttggtcagccacctgctggaaaagcacgtggccgggatcatggtctgcaccaccaccggcgaagccgcctcgctcagccgtcaggaacagttggcggtgctggatgcggtattgcagctggtgcccgcgcaccgcgtggtgatgggcctggcaggctacaaccagatagaactgctgcagttccaacgcgaaatcctcaaacgcccgctggccggtttgctggtgccggcaccgagctatatccgcccttcccaggccggccttgaagcgtttttccgcacggtggccgatgcctccagcgtgccgattattctgtatgacatcccctaccgcaccggcgtgacctttgaacaggccacgctgctgaacatcgtcaagcacccgcgcatcgttgcgatcaaggattgcggcggcaacctggcgaccaccttggcgctgctcgccagtggcgatgttgatgtgctgtgtggcgaggacctgcagatcttcaacgcgttgtgcctgggcgccagtggcgcgattgcggcctcggcgcatgtacgcaccgaggactttgtggcgctgtgccagctcgtgcgggataaccagctgactgaagcccggtcaatttttttcaagttgataccgctgatcaacacgatgtttatggagcctaaccccgcgccggtgaaggctgcgctggccctggaaggcttgatcggcagtgagttgcgcgcaccgatgcaagtggccagcactgccgtggtagagcggttgcagcaggttttaatacgcggcgtttaagcgtcaaaacccgctcatgcgccaaaaaaagacatccaacggaccgcccggttgcgaccggcgcgatcccggcctatgttccaagccatgctttggattttcagcagtccccctctctacgctctctcgtaccaggtgacgacatgcccacgctttcccgccccgccgtactcgaactgatcggcaacaccccgttggtcaaggtcagccgctttgataccggcctgtgcacgctgttcctcaagcttgaatcacaaaaccccggcggttcgatcaaggaccgcatcggcctggccatgatcgacgccgccgaacgcgacggccgcctgcgccctggcggcaccatcatcgaagccaccgccggcaacaccggcctgggcctcgcactggtcggccgcgccaaaggctatcgcgtggtgctggtggtgcccgacaagatgtccaccgaaaaggtgctgcacttgaaggccatgggcgccgaggtgcatatcacccgctccgacgtcggcaagggccaccccgagtattaccaggatgtggccgcgcgcctggccaaggacattcccgattcgtttttcgccgaccagttcaacaacccggctaacccgttggcccacgaaaccagcaccgccccggaaatctgggcgcaaacccagcacgatgtagacgcaattgtggtgggcgtcggctcggcgggcacccttaccggcctgacccgcttcttcaaacgcgtacaaccggagctggccatggtgctggctgacccggtgggctcggtgatggctgaatacagccgcagcggcaagatgcaaaccccaggctcatgggccgtagagggcatcggcgaagatttcatcccctcgattgccgacctctccagcgtgcgccacgcctattccatcagcgatgaagaaagcttcgaccacgcccgccaactgctcaaggccgaaggcattctcggcggctcgtccaccggtaccctgctcgctgccgcactgcactattgccgcgagcaaaccgtaccgaaacgcgtggtcaccttcgtctgcgacacgggtacgcgttacctgtccaaggtctacaacgaccagtggatgaacgacgcgggcctgctgcaatacaaacactacggcgacctgcgtgacttgatctcgcgccgcttcgaggatggccgcgtgatcagcgtcggccccgacgacaccctgctcaccgccttccagcgcatgcgcctggccgacgtgtcgcaactgccggtgctggtggacggccagcaactggtcggtgtgatcgatgaatccgacattctgctgggcctgcatcacgacgccgcagacttttccatgaccgtcgccagtgccatgtccgacaccttgcaaaccctggccccgagtgccagcctggcagaactgcaggcggaactggatcgcggcctcgtcgccatcatcgccgacgcctcaggcttccacggcctgatcacccgcgtcgacctgcttaatcaccttcggagaacccttgcatgagtcagcctgataaaagcgcctttgccacccgcgtgatccacgccgggcaatcacccgacccgaccacgggagcgctgatgccgccgatctatgccaactccacctatttgcaagacagccccggcgtgcacaagggctttgattatggtcgttcccacaaccccacgcgtttcgccctggagcgttgcgtcgccgaccttgaaggcggcagccaggcgtttgcctttgcctcggggctggcagcgatttcaaccgtgctggaactgctcgacgccagtgcgcacatcgtctccggcaatgacctgtacggcggcaccttccgcctgtttgacaaggtgcgtcaacgcagcgccgggcaccgtttcagctttgtcgacctgagcgatctgtcggcgtttgaagcatcgctgcaagacgacacgcgcatggtctgggtcgaaaccccaagcaacccgctgctgagcctgacggacctgagcgccattgcgcgcatctgtcgtgctcgcggcatcatctgcgtggccgacaacacctttgccagcccgtggatccagcgcccgctggagctgggtttcgacatcgtggtgcactccaccaccaaatacctcaatggccactccgacgtgatcggcggcatcgccatcgtcggccataaccctgagctggccgagcgcctgggcttcctgcaaaactccgtgggtgcgattgccggcccgttcgatgcgttcctgaccctgcgcggcgtgaaaaccctggcgctgcgcatggagcgccattgcagcaacgccctcgacctggccacctggctggaacagcaaccgcaagtgtcgcgggtttactacccaggcctgccgtcgcacccgcagcatgagctggcgcgcaaacagatgcgggggttcggcgggatgatttcggtcgacctcaacagtgatctggccggcgctacgcgcttcctggaaaacgtcaagatcttcgccctggccgagagcctgggcggcgtggaaagcctgatcgaacacccggcgatcatgacccatgccagtattccagcagcaacgcgggcgcagctgggcattggtgatggcttggtgcggttgtcggtgggggttgaggatgtggaagacctgcgcgccgacctggcacaggcgttggcgctgatctaaccctgacagctgatcgttcccacgctccgcgtgggaacgccgcctgggacgctccgcgtaccgcctggaaagggtgacgcggagcgtcacgggatacattcccacgcggagcgtgggaacgatcgatgtcaggctgaggtgatattggcacgcgccgagtgcagctgatcgttcccacgctccgcgtgggaatgccgcctgggacgctccgcgtcccgcctggaaaggctgacgcagagcgtcacgggatacattcccacgcagagcgtgggaacgatcgatgtcaggctgaggtgatgttggcgcgcgcgctgtgcagctttttatagctgtcgatcaagcgcaaatgccgatccaggccttccagcttcatgctggtcggcgtcaagccatagaaacgcaccgtgccgttcaccgaaccaatcaccgcgtccatccgctcgttgccaaacatgcggcggaagttggtctcgtaatcctcaagttccagatcttcgtccaggtgcatctccaacaccgcattcaccgcctgataaaacaggccgcgctcagcggtgttgtcgttgtactgcaggaacatctccacgcactccttcgcctcttcgtattgctgcaaggcgaggtagatcagcagcttcaactccaggatggtcagctgaccccacgccgtgttgtcgtcgaattcgatgccgatcaaggtggtgatgtcggtgtagtcgtccagctcgctttccaccaggcgctcagccagtgctttaagctcgtcatcgctgaggctgtgcaggttgaggatatcagcgcggaaaaacagcgccttgttggtgttgtcccagatcaggtcgtccaccgggtagatttccgagtagtccggcaccaggatgcggcaggcggttgcgccgaggtgttcgtacaccgccatgtaggactctttgcccatgccctcgagaataccgaacaaggtcgcggcttcctgggcgttggagtcttcgccgtggccggagaaatcccactcgacgaattcgtaatccgactgggcgctgaagaagcgccacgagaccacaccgctggagtcgataaagtgctcgacgaagttgttcggctcggtcactgcatggccttcgaaggtcggctgcggcaaatcgttcaagccttcgaagctgcggccctgaagcagttcggtgaggctgcgttccagcgccacttccaggcttgggtgggcgccgaacgaggcaaatacgccgccggtgcgcgggttcatcaaggtcacgcacatcaccgggaattcaccgcccagggacgcgtccttgaccagcaccgggaagccctgggcttccagaccctggataccggcgagaatgcctgggtattttgcgatcacttcagccggcacgtccggcagcgcgaattcgccttcgatgatttcgcgtttcaccgcacgctcaaaaatctccgacaggcactgcacctgggcttccgccaaagtgttacccgcgctcatgccgttgctgaggtagaggttttcgatcaggttggatgggaagtacaccacttcgccgtcggactggcgcacgaacggcagcgaaacaatgccgcgttcttcattgcccgagttggtgtcgtacaggtgcgagccacgcagctcgccgtcgcggttgtagatcttcaggcagtaggcatcgaggatttcagccggcagttcgtctttgcggcccggctggaaccagcgctcatccgggtaatgcacaaacggcgcgttggccagttcctcaccccagaactgatcgttgtagaagaagttgcagttgagccgctcgataaactcgcccaacgccgacgccagcgcgccttccttggtcgcgcccttgccgttggtgaaacacatcggcgagtgtgcatcgcggatatgcaacgaccagacgttgggcacgatattgcgccacgaggcgatttcgatcttcatgcccaggcccgcgagaatgccggacatgttggcaatggtctgctccagcggcaggtctttgccggcgatataggtgcccgcctcgcccgtcgtattcggcatcagcagcgcctgggcatcggcgtcgaggttttccacctcttcaatcacgaactcgggtccggcctgtacgacttttttcacggtgcagcggtcgatggaacgcaggatgccctggcggtccttgtcggagatgtcggcgggcaactcgacctggatcttgaagatctggttgtagcggttttccgggtcgacgatgttgttctgcgacaggcgaatattctccgtggggatattgcgcgtctcgcagtacagcttcacaaagtacgccgcacacaacgccgacgaagccaggaagtaatcgaacggacccggtgccgaaccatcgcctttgtagcgaatcggttggtcggcaattaccgtgaagtcatcgaacttggcttcaagccgaaggttgtcgagaaagttgaccttaatttccatgcgggcacaccagaataacgggctaaacaaattggccgccattatgaagattttcgccgggaagtctcagggttttccgaattgcctgccgatcggtgctaacgtttccctcaacaactccaggtggctcccatgacaaatacaggcataaaggtcgctcctgtcagctcaggcgaatcgaaagctcaatgtcatcggcaaatggcaccgacagatagccgttcgcaggctcgcgcacatgggccaggtattccgggcagtagttggtgttgtcggccaccacccatgcgccggggcgcaggtgtttttcaaccaggttcagcacgtcgccgtacaaggccttggcgccgtccagcagcaacaggtcgacggcttccggcaagtcgctgaccagcgtcacgagggcatcgccttcacggatttcgatcaggtcactcacgccgccctggatgaaatgctcacgcgccagggcgatctttgcgggctcgaactcgctgccaatcaacacgccgccgccgttgtcgcgcagggcggcggccaggaacaaggtggacaggccaaacgaagtgccgaattcaacgatagcccgcgctttgctgctgcgcgccagcatgtagagcaagttgccggtgtcgcgggagaccggcagccacaggtccttgagcagggtgtagagctcaaggtaatcggttttgctgtgcatcaggcggtcgcgctcttcgccggatatgtcgttgaagatcgggctggtgcttgcgtcggcttgtgcgtagaggcgttcgatcaggggcgccaatggcgcggtggtcagggtcgtcatgattgatttccgtcaggttgggactaagatgcgactaatccgtcgcatttaaagtatgcgagtgattcgtcgcattcgctattcgcgttagccccgccgctggagcgccagatgacaacccgccagaccgcccgtatttcctcacgcaagcagccacaacaggcacgttctaccgaactggtggcggcgatcctcgaggcggctattcaggttttggccaaggaaggcgccacgcgtttcaccaccgcgcgggtggcggaaaaagccggcgtaagcgtgggctcggtgtatcaatacttccctaacaaggcggcgattctgtttcgcttgcagagcgatgagtggcagcaaaccacgcagttgctgcgcagcatcctcgagcaaaccgacctgccgccgctgcagcgcctgcgcacgctggtgcatgcgtttatccattccgaatgcgaagaagcgcagatgcgcgtggcgctcaacgacgccgcgccgttgtaccgcgatgcgcccgaagccgtcgaagtacgcgcggcaggccagcgcgcatttgaggcgttcatgctcgaattgctgccggacgtgcctgaacagacgcgcgcactggcgtgcgatttgatcctgaccacgctcagttcggtgggcaaggatttttccggcagcccgcgtacaaccagcgagattgaggcgtacgccgagggtatggcggacatgtttggcgcctacgtgaacgcgctcaaccaaccctgattgtttaacaaaggcataactgaaggtacacaaacggcgattgaacgcatccgcgtgcgatgggagcatcggcagccatgatttcgcgcttgtgtgtgttccgtcgccacctgcagccttccttcccgaaggtgcaggcgcgtccctgcgaaaatccgctgttcaatatcatcctggccttctgggcactgtggcattgccgccatgcgcgcccgcccgatgcacacctctgattaatccgaaccggcctcgccggcattcatttatcagaaggaacatgccatgaccgcagccatgcgccctgtcaccggtgctgcccagcgcagcgcctcgtattacaccgccagcctcaacgacgccacccactacccgaccttgcacggccaggtcagtgtcgatgtggtgattatcggcggcggctttaccggcgtcgccagcgccgtcgagctggtcgaacgcgggctcaaggtcgcgattgtcgagagcaatcgcatcggctggggcgccagcgggcgcaatggtgggcaagtcaccggcagcctgtcgggcgacgaggcgatgcgcgcgcaaatgcgcagccgcctgggcgctgaggtcgacgatttcatctggcacctgcgctggcgcgggcatcaaatcatcgagcaacgcgtcaataagtacgcaattgcctgcgacctcaagcacggccacttgcatgccgcgatgaagccctcgcacctgaccgaactgcgcgccttccacgatgaagcgcaacggcgcggcatgggcgatcaagtcagcctgctcgatcaagccggtgtgcgtcagcatctgggcagcgagctgtacctgggcgcgctgaaaaacacgcgcaacctgcacctgcacccgctcaacctttgcctgggggaagcgcgcgcggcgcacagcctcggcgcgttgatttacgagaacaccgaagtgctgcaaatcgtacatggcgagcggcctgcggtggtcaccgcccttggccgcattgacgcacgccacgtgctgctggccggcgacgtgtaccacaaactcgaacccaagcagctcaagggcaagatcttcccggccatgggcggcatcgtcaccaccgcgccgttgggcgaactggcgcagcagatcaacccgcaggaccttgcggtatacgactgccggtttgtgctcgattactaccgcctgaccggcgatggccgcttgctgttcggtggcggcgccaactattccgggcgcgattcacgcgacatcgccgcagagctgcgcccgtgtatcgagcgcacattcccggcactcaagggcgtcgacatcgagttccagtggagctgcgcgatgggcatcgtgatgaaccgcatcccgcagctgggcaagctctcaaacaacgtctggtactgccagggctattcggggcatggcatcgccaccagccacatcatgggtgaaatcatggctgaagcgctgaccggcacactggaaaaattcgacacctttgccggctgcaaacacatcaaggtgccgctgggcgatgtgttcggcaacccgatgctggcggtgggcatgtggtactaccagatgcttgagaagctgcgctgaacggctcagggttgagtgggcgatagtgtatgcgctcagtgcgccgtaaacactgggtttaagcaaacgttaaagcggcgtcgtctcaagtgcctttgttgggtgacacccaccacgtcatcgcgcagcggctaccgggctcgaagccgtgggcatactcgtcggccaggatgtccgccaggcgcttgtcgcctgtcggttgaaagcctagacgcgtgtaaaacggcgcattccacggcacgtgcctgaacgtggtcaacgtgactgaacgcagcaggttcgcgcgcgcatagtccatcgccgtttccaccaacttacggccccagccttggccttgtatggattgcgcgaccgacacttcatggatgtgcagcgcatcaccctgacgttcggcgctgagaaagccgtgtggctgggcatcagcgtcgaccaccacccaacaggtggctaacgcaatcagttgacggtgacgttcgacgctcatcgtggcggtgtccgccagccagctcaggccatcgatacggcggaatacctgggcggcgctcagctcaacgccgggcagcagcggcgcgtcgtcgggcagggcaacacgaatgtggatgtgcatgaatgacgaactcgggtggtcgcaggcgaagattaatgctcaagctcgaattgctgaaaccccacccgtgctgatatcccgcgccgcagtgtaaaggcaaacagcgcgcgctttcgagcaaatgcctgtttgcacctacgcattcactgctatgtttcgcgctcgatcaggaaaggatatgccatggaaccgttagcgccaaacgcagcattggtgatcatcgacatgcagcagggcatgaacaacccaacgcttgggcgtcgcaacaatcccgacgccgaattgcatatgcagcaactgctgggcgcttggcggcagtcgcagcgcccggttgtccatgtgcggcacctgtcgcgcacgcccggctcggtattttggccaggccagccaggctgcgagttccaggctgaactggcgccgctcaaacatgaacatgtgctggagaagaacgtgccggatgcgtttgcggccacgggccttgagcgctggctgcacatgcgcgcaatccggcagttggtgatcgtcggcgtgatcaccaacaactccgtggaatccacggcacgctccgccggcaacctgggctttgaggtgatcgtggccgggaatgcctgctatacgtttgaccaaaccgatttgttcgggcggctgtggcctgccgaggatgtgcataccctgtcgctgagcaacctggcaatggactacgccagggtgatcgaaacggccgagattctcgccggtacttaagcggtaaagacgcccgcctccaccagcatttcaaccagcccctcgggccataccgtttcctcggtcatgcgcagcgcctgggcggaccaccagcgatggtccgccatcacctgggtctcttccggcgtccactcggccctggacagcgccgcgctggcggcgtgaacgataaagtaatgctcgatcgccaacaccgtctcgccgctgggcagcatcagctcgaagctgcgctcggccaccgatgcgtccacgccgctgaccacaatcccggtttcttcgcgcagctcccggatcgccgccgcgtggaagctttcgcccgcctcgacaccgccgcctggcgtggcccagtaattcctgccggccagcgcgccgtctttatgcacaaaccggaacagcaggacttccccggcggggtttataaccagcaatcgtgacgctttgcgctcgcgcatcggcactactccttgtgtatatgggtttgcaaataggccttcagcaacagtgtggtctgttgctcaagccctgcttcgaatgcaggcgacgcgttgccttcgagcaaggtccgcaccgggccgacaatagcgctcagggcaatgctcgccgtcaggaccgggtcgtcaaactgagcatctgtggccgtgcgcaacatcgcagcaatcaccgccaccatccgcgcattgatacgcgcgaccaattcagcaccgccccgctcgcctgcaatcgcatacagcgccttggacacgccctggtcgcgcagcttggcgttgagcagcgccgtcaccagcccggacgccatctcggccaccggcagctgttgatggcggctgcaggccaactcgaccgcctcggccacccactccaaatgtttttgcagcacggcggccagcagcgcgtcgcggttcgggtagtactgatagaggctgcccaccgacatgccggcgcgctcagccacgcgggtggtggtgcagcggatcaggccctgctgggtcaaaacctgaagggttgccgtgtgcagcgcctcgacggtggcgacggaacgcgcctgaaccgctgattttcttggctttagcgtggctttgacggtggtcatggaatgcgaattccaatatctgaaggatccttcatattagagccttactccgatgacgcaagggtgacagcaatgacgggcttggcaaacagcggcacatttaccttgggcgaccgccaggtcaaccgcatcggctatggcgcgatgcaactggccggccccggcgtattcggcccgcccaaggatcgtgcaggcgcgttggcggtgctgcgcgcggccgtcgccgccggcgtcaaccatatcgacaccagcgatttctacgggccgcatatcaccaatcagctgatccgcgaggcgctgcacccgtaccgcgacgaccttaccctcgtcaccaagatcggcgcgcgccgtgataacgaaggcggctggcatgccgcgccgtccaagcaagaactgacacaggccgtgcatgacaacctgcgcaacctcggactggacgtactcgacgtggtcaacttccgcgcgtcccataacctgatgggccccggcgaaggttccaacgaagcgccactgaccgtgctggccgagctgcaacagcaaggtttggtgcgccatatcggcatcagcaacgtgactccgacacaggtggccgaggcgcgcaaaatcgtcaagttcgtgtgcgtgcagaacctctacaacatcgcccatcagcacgataacgcgctgatcgacgaactggcccgcgacggcattgcctacgtgccgttcttcccgctgggcggttttaccccggttcagtcatcgacgctgacacgtgttgcccagcggctgggcgtaacacccaagcaactggcactggcctggttgctgcgacgctcgccaaatatcctgctgattcccggcacctcgtcggtggcacatctgcatgaaaacctggcggtcggcgaactggcgttatccgatgagaccttcgctgagctgaatgccatcgcgggctgaaaccggcgctattcgggcacctcggcttcaaccgggcgtgccctttcaccgagcctttctacaagcctgaccaaataaccatccgggtcctgcaccaggaactcacgctgcccgacctcgacctcgcccgccctgtaccacacatccttgctcggcttgaataagggatacgccgccgcgtccagccgttgaatcaccggcagtaccgccgccacgtcaatctgcagattcatcccgcgcccgaatggccgctccagcgcggcggtcagccattggttggcgagcgggtcgacttgctcaagcatcacctgggcgccgtccagatccaagtaggcaaagccgtcttccaggcgttgataagccaccttgaagccgaccaacgccacccagaattcgagactgtcactcaggttgctcaccatcaattccgggaccagcttatttctgtgcatcatccggcgttccttgtggctgtcagcagttgcgcgattttcatgcgcagctcgccgtgctgcgcttctgcgtaaggcgtggcggttttccagtcgtagaaccaggccggcatcttgcgcttgtcgtccggctccgtggcgtagcgaggaaagagatggcagtgcagctccggctcggaattgccgaggatctcgtagttaatgcgcaccgcgccggtcgccgccagcacggcgtcgccaaggcgggccatatcgagcagataggtcgcgcgggcgtcggcatccaggccattcaagctggccaccaccgggtcgggcagcagcaggcaataacccggcagaaactgcacatcgcccatcaccgcccagcccgagggcatgcggcagataaccttgtcgttggcgccgttgcgggccagtgctacgcgttgcgaaatcagtgacatgcattgtccttaatgatgacgttcaactcaggcgagcgaacatagccaagccgtcctcaactgtcgataacgcgctgcacgtggatcgcatcggcgcaggcctgcgctgcgagtttcagctgttcggctgaccttgcgcaaccatcgcacgccatgcctgaacgctgggccgctcattcatccgcgcatgccatgcgttcagcgccgcgcattcttcgggtatcggcaagctcaccagcgcggcgaagatcaacccgcccagcagcgcaatgtcggccattgagaatgcgttgcccgccacatagggctgagtcgccagcagcttgtcgaaatagtgcatgcccctgaccgccttgtcgcgcatgcgcccgccccattcggcgttttgatacagctcgacctcaggccccaaaccaggcgtcgcgtggtggaaatacacgctgatcgcgtccatcagctcgatctcggcgcggcgggtcatcatatggataaggccttgctcggtcggcgttttgccggtgagcgtcggctggccatcgagggcatccaggtactgcgtgatagcggtgcactcggcgatcagcgtgccgtcgtgcaacgccagcacaggcaaggttccggaatagttgagcgccaggaatgcgggctgtttgtgcttgccttcccataagttgacgggcacgaactcgacctgcgagagcaagcctttctctgccagtgcgatgcgcacacgtgccgggtacgggccgttgtaccagtcgtagattttcatcgaaggggatgtggaagtgtcggaatgaggctgttggaacgtcatgggttattcacctacctgtcaaatggtaggtagagattggaggctttattcggcactgtcaagcactacctaccagttggcaggtaaagccgtgtgggcgtagaatcgcgccatccacccattcgaactgaggcataaaacgtgagcgagaacgcccgggaagcgatcctggaagctgcaagaatcgcagcccagcactacggctacggcggcatcaactttcgcagtatcggcgagacggtcgggatcaagaacgcgagtatctattaccacttcccgagcaaggccgacctcggtgcggcggtcgccaagcgctattggcaagacgccgtgaaggctctggaggtgttacgcgaggaaaaccccgagccgctgcgcagcttgcaggcctacccgagcctgtttcgcaaatccctggaagacggcaaccggctgtgcctttccagcttcatggccgccgaatacgtggacctgcccgacgccgtgcgcagcgaagtactggcgttcgcagacatcaatgtggcgtggttgatggcgcgcctcaccgacctcggtgcaggcagccccgaagtctgtgagcgacgcgcccgcgcgatctattcggcgattgccggcgcgcagctgattgcgcgtacgcgcgccgacatcggcctgtatgacgaactggtccagagttatcaggacgcggggcttatcccggcataacgggccccaggccgacttgcagcaggtagccttcgagcctttcgagcgcagccgaggacacgaatgcgccgatataaccgtccgggcgcaccgccacccagtcgccaacagccagcgcatacgcacgttgcaactgcccatgctcatccaccagctcacactgcgggccgatgtgatgaatatgcaaccccggccgaggcgacacggcaccgggtgtaacgccatagcccagcagcgtccaatgcgcgcctttgtacaggtcgaacaggcgcagcgcttggccgctggcaccgcgcagttgcgcatccggtgcacggtcacccgccagcaggttgccggtgcgctcggcgtgctgcagcgcgagtgatgtttgcgcgtagccgagatccagttgatgcacttccctgctccggcgcatgtcgccacgctgcatgccgtcgagcagtttggtcgacaagcccagtaccgaagcggctatggggcgccgctcttcttcgtaactgtcgagcagcgtttgcggtgcaccgttggccaccgccgccagtttccagcccaggttgtaggcgtcctgcacgctggtgttgaggccttggccaccggttggcggatggatatgcgcagcgtctccgaccagaaacacctggccgacacggtaatgatcagccaaccgcgcattcatgttgtaggccgaggcccaggacaccgaatgcacgtgaataccatcgcgcccggtgcgctcggccaggatcgccgtcagcccttcggcgctgaggtcgatgtcagcctccagcgggattggcccctgaatctggaacaactcggtgccggccagcgggcacacggcgatctgccggagcatgtcgccttcgccgaaacggtgccagcagtcagcagaaaggccggacaactgcacatccgcaaccagcgcacgcacgcccagcgttttgcctgggaagccgatatccagggcgtgacgcacaaaactgcgaccgccatcggcgcccaccagccagcgcacacgcacagattgcttgccagtgttgtcggccaactgtgcgctgacaccctcggcgtcctgctcgaacgccaccaactcgcaggcaaattcaggcgcgtggcccagctccagcaggcgttcgcgcagcacgcgttcggtgagaaattgcgccaccatcaacggctgttgatacggctcggccgacgtcggcgcgttgtgttcaatggaattggcctcgctgtagctgccatcgtcgcggtagcgccgctcagtcggatagactccacccacagcgaacaggcgatccagaatccccaggtcttcgaacagttcctgagagcgcggctgaatgcccttgccccgcgaaccgtgaaaaggctcggcgtttttctcgatcaggcgaaagctgataccacggcgtgccaggtcaatcgccagggtcaaaccggccgcaccggcaccgcaaatcagtacatcaacagcgcattgctcgttcatacggatcacctatatgtgcaatacgcacatattaagagggagaaacacggtgtcaagaaaaagcgtgcaaaacgcacatatcagcgcacaactgcgagacctgcatgactcgctggtggaaattgtcggggtgatgaaccgtccccagcgtgacgaggcgatggtgcgcgaggccgggatttccctggaccgcgcgctgtttccgctgctggtgctggtcgagcggctcggcccgattggcgtggttgaactggccgaccgcgtgggccgcgactacaccaccgtcagccgccaagtggcgaaactcgaaagcctgggcctgatcctgcgccaggaaagcgccgtggaccgccgcgtgcgtgagtcggtcatcaccgaaaaaggcaaggccatgaccgaccgtgtggatgacgcccgcgagcgcatgggcgtgtcgatcttctcgacctgggacgaaggcgatttcgaaaacctggtgcgcctgatgcgcaagttcgccgcggacatcaaggacgattcgatactggcgaccaaagatatacgctgacccgccgcagctcgggattaccacgctaacgtcacaccgaaatgagcggttttgcaggcggtaaaatcccaggacaaaaactatttttgttgtacacaaaatatcgctaaagatttagcgtgctcgagccgaaacaagcagtgatagcaaatcgccctccctgctgatggtcgtctcgatgaaaataaaaaacaagctggtgctcgcgttcgtctccgtggcgtttatcccggtcagcctggtcgcggtgatctccgtgatgaacactcggacccaggcggtcgagcagttcattgacggcagcacccgcgaaatacgccagatcgacggcaatatccggcagttcttcgatggcacgctgcagaacgtcgatcaaatgtccgccgatcctgtatacacttccgtaaacactctcaaggattaccagcccgccaacgccgccagccaaccgctgccggcccaggctaagcaggtaatcgaccagttcgcccggttcggcgccacccatccttcggcagccattctgtccatcggcctcgaagacggcacctacgccaaatggcccgatgacccgcaactggccaagtacgacccgcgcacccgcccgtggtacaaggccgccatggccagcccgaataaaaccgtgcgcacgcccgcttactattacgacaaagatgacgtcgccctggtcggcaccgcccgcgccctgctggacaccaacggcaaggccaaaggcgtgttcgtggtcagcgtgtcgctgaagaacctcaccgaattgctcaagagcatcaagctgggtgaaagcggctacgtgatgctgatcgaagacggcgtggtgctggttgacccgcgcgatgccgcgcacaacttcaagccgcttaaagacctcggcgcgccctatgcgcacctggcgcaaacgccgcaaggctcgaccgaagtggtcatcgacggcgtgcgttacatggccaacgtgtggacctcgccgggcctgggatggcgctatgtcgggctgatcgaatacaacgaagtgatggccgccgccacgcgcatgacctacctgaccactgcgattgtggcggtgctggtgctgatcttcgggttgattgccgcagcgttttccaaagtcatcgtcaagccgatcggtcaagtcagcaccggcttgcagtccatcgcccaaggcgaaggcgacttgcgccatgagttgcaggtgcagggcaaggatgaaaccgccgagctggcgggctggttcaacaagtttctcgccgcgatccgccaattgatccagcacatcggcgccgcctcgaccaacttgcaggacgcctcacgggtcaacagtgaagtggcgcacaacatgaatgaagccgccgggcgccagcgtgaggcggtggagttggtgtcgaccgcgttcaacgagatggtcgccaccgccaacgaagtcgcgcgctcgtgcagcggcgcagcggaatcggcggagaacggtcatcgccgcgtggccgagggcaagcagcagatcgaagtcaccaccgacaacgtcaatcgcctcggccggcggttgaccgagtcgtcccaggccatggtcgagctggaagccggcagccgcagcatcaaccagatcctcggcaccattcgcgcgattgccgaacagaccaacctgctcgcactcaacgcggcgattgaagccgcccgcgccggtgatcaaggccgtggcttcgcggtggtcgcggatgaagtgcgggcgttggccaagcgcacctccgactccaccggcgagatcgagcaactgctcggcaccctcggcagcaaaaccgaggaagtcacgcagaagatgagcagttgcctggacctgtcccgcgcgagcgtttcatccatcgaaaacgcgcgggacagcttcgagggtatccaattatcggtgaatgaaatccgcgaccagaacctgcagatttcagccgccgccgaggagcaacacagcgtcgccgaagagatcaaccggcatatccagcagatctatgacgaggctcggctggtagaaagcctggccaattctgcgcaggatgactcggggcgcctggccaatttgtcggatgagttgaacggtttggtggggcgcttcaagtcctgacgcacacggccctggaagtccgcgatctgttgccacatcgcgaccgggttggaatacctcaggaagtgcccgcacgcggcaatttcgggcacgccaggccgaggaacttgcccatcaggtcgccatggtcggacagctcgaccgtcgactggaaaatcccgcgcaccgcgccggcgcgcaccttgtggcgcatagtcctcttgggtcgatccaaactatgccgactgtgaaaccatccagctgacaaaggcctgcagccgcgtgcaaaaggcctcgcgctcggcgctcgggttgcgcgcttcaaacagaaagtaggcgatctggatgcgcatcgtcgggtaatgctgcacgaacaacgcgacgtgttcttcaaggctgtgtggccagcctgcggcgtctgctaagcgcaaggtgtgcgttgcccgaatcagcttgcgtgcggcttcgcgttgcaggcgatggcgttgctgttcggtgccggcttgctcgatacgtgtgagataggccgtgagcacgggttcgaagtcggcattgagcgccaaggcgatctcacgcgatggccgaaacggttccaggcgcagtgaaaggtcatcgccccacacgcaccggcaatgatgcttgagccagaagccccagcgattgtggttttcagccgccagcacctcggcgctgtggccgatatcgaagtcgattttggtcaccgtagaatgccgttgttccaatgcctggcgaagctgctccaatcgctcgaacacgagcgaatccggcggttcattgagtaccagcgtgacgtccaggtccgactcgcccgggatcgcgtcgcccctcgcgacgctgccatacagataaaggctgtgcagccccaaaccggcctgcgcaagcgtggtacacacgtcggtcagcagcggctgaaactcaggctgcaggggcgcatcgccgaccgtcaacacacggccgtttgcatccagaccttgatcggtgctcatgggcgatgcacctcaatcaccaggccctcggcctcgctcggcgcactgaagtgtcgggtgatcagctggaattcggcatcggtggcggcgaaatcatgctcgccctgggcattgcgcgcatgcaggcgcgcgcggcaggtggcatcgtccagttcgaggtaatgcaggcagtgcggcacctgcgcggcgtgcgccaggccgagcagccattcgcggttggcccgtgtgttggccggaacgtccagcaccacattgacgcccgattgcagcaggttgatcaccaaaggccccaacaccccgcgaacacgctgggcgcagcgcaggtaatcggcaatcgactggatctcggcaggatacagctgcgcaagccagtggtcttcgctgagcatcacggcggcatgctcggcggccagggtgttagccagggtggatttgccggaggcgatcttgccgcacagcaggtgcagggttggcatggcacgggtccttatatcgggccgtcaagcatgccatttttttacgccgaacgatgttgccaatactcataaaacgccagcgccgcgccgttcttgtccttggcttcgagcatgatgtcgaaacggtcgagaaactgcagggcgtaatcgttggtccagcggttccacatctgcgcgctgtgggcgtacaggtcgcgtttggagaccaccttcaacagcgcgtccatttccagcttgtgctcggcgtcgaaacccagcgcttgcaggctttcctggggctgggagtaatgcatcgtggggcgcacgccgcgccagctgtcgatcacgcgggcgacccgtggcgaatcggggtcgatgtactggtcttcgtggatccagcagtggtggatgtccagcaccaccggcgccaggtcggcgacttgcaggcaatggtcgaggccgtaggttttttcgtcgttctcgaaggtgatgcaattgcgcgccacttcggacaaacgcgaccacaccgcgcgcgtgccttcaacgccgaggcggccggcgatgtgcacgttgcacttgaggtcctggaagcgtcggccgtaacccatcatgcgaatcatgtcggcgtggtattcgaactcggccacgctgttttccaccacgccggggttttccgagcccagtacacagtattggcctgggtggaatgacaggcgaatgtccgaggcgcgcgcaaagtcgccgatggccgcaaagccctcgatcaactgacgttcgattgccgggtctttgtacacgtccgccactttcgggtggctgtagaacggcagcaagtcactgctcaagcgcaacatgcgcaaggtcggcggcagctcggcgacgtaggccagcaagcgcaattgcgccgccagattatgcgtgacgatttccaccagcttgtcgcgggccacagtcggcgcgaccccttcgagccaacgcaacgtggtggtgcgcgggttgaacgggccttcaatcaacttcaaggcgctggccgagagctgacggtcggaatgcttgtattggcagacgaagccgatgcgcgggtgggtcataacactgcctggcggggacaaagggttggatgatacggcgttaggcccaggcctacccagtgggttcataatatttcgacacgaaataccctgaactttctgacaaacactgcgctcctctcctatgcgctgccccgaccccaggggcgttgtacaacaaggagccgccatcaacatgactacccttcccgtctatagaaggtcaacgccggggccgctgcatgcgaccttattggcaggcacggtgccgctgtttctcggcgccctgctcagcgacatcgcctacacccagacctaccagattcaatgggccaacttcgcctcgtggctgatcgccggtgccttggtgtttgcgggtttcgcgtttttgtttgcgctggtcaatctgctgcgcgccgagcgtaaagcaggtcaacctgttgtgtatgtgctgctgctgttggccacctgggtactgggcctgatcaatgccttccagcatgccaaggacgcgtacgccgccatgcctgctggcctggtgctgtcggtgatcgtcacggtgttgacgcttgccgccacctggaccggcctgcgcaccggaggtgccaaatgaaaacgtcccacacactgaccctgctcagcaccgccctgttgctggctgcctgcggtggcgaaggcgacaagactcaggcccgtggccctgatccgaaattgccggagcaacaaagcagcctgttgccaagcatgaaaattgccgagcccacgccctggggcgcgcaaaaacccaaggtgcccgaaggctacagcgtcaccgccatcgccaccgatttggcgatcccgcgccaaaccctggtgttgcccaacggcgacatcctggttgccgaaggccgtggcggcagcgcggccaaactcaagcccaaggacgtgattgccagcgtgatcaaggccaagggcaacacccaggtcaagggcggcaaccgcctgaccctgctgcgcgatgccgacggtgacggcacctatgaactgaaaaccgtgttcgccgacaacctcaacgcgccttacggcctggcgttcgccgacggcaaactctacgtcgccaaccaggacgcgctggtgcgcttcgactatgccgacggccagaccaaggccagcggcccgccgaccaaaatcaccgacctgccggcgcagatcaaccaccactggaccaagtccctggccgtgagcgaggacgggcgccagctctacgtgggcatcggctccaacagcaacatcaccgagcgcggcatggaagtggaaatcgatcgggcaatggtctggcagatcgacgccgccacgggcgcgcacaaaccctacgccaccggcattcgcaacccgaccgcactgaccattcagccgggctcggggcaattgtgggcggtggccaacgagcgcgatgaactcggcccggacctggtgccggactacctgacttcggtgcgtgaaggcgccttctatggctggccctacagctactggggccagaatgtcgacccgcgtgcgcaaccgcagaacccggcaaaagtcgccgaggcgatcaagccggattacagcctgggctcccacgttgcagcgctgggcgtggatttttccatccccgccatgggtgaaaaattcgccgacggcgcattcgtcggcgagcacggcagttggaaccgtgacaacccggtgggctacaaggtgatcttcgtgccgttcagtaacggtaagccgtccggtgaacccatcgacttcgctaccggctttcgcggcgacgacggcaagacccgcgggcgcccggtgggtgtgacagtggacccgaaaggtgcgctgatcatcgccgatgacctggccaacaccatttggcgggtgacgcgtaaccgctgagcaaagtgtttgacttggttgcctgaagcaacaatataattgcttcaggcaaccaaccgagcatcatcatctctacgacccttgtcgaacgcgccgcgatcattcgcggtttcaatcgtttctacacgcaccagatcggtgtgctgcaggaacacctgctgcaaagcgacttctccctcaccgaaatccgtgtgatgtacgaactggcctcgcgtggcgacctgaccagcgccgacctgtgccagatgctcggcctggatgcgggttacctgagccggctgatcagcgggtttgaaaagaaaggcctggtccagaaagtccgctctgtcaccgatgcgcgcgccgtgcaattgcacctcagcgacgtcggccgcgccgtgctcgcaccactggaaaaccagacccaacaggaagtcattgccttgctgaaggccctgcccgagccgcagcaacagcaactgacggccgccatgcagcgtatccagacactgttgcaaggccgcacgccgagctacttgctgcgcgacccgcaaccgggcgatatgggcctggtggtgcagcagcaatcggcgctgtatgcccgagagtacaactggaactgggagtttgaagcgctggtgtcggagattgtcgccaagtacttgcgcgagtttgaccctgccagcgagcgttgctggatcgcggaaaaagacggcgaagtggtgggttcggtgttcgtggtgcgccatgacgaaaccacggcgaaactgcgcatgctgtatgtagacgccagtgcgcggggcatgggcatcggccaacgcctggtggacgaatgcctgcgctttgcgcgcaatgcagggtacaaaagcatgttgctgtggacggtggacgcgctgaccgacgcgcgcaggctgtatcagaaggccgggttcaacctggttgatgaagaggccacggtcagtttcggcaaatcgctggtgagtgaaacctgggcgcgagagctgtaaggcatgcgcgcagtggacgggctttgtgggagccgggcttgcccgcgatagtgtcacctcggtgtgtcagccacaccgcggtgcctgcatcgcgggcaagcccggctcccacatttgaactgggtggacttgaggattgtgcccgccttacagatcagtgatttccttatgacgcggcaccagcgccttcatcacgctccacgccaccaggtaggccagggcacagattgcgaacatgatcatgtagccggtgtggatgtcgttgatggacttgtagtagtcaaacacccaaccgccaatcttggtcatcaccacaccgcccaagccaccggccatgccgccgatgccgaccaccgaggccacggttttttgcgggaacatgtcggacacggtggtaaagatattgcacgaccacgcctggtgcgccgaggcccccacgccgatcaacagcaccggcacccagaagctcaggtagccgaaaggctgggccagcaacaccaccagcgggaacagcgcgatcaccagcatggctttcatgcggccgtcatacggtgcgtcgccgcgggccatgaagtagctggggaaccagccgccgccaatactgccgaccatggtcatgctgtagagcacggccagcggcatcacgatatcggcgcctttcatgccgtactgcgccgacaagtaggtgggcaaccagaacaggaagaaccaccacacgccgtcggtcatgaacttgccgaaggcaaacgcccaggtctggcggtaggtcagcagcttgaaccacgagactttcttcggcgttgtaccgacaggttcaggcgtgaacggctgcacggtctggtcgctgcggatgtaagccaactctgcggccgacaggcgtttttgctgctccggtttttcgtaaaccgccgcccacaccgctacccaaacaaagcccaacgcaccgatgacaataaaggcggcttcccagccccacatcccggcaatcaacggcacacagatcggcgccaggatcgcgccgacgttagcgccggagttgaaaataccggtggccagggaacgttcttttttcgggaagtattcggcggtggccttgatcgcgatggggaagttacccgcctcgccaatcgccaacacggcgcgtgacagcatgaaaccggcaatcgacaccggaatcaccgccaggccgatggccgtgctgaccgccgcgatgccctcgcccatcggcaccgcgaacgcgtgcatgatggcgcccgaagaccagatgccaatcgccaccacgtaggcggctttagtgccgatcttgtcgacaaagcgtccggcgaacagcatcgaaatcgcatagacaaactggaagaccgccgcaatgttggcgtagtcggtgttgctccagccaaattgcgtcgacagctgcggcgctaaaaggctgaggacctggcggtcgaggtagttgacggtggtggcgaagaacaacatcgcgcagatggtccagcgatagttgccgacggccgtgccgacgcgatgggcgtttaggggctcattcaaattcatggcatcactttttatttttgttaggtaggacatacgttacgtcatatgtcgtcgtacaactgtgacttttatagcgggctgcctgggcggtgtcaatcgcaaagattgcggtttattgaggtatcaggccggtatagaccggctcaatcgacagcagttgtaggacgacaaatccgtaataccaggcttggcgcctggcccggcacatcgtcgagcacaccaaatggctgcatgccgagcttttccagcacgcgaatcgacgcggcgtgatccgggcgcaccaacccgaacaccgccggcagccgcagcggtccgaacgcctgcgccagcgcatcgcggccaagctgcgtggcgaagccctgcccccaggcctcgacggcaaagcgataacccaggttgatacggcgctcggtcaggtaattaagcggcgccacgccgccgaagccgatgatgcgttcaggctgctcgctgcgggcaaccgcccaccagccgtagccttgagtggcccattgttcgagccagtggtcgagcaagcgttgggcgtcggccaggctggccatcgggccgttgggattgaacaggttagtctgcgggtcgccgaagatcgcgaacaatcgctgcacgtcactggcttcgggcttgcggtaggtcaggcgtgaggcggcggctggcattcggatatatccctcgtaaagccacgaagttcaatgcatctgcaaaaaaacgcaaatagtggtgaattatttgatgtcctcttgtatctgaactgacagagcggtgccatcgcaacgatggcacctcccctgttctgttttagagtggcccgcatgaaaatacgtaagaaaagcgtcaaacccatcggtttgaaagacatcaccatcgtcgacgataccaaggtgcgcaaggcaatcactgccgccgccctgggtaacgccatggaatggttcgacttcggcgtctacgggtttgtcgcctatgtgctcggtaaggtgttctttcccgacgcctcgcccagcgtacaaatgatcgctgccctgggtacgttctccgtgccgttcctgattcgcccgttgggcggcctgttcttcggcgccttgggcgacaaatacgggcggcagaaggtccttgccgccaccattgtgatcatgtccctgagcaccttcgccatcggcctgattcccggctatgcctcgattggcatctgggcgccgatcctgctgttgctgtgcaaaatggcccaagggttctcggtgggcggtgaatacaccggcgcctcgatcttcgtcgccgaatatgcgccggaccgcaaacgcgggttcctcggcagctggctcgacttcggctccatcgccggcttcgtgctcggcgcgggtgtggtggtgctgatctcaacgatattgggtgaagccgatttcgaagcgtggggctggcgcctgccgttcttcctcgccctgcccctgggcatcatcggcctttatctgcgtcacgcgctggaagaaaccccagccttccagcagcacatggacaaactcgaacaaggcgaccgccagggcctgacccacggccccaaagtgtcgttcaaggaagtcgccaccaaacactggcgcagcctgctgacctgcatcggcatcgtcgcggccaccaacgtgacctactacatgctgctcacgtatatgccgagctacctgtcgcataacctgcattacaaagaaaacagcggcgtgctgatcatcatcgcaatcatggtcggcatgctgttcgtgcagccattcattggctttgtcagcgacaagatcggccgcaagcccttcatcatcgccggcagcgtcggtctgctgtttctgtcgatcccggcgttcatgctgatcaccagcggcaagatcggcctgatcttcgcaggcctgctgatcctggccgtgatcctcaacttcttcatcggcgtaatggcctcgacactgccggcgatgttccccacgcacttgcgctacagcgcgctggccagtgcgttcaacgtctcggtattgatcgccggcctcactccaacggccgtggcctggctggtggaaagcaccaacaacctgtacatgcccgcctactacttgatggtgtttgccgtggtcggcctgatcaccggcctgaccatgaaagaaaccgccaacaagcccctgcgcggcgcagcgccggccgcttcggacatggaagaagccaaggaaatcctgcaagagcaccacgacaatatcgagcagaagatcgaagacatcgacgccgaaattgccgcgctcgaagccaagcgccagaacctggtgcaacagcacccacgtattaactaacacttgaccctgcgtggtggcccccaggccgccacgtcattggagtgcttaagcatgcttccaagcgtcaccgcagcccattcgttactcagcgccgatgagcgcgctgccatcgccgaaatcgaagccactaccagcatcctgcaactggttacccgcctgaccggcatgcgctttgccggcatcgccaaattcaccgacctggaatgggtggtgtgctccgcgcacgacccactcgacatgggcattcatgtcgatgacgtactcgacctggaaaccaccctgtgcagtgagttctgcatcaatccgcaaacgctgtttattccgcaaatcagccagaacggccgcttcgccacgcgcccggtggtcaagcaatacgccatcgaaagctacgccggcgcgccgatcttcctgcccgatggccgcctgttcggcgcgctgtgtgcgctggattcgcgggcgatgttgtttgacgaccccaacttgccggaaaccttgagcctgtttgcgcggctgattgggtgcatttttttcgctaacctgacaacgactgatcagtaacggccgttctccctcgcagcgcagcaatatcgcgcttgggcggcacgccaaacagtcggctgtactcgcgactgaactgtgaagggctttcatagcccacttggaacgcggcactggacacgtcccgatgctcgttcaacatcaaacgtcgcgcctcgttcaagcgcaaccacttctgatactgcagcgggctcatggccgtcagttggcgaaagtgatggtgaaaagtggccgcgctcatttgtacccgcgcggccaattcatccacgcgcagcaattcgccgtaattcagtttcagccaatcgatcgccttggctattcgataacccggcccatcaacggaacagatctggcgcaatcggcaggcctgatcgctttgcaacaaccggtagtgaatctcgcgctgaaccagcggagccagtaccggtatcgcctcaggctcatccagtaaggcaaccaggcgcgcgaaagacgccagtatcccttcggtgacagtgccaatacccactcctttcagtatcgcccgctcacgcgtcggcggcgcgccactctgcgcaatcagttcggcgaggatgcgtagatccaatttgaaggtcaggcccaggcagggttccaacgggctggcggccagcacttgcgaattggccgggatgtccagtgacgtgaccagaaatcgggcggtgtcgtacgaatagccatggccaccgacccataattgcttctcgccctgggcaaccaggacgatgctcggctcgaccatgcacaccaccggcgcagcgggctgctcacgccgataaaagcccaggcccgggatcggcatggggtagtcgccgggtgccgcgacccgcgaggcaatcgactgaaccagcgtttgcagaggcgattgggggatgtgctgtgtcttcatggcgggctctttctgttcttcgctggactttaccgcgccagccccttggcgtcccaagtgagcacacacactcagaggatcaggcaagtattccagtggaacacactacagaaccttcgagcgcaccgggaaaatgggccaccccacttcgccaaggttcaacctatgaaacgcctattgctcgccctgggtttgctggtgacttctttttcttcaataggagccgacatgtccaacggtgctgacaacttctacaacagcgacacagtgacaatggaaaaggtcaccttcaataatcagtatgggatgcaggtcgccggcaatctgttcttacccaagcatattgctgcggggtcaaaaaatccggcgataatcgttggccatccgatgggcgccgtaaaagaacagagcgccaatctctacgccaccaaaatggctgaacagggctttgttaccctttccctggacctgtcgttctggggtgaaagcgcaggtttgccacgcaacgcggtgctgcctgacctctacgttgaagacttcagcgccgccgtcgacttcctcggcactcgcccgctggtggatcgtgagcgcattggcataatcggcatttgcggcagcggtagtttcgccatcgcggcggcaaagatcgaccctcgcctcaaggccatcgccaccgtcagcatgtacgatatgggggctgccaaccgcaacggcctcaagcagggtgtcactcaggcgcagcgccaacaactgttgcgccaagcagccaaccagcgttatgtggaattccagggcggcaataccgtctacaccggcggcaccccgcacaccctcactggcgatgcggtgggcgacgagttctacgacttctaccgtaccccgcgcggagcattcaccccggccagtgcttcgccgcaaaacaccacacggcccacgctcaccagcaatgtgaagtttatgaacttctacccgttcaacgacatcgagacgatctccccgcgccctctgttgctgattgccggggccgatgcgcactcccgcgaattcagcgaagacgcctaccagcgtgccgccgaacccaaggaactggtgatcatcccgggtgcaggccatgtcgacctctacgaccgggtaaacctgatcccgttcgccaagctcgccaccttcttcaaaagcagcttgaagtaatgtcccaaaacgctctcacgccccactggggcgcggtactcgccatgtccctcgcggcgttcgccctcgtggcgtctgaattcatgcccgtgagccttttgacgccgttggcggccgacctgcacatctctgaaggccaggccggccaaggcatttcagtgtctgggctgttcgccttgctgaccagcctggtcattgccgcagtggccgcgcgggtggatcgcaaaggattgttgttggcgctgaccgtgatgatgatcctgtccggaacggtggtggcgctggcgccaaactacctggcgttcatgctcggccgtgcgttgatcggcgtggcgattggcggcttctggtcgctgtccgctgctaccgcgatgcgcctggtgccagccgcgcaagtgccgcgtgccttagcgctcgtcaatggcgggaacgcgctggcgacggtgattgcagcaccgttgggtagcttcctcggcggactgatcggttggcgtggcgcgttcttctgcgttgtgccggtggcgattgtggccagcgtgtggctgctgataagcctgccttcgatcaaggcggacgctgcagccaagaccggcaacgtatttcgcctgatgaagagcacgcccgtggccttgggcatggcggccgccagtgtgttcttcatggggcagttcatgctgttcacttacttgcgcccattcttggagaacgtgacccaagtcagtgtgcccacgctttcactcatgttgttggtgctggggttgactgggcttgcggggacgttcctgattgagcgcgtgctgaaaaacagcctgtacttcacgttgatggctatcccactggtaatggcggtgatcgccctggggctggttgcaggggggcgctcgccaaccgctaccaccgttttgctgggcctgtgggggctgattgccacggccgcgccagtggcttggtggacgtggttgtcgagggtgctgccgaacgatgccgaggcaggcggcggactgatggtcgctatcatccaattggcaatcgcctccggtgccacactcggtggcgtggtgttcgacctgagcggctaccaggcgaccttcgaactcagcgcggcattgctgggcgtcgccggtctgttggcgtaccagacctcacggtgctctgcagccgcacacaaggccatccgaactacctgaaaaactgactcggcgtcttgccaaactgcttcttgaacatgctggtaaaggcgctcgggctttcatagcccgactcgatggccacatcgatgatcttctcccctaccgcaatgcgctccagcgccaacagcaagcgcgcctgttggcgccactggccgaaggtcaggccggtttccttgcggaacaggcgctggatggttttctggtccagggccagccgttcactccaatccgccaccgttgaagcatctcccggctcgtgttgcagcgcctggcaaatacggttgatgcgcaggtccgcaggctggggcagcgacagcggtaatgcgggcagaatcgccagctcatcaaggatcaggtgcatgatccgcgcgtcacgcgaatcctcggcgtacggcggtttcaggctgaccgaagccttgatcaactcgctcagcagcggcgagacactgacggtcttgggctcggtgggcagattgggaaagcgctccgggcgcacaaacacactgcgcattttgagcgtgccgacgcagcgcagcgaatgcacttgaccgcagggcatccagaagccgcgattgggcggcaccgtccattggttcagcgccgaatacaccaccatcacgccttcaaccgcatacaacagttgatgcttctcgtggctgtggtcggggatcacccaattttcgggataatcggtggcggaactgattacagaccagtcgccttcgtcgatctcccgcagaaatacatccagtggtttgatgatttcgccctttttgcaacagttggcgcccgaatttcgcgagacaggcatttgcagcgaatttagcataaacaccgcaacatttagaaacggacggcgagcttaagtactcgctgcccctgttcgctgccctgtatggaatgcctgcatgtcgagcctgaccgcgtcacctgccgctgcaaccgccacaccgcaaataagccccttggtcatgcgcgtcctcggcgcctgcgccctggcgcacatgatcaatgacctgatccaggccgtgctgccgtcggtgtacccgatgctcaaggccaactacgggctgagcttcacccaggtcggcctgatcaccctgacctttcaactgaccgcgtccctgctgcaaccctggatcggctaccacaccgaccgccatcccaagccgtggctgctgccggccggcatggtgtgcaccttgatcggcattctgatgctggcgtttgtcggcagcttcccggcgatcctgctggcggcggcgctggtcggcgttggctcgtcgaccttccacccggaaacctcgcgcgtggcgcgcctggcctccggcggccgctacggcctggcgcaatcgacgttccaggtcggcggcaacaccggcagcgccttcggcccgttgctggcggcggcaatcatcattccctacggccaaacccatatcgcctggttcgggctgttcgccgtgttcgccattttggtgctgtacggcctgagccgctggtatcgcaaccacctcaacctgttcaagctcaagcaaggcggcaaagccacccacggcttgtccaaaggccgcgtgacgtttgccctggtggtgctggcgctgctggtgtttaccaaatacttctacatgaccagcctgaccagctacttcaccttttacctgatcgagaaattccacctgtcggtggccagctcgcagatgtacctgttcctgttcctcggtgcggtggccgtcggcaccttcgccggtggcccgatcggcgacaagatcggccgcaagaaggtcatctggttctcgatcctcggcgctgcgccgttcaccctggccctgccctacgtcgacctgttctggaccgccgtgctcagcgtggtgatcggcttcgtcatcgcctcggcattctcggccatcgtggtgttcgcccaggaactggtgccgggcaatgtggggatgatcgccggcatcttcttcggcctgatgttcggtttcagtggcattggcgccgcgctactgggcttgctcgccgacaaccatggcatcgagtacgtctacaagatctgctcgttcctgccgctggcgggcatcctcacgatcttgctgccctcgaccaaaggcgtctgacccgccgatcatcggctggccgtgtgctactacacggaatgctctgaaaaacctgcgtgtgcgcttacaatcccgactttaagcgcacacccaggcagacccggcacgacatgacgctcgaccctcctacgattttgaccctgagcattgcgctcgcagctgcggcggccctgtacctggccgttgagtggcgcagcgtgcgcgagccgtcgctgctgttctgggccgctggctttgcgaccatcagcctcggttccaccctggcgttgctgcgcggcagcggcctgttgatgatcggtatctggttcgccaacggcctgctggtgaccgcacacttcctgtttttactcggcgtagcacgctttacccaggtgcgcctgtcgcggctgtggctgctgttgctgatcatctggctcggcatgctcgcattgccaaccgacctgtcgtggtccaaagccatgctggtcgtgcagtcgctgctggtggcgctgccgaccctgcgcgccagcttcctgctgcgcccccacggcaaatccttgagcatcggcgccgtgcagttgcgctatgtgttgctgctgcacggcgcgttctacgtggccaaggcgctgtcggtgctgatccccggcacgctgatcgacctcgccgcgttcaagggcgagatcatccaggtctcgttggtggaaggtgcaatggcgatcatgttgatcgccttgtcaatgaccggctcggaacgttatcggcgtgaacaacaaatcgcccgcctggcggcccgcgacccattgacagcgctgtacaaccgtcgcgccctcgatttacgcgcgccgcagctgttggcccaggtatcgccggcacaaccgggcgccttgctattgatcgacatcgacaatttcaaactggtcaacgacctctacggccacaccgccggcgaccgtttgctgatcgccttgagcgagatgatccgcgcggtggtgccccaaggtgcattggcggcacgcctgggcggggatgaatttgtgatcctgttgaacaaggcttcgacgcagcagatcgttgaactgggcagtcgtttgcgtgagcagttccagcaaacgacatctgcgactttcaccaccccggcgccggtgaccttgagcatcggtgcaaacctgttcgaccaaccaccggagaacctcacggcattgatcgaacagggcgacaccacgctctacgaaaccaaacgcggcgggcgtgacagtattcggttggtggaccgcacgggagccggttcgtacggttaatggcttcctgtgggagcgggcttgcccgcgaaagcggtgggtcagtcactatcaatgtttgctgggccgacgtcttcgcgggcaagcccgctcccacatttgatcgtcgctgttttaagcattgcgtttgcttaactgaacggcattagggcttgccacaggtttagtggcgacggcgtgaaaacccattcacaacgatataaagcaacggccccaccgacacaaacaccgccgtcagcaaaaagtacggcaccagcgaccctaccgaccgccctcgcccgcgcgcatcccgatacatccacacgcacgccagcaccgccatcaggtacaggtcgatgaccacctgcgcggtgtccggccgcgacatcaattcgcgcccaaacgccaacagtgattgctcggccgtgagcatcgtagccaaggtgtacaacgaaaatcccagcaaaccggccagggcgaaatagggtctgcgcatggtgccttccttgaaaggatcgaggctcaacatagtgataaggtggcgcctctcgcaatgacctcggaggtcatgatcaggccatggacaccccttcaactgccggccagcacctgcgccaattgcgtcgacacgccaagctcagccagctggacctggcgttgataaccggtgtttcccagcgccacctcagttgcctcgaaaccggccgcgccaagccgagccccggcaccttgcataatttactgacggcgctggaagcgccgctggagcagtgcaaccaggtgtttctcgcggccggttacgcgccgcgttacaccgccacgccactcgccgccccgcccatggccgccatacgtgaagccgtcagccatgtgctgcatgcgaataacccggccccggcgattctgctaggcagcgaatggcaagtgctcgccgccaatgccagtaccggcgtgttgttcgagttggtcgggattgagccgaatgccgccgacggcctgaacctgctgaccacgctgctgcaagcaggcggcctgggcgaccacctgatcaacgccgaggagatccgcgccgtcgcctggcaacgcgcaacccgtgaggcgttgggcaatccggccttggcccagttactggcgcgcttgcccatgccgagcagcaccgaactgcccgatgcaatgccgccactggtgctgacgcgcatccgctctacgcgcggtgagctgagtttcctgtcgaccttcaccaccttcggcatgccccaggacattaccctcacctcgctgcgcatcgaacatctgattcctgctgatgcgcccacgtggcaagtgatgcgcgccgcctatgcggattatgccgcgctggttttgtgaaatatctgtacgtagactgccgccatacctcccacttgaaggcggcgaaaaaaacctgatgcaagttaccgaagtctccattgcccaactgcgcgcggcgcttgaaagcggccagaccactgccgtagaactggtccaggcttacctggcgcgcatcgaggcctatgacggcccgcagaccgcgaccgcgctgaacgccgtggtggtgcgcaacccgcacgcccttgaagaagcccaggcagccgatgcgcgccgggccaagggcgaaaccttggggccattggacggcattccttacaccgccaaagacagttacctggtcaagggcctgacggcagcctcgggcagcccggcctttgccaagctggtcgcgcagcgcgatgccttcaccattgaacgcttgcgcgcgggcggtgccatttgcctgggcaagaccaacatgccgccgatggctaacggcgggatgcagcgcggcgtgtatggccgcgcagaaagcccgtataacgccgactacctcaccgcaccctttgcctcgggctcgtccaacggtgcgggcacggccacggcggccagcttcgccgcctttggcctggccgaagaaacctggtcgagcgggcgcggcccggcgtccaacaacggtttgtgcgcctacacgccatcgcgtggggtgatttcggtgcgcggcaactggccgttgacgccgaccatggacgtggtggtgccctatgcgcgcaccatggccgacttgctcgaagtactcgacgtggtggtcgctgaagaccccaacccgcgcggcgacctgtggcgcctgcagccgtgggtgccgatcccgagcgtggcctcggtgcgcccggcgtcctacgctgaattggcggttaacagtgcggccctcgccggcaaacgcttcggcgtaccgcgcatgtacatcaatgccgaccccgaggccggcaccagcgaaaaacccgggatcggcgggccgaccgggcaaaaaatcaacacccgcgccagcgtgatcgacctgtggcacgccgcgcgccaagcactggaagcggccggcgccgaagtgatcgaggtggacttcccactggtctccaactgcgaaggcgaccgccctggcgcgccgacagtgtttacccgtggcttggtctccaaggaatttttgcacgacgagttgtgggaactgtcggcgtgggcattcgatgatttcctgcgcgccaatgacgacccggcgctgaaccgcctggcggatgtcgacgggccgaaaatcttcccgcacgaccccggcaccctgcccaaccgtgaagacgacctggccgctggcatggacgaatacgtgcgcatggccgagcgcggcattacgccgtggaacgaaatcagtaccgtgccggatggtttgcgcggcctggagcaaacccggcgcatcgacctggaagactggatggacacgctggggctggatgcggtgttgttcccgaccgtggccgatgtggggccggccgatgccgatgtcaacgaagcgtccgccgatattgcctggagtaacggtgtctgggtcgccaacggcaacctcgcgattcgccacctgggcgtgcccaccgtcaccgtgccgatgggcgtgatggccgacatcggcatgccggtggggctgaccttcgccgggcgtgcttatgacgactcagcgctgctgcgctttgccgcggcgtatgaagccaccggcagcaaacgcctgatcccgccacgtacgccggcgttggcagcgggctaaacgccgttcaagtgtgggagcgggtttgctcgcgaaggcagtgtgtcagtcaatatattgggtgactgaccaaccgctttcgcgagcaagcccgctcccacatttttgactgcacttcacaccaagccacggtcaacctgtggggggtggcttggctgcgatgacggtgggtcagccagtctatttgtcactggcaggccgctttcgcaggcaagccagctcccacattgttaactgcatttcacatcgaaccttgcagtgcacagcgagcagcaacaggctaaacccagtcaatctgtgggaactggcttgcctgcgatggcggtgggtcagccagtctatttgtcactggcagaccgctttcgcaggcaagccagctcccacacttttaactgtatttcacctcaaaccatgcagggcactgcgagcaacagcaggctaaacccggtcaacctgtgggagctcgcttgcctgcgatggcggtgggtcagccaccctatttgtcactggcaggccgctttcgcaggcaagccagctcccacattgttaactgcatttcacatcgaaccatgcagggcacggcgagcaacagcaggctaaacccggtcaacctgtgggagctggcttggctgcgatgacggtgggtcagccagtctatttgtcactggcagaccgctttcgcaggcaagccagctcccacagttttaaatgcatttcacatcgaaccatgcagggcacggcgatcagcagcaggctaaacccggtcaacctgtgggagctggcttgcctgggatggcggtgggtcagccaccctatttgtcactgacaggccgctttcgcaggcaagccagctcccacagttttaactgcatttcacctcaaatcatgcagggcacagcgagcagcaacaggctaaacccggtcaacctgtgggagctggcttgcctgcgatggcggtgggtcagccagcctatttgtcactggcaggccgctttcgcaggcaagccagctcccacacttttaactgcatttcacctcgaaccatgcagggcacggcgagcaacagcaggctaaacccggtcaacctgtgggagctggcttgcctgcgatggctgtgggtcagccagtctatttatcgctgacaggccgctttcgcaggcaagccagctcccacagttttaactgcatttcacctcgaaccatgcagggcacggcgagcagcaacgggctaaacccggtcaacctgtgggagctggcttgcctgcgatggcggtgggtcagccaccctatttgtcactggcaggccgctttcgcaggcaagccagctcccacattgttaactgcatttcacatcgaaccatgcagggcacggcgagcaacagcaggctaaacccggtcaacctgtgggagctggcttgcctgcgatggcggtgggtcagccggtctatttgtcactggcagaccgctttcgcaggcaagccagctcccacagttttaactgcatttcacctcaagtgatgctgggtgcggtgagcagcgacaggctaaatgcggttaaacatgtgggagcgggcttgctcgcgaagagggcgtgtcagtcaatatatcgggtgactgacccaccgctttcgcaggcaagccagctcccacagttttaactgcatttcacattaagccaggtagggcacggcgatcagcaggatggcggtgccgtgggccagggttgccggtagcacgccatagcgcatgcgcaccagtgcgcaggccagcccttcgatcagggtgaacagcaacaccggccagcctagctgggtgacgctcagcgccaggaaagcatggcacgccgcaaacgccacgccgctgatcaccgctgcgcgccatggcgtcacctgttgctccaggtagccctgcaagaacccgcgaaacaacacttcttccaacgcattagcgccgtaggccaagaccaccatgcccggcagccacacccaatagccgtgaatcccggacgcctcgataccttggtaaacccgcagcggcaggccaatcaaacaaccgacgatgaacccaacggccacaccaacgagcgggttgccgatagaccagcgcaccagccgccacaactccggtgccaggcgtgccagcagcatgatcagcaacaccgagagcccgcccagtgtcgccaacacgaacgcattggcgctgaacgcgatctgcacgtcgctgccgagcgcccacatgcccaagggcgtcatcgcatcgcgcatcaatacaaaggctgccagcaggatcaggatgcgcatcgcgcccagcgctctgggcgtgagcgcgaaccacaggccaaacagcaacaggcccggcgccacgtgggcgctgtaatcaatcaatacctccaggccctgggtgatcatcgacgactcagccgtgggccacagcaatcatgtcgacctcgaccgctgccgacttcggcaactgcatcacccccaccgaggttcgcgtatgtaccccggcgctgccgaggatctcgtgcagcaagtccgaggcgccgttggccacttcgctctgctggtcaaaatcctcagcactgcgcacatacacggtgatgcgcgggattgccttgatctggtccaacgaacccagcgcctgcttgagcaaacccaggcaacgcaacgcgctgataccggcggcgatttgcgcctgagccagggtcaggctgtcgccgactttgcccggcagcacaatcgtgtcgcccacgcgcgggatctggccgctgatatacaggtggtcgccatcgcgaaccagcggcgtgtaattgccgccgactttgaattcgtccagttgatagccgatgcgctgttgcgcggcctggtatttttcatcgcgggtcatgggcgtgaatcctcgtgtcgacgttgccattcatccaccacatcgcccagggtcttggggatgtcgttgcgaatccaggccatgaatggccggtcgaacttgaacgctgggccacagtgttcaagcatgaaacggcgtacgttctgggtatttttgtagtgtggggtcacgggagtggcgcgagtgatggcgtcgctgtgccagtcaaaatccatttcgtctctcgggcggtgtgtggtttcggcagtagcatagcgaggtgcttgttgggcaggaagtagcctgaagtaacgggcgagcatttagactgtgttgggatgtcgtacaagacccctgactgcttataacggctaatacgccaaccttttcaagatatttcaaaatttcactttccttccccaccgaaaatattgcatggttgtacgacgacttgagttgtcgtgtccgcccccaacaacaataaggaaacacccatgccaaacgtcaaagtgctgatcggttttctgtgcctgttcaccggctacgtcgcagctgcgcctgcccccgccgagaaggatgtggcccaagcggtcgaccaactgacccaagccatgctgcacctggatctcaagcagcttcacgccttgacctccgacaaactcacctacggccactccagcggcaaggtgcagaacaaagcgcaattcatcgcggaccttgaaacccacaccagcgccttcaaaaccctcgaaatgcagaaccagaccatcaccctcgacggcgacaccgcgctggtgcgcaaccactttcacgcgctggcggtgaacagcggcgtcgacacgccaaccgacatcgacaacttccaggtctggcagaagcaaaaaggcaaatggctgctgatcgggcgtcaggcttacaaatactgatggctgacggtgagctgaccggcgtcagctcaccatcgcaccacctcgcgtaccttcaccagcgctttgcgcaacgcctgcatgtccaccgagcccaaggccagccgcaacgcatgcggcacggttgccgagacggcaaacggctcggcggtggacactgaaataccgtcccgctgcaaagccatggcgacctgatcagcccgcgcatcctcccccagcggcaaccatagaaaatacgacgagggatggctgatgtaattcacgccgtccaacacctgcgccgccagggcttgtcgcgcctgggcgtcctggcgcttttgcgcttccaggtgggcgacggtgccgtcctcgatccaggccacggccagtgcgctcatcacccccggcacgttccaggtggtggccatgatggtgcgctccagcttctttacccacgccgccggcgccgcaagaaacccaacgcgtaaaccggtggcaacgcttttggaaaacccgccgacgtacaccgtgcgctcgggtgccagcgtcgccaatggcggcggcgcgtctgcggccagaaacgcgtaggccgcatcctcgatgatcatcaggttgtgctgacgggcaaccccgaccagttgctcgcgctgctccaggctcatcacccaacccaacgggttgtgcagcgtcggaatgctgtacaccgcgcgcaccgggcgcttgctgcacaggcgttgcagggcgtccaggtccgggccgctggcgctgacggggatcgcgacgatttccaggtgcagggtttcggccagcaccttgaagcctgaataggtcagcgcatcaacagcaaccacgtcaccaggcttgagcattgccatcatcgttacggccaagccgtgttgggcgccgctgaccaccagcacctgctcagcctcgactgccagccctcggctcaacaggtgccgcgccaccgccgcgcgctcgtgcaggcggccggcatggggctggtagcgcagcagcgcttccaggtcgcccgacagcgccagttggcgcaaggccgtgcgcaacaggtcggcctggcccggcagcgacgggtagttgaagttgaggtcgagcattccggtgccgacggtcatctgcccactgccctgccccggtggtaacgcgatctcacgcacgaaggtgccgcgcccggtttcaccgctgaccagccccatggcttcaagctcggtgtacacgcggctggcggtgaccagcgccaggccatagtcggcggccaattgtcgatgggtcggcaggcgtgtgccgggcgccagtgtgccgctgcggatgttctcggcgaaggtgtcgaccagcgacttgtagcgggcgcgcggcataggcggtgtatccatgacaattttttgattgtcttaatcttcaatcctaggatggccgaacgcaacttatccttttcgagcacgcccttatggaacgcacctcgcgcctcaacaccctcgatagcagcgcccaaggctgggtcaatggctttatcggcgtggtgattttcagcggctcattgccggccacgcgcctggcggtgatggaattcgacccggtgttcctgaccatgatccgcgccaccctggctgcggcgctggggttgtgcctgctgtggctgttcaaggagaaacgcccggcgcgcgcgcaatggatgccgttggcaatcgtcgcgctcggcgtagtgattggcttcccgctgctgacggcgctggcgctgcaatacgtgacctcggcgcactccatcgtcttcatcggcctgctgccgctggccacggcggtgtttggcgtgctgcgtggcggtgagcggccgcgtccggtgttctgggtgttttcggttctcggcagcctgttggtgatgggctacgccttcgcccaaggcttgagtgccgcgccggtcggtgacgtgctgatgctgctggcggtgctggtgtgcggtttgggttatgccgagggcgccaagctgtcgcgcagcctcggcggctggcaggtgatctgctgggcgctggtgctgtcgctgccggtggtggcgccgctgagtgtgatcctcgcgccgcccaccttgagcggcatcagcctgcccgcctggctgagcctggggtatgtggcgctgttcagcatgctgatcggttttgtgttctggtatcgcggcctggcccagggtggcatcgccgccgtcggccagttgcagttgttgcaaccgttcttcggcctggcattggcggcgggcctgctgcatgagcaggtcagcctgggcatgctgctggtgacggttgcggtgatcgcctgcgtggccggcgcgaaacgctttgcacgttaacgctgcggcgcgaccatcttgaatttgatgttgatgtcgttggacaccacgctgttgcccgcccattcgccctcgccgatcttgaagtcgtcgcgtttgagcacgaattcaccgtcgaacacgccaatgccgctttgctccttgagcagcacagtgatgtccaccggccgggtgatgcctttgatcgtcaggttgccggtgatcttgtagcggttatcgcccagcgcggtggcaccgttggattcatacacgccgagcggataggccgcggtgtcgaaccaggcgggctgctgcagctgggtattggcgtcctggctgccggcatcgatgctggcgagctggatcttgagcaacgcatgcgccgcctcgggctgttgcgtgtcgaaactcagggtgccctcaaagtcgctgaaggtgccatacacgcgctgcccgaactgctggaaggtaaagctgatctggctggccgtgcggttcacatctttgtattccacggcctgcgcgttggccaaccaaccgaagaccagcgccagcaagcacaccttggacatttgacgcttcatggaacactccgcaagagaaaaggacacaggtgctgagctaacacgccatgccatggatttattccctttcggtgcgcgccctgctaaacagagtagtcgccaaaagaaacaataaggactttgcatgcacaccgcttccctgcaggacaccaccgcccccgaaggcatctgctacggctgcggcggcagcaacccgcatggcctgcacatcaagagccgctgggatgccgatggcgtccatgtcatcgccgagcatcagcccgaggccaaatacagcggctggcccgacctggtctacggcggcctgatcgccatgctggtggactgccactccaactggacggccatggcctaccactaccgcgccgaacagcgcgaacccggcagcctgccgcgcatcgactgtgtcaccggcaacctcggcatcaaattcatcaagcccacgcccatgggcgttacgctgagcctgcgcgcgcgggtcgaaggtgaggtggggcgcaaaagccgcgtggtctgcgaggtgtacgccggtgacgtgctcacggctatcggcgactcggtgttcgtgcgcgtcgacaccggccaactggccgccgccgcccatggtcgcgagggctgatcctggtctacattgattgccaccgctaatcgaggattgcaccgatgactcgtctaaccgcgaaagactttgcccccgaactgctggaactctacgacggctacgcccacggtaagctcaaccgccgcgaatttctcgaccgcgccgcgctgttcaccttcggcggcctcaccgcctctgcgctgctcgcggccctgagccccaactacgcgctggccgaacaagtcaaattcaccgacccggacatcgtcgccgactacatcacctacccctcgcccaaaggcaacggcaccgtgcgcggttacctggtgcgcccggccaaagccagcggcaaactgccggcggtggtggtggtccacgaaaaccgcggcctcaacccgtatatcgaagacgtcgcccgccgcctggccaaagccggcttcatcgccctggcgcccgacggcctgacctcaatgggcggctaccccggcaacgatgaaaaaggcgtggaattgcaacaaaaagtcgacccggaaaaactcatgaacgacttcttcgccgccatcgaatggctgatgcaccacgacaacagcaccggcaaagtcgggataaccggcttctgctatggcggcggcgtgaccaatgcggcggcggtggcctacccggagttgggcgcggcggtgtcgttctacgggaagcagccggaagcgaaagacgtgccccgcatcaaggcgccgatcatgttgcattacggcgagttggatacgcggatcaacgagggttggccggcgtatgaaaaggcgctaaaggcagcgggtacgacctatgaggcgtatatctacaagggcgccaaccacgggtttcataatgattcgacgccaaggtatgacgaggcggcggcgaatctggcgtgggaaagaacccttgggtggttccacaaatacctggcctgaccacactctgaaatgtgggctgtgttgaaccagttgctgatcgccgtgccctgtatgacctgatttgaaacacggtaaaactgtgggagctggcttgcctgcgaaggcggtctttcagtgataaataggctggttgatacaccgcttttgcaggcaagccagctcccacaggtgggctgtgttgaaccagttgctgatcgcagtgccctgtatgacctgatttgaaacacggtaaaactgtgggagctggcttgcctgcgaaggcggtctttcagagataaataggctggctgatccaccgctatcgcaggcaagccagctcccacaggtgggctgtgttgaaccagttgctgatcgccgtgccctgcatgactagatttgaaacacgggcaaattgtgggagctggcttgcctgcgaaggcggtctttcagtgataaataggctggctgatacaccgctttcgcaggcaagccagctcccacatgggctcgtcgctgattgccagatcaatgctccaacgcataccgccgacaatggttgagataaccctgctcatggctgcccaccaactgcaccacactggtccataaccatgacggcgcatccagctgtttcgagcggttctcctgcagcacggccatccattccttgcgcgtatcccggtccatctgccgggcgtgggcgatgccgaccacgcgggccaggtagccggcggcgtgcatcgcatcggtctcgctgagttcatccagctccagcttcatgtcctggggcagcaattcgcggatgaaaaaaccatggtccaaaaagcgcgtcgccagcatgcgttcacccagccccggtgacagctggcgcgcgccctccactactcggcgcccgttatccctgggcatcttcgcgcgggccgcacgcggtgcagcggcgccgacggcttccttgatgtcgatcaggcaatattcctgatcatccttgtcgcccacgcccagcagtaccgcatagcgcaacagcccgagggagctgcagcccttgacccaataggcgcaatccagcagttcaacttcggcgtcttttggccggcctttgagtgaggtgaccaactggtggagctcatcggaggcgcacagcgttttcagcgcagccttttctgcgcgcgacagcgaccagaaatgcttgcccagcggaatcgtcggtcgtacgttttcaatgcgttcacgcgccaggttcttccacgtgcgttccaccgcggtgcgcataccggccttgacctgggacggacgtggcggtgcttcatcgggtttgtctttaaaggcctgctcgtagccgaccatcatttcttcgagcatgcgcgcggtggtcacccccggcaggtccgagccgcgcgcggcggtggccaacgacagcgccaggcgcaccaggtcgtgggcggggttgccgatcacggtctggtcgaggtcgcggatgtgcatgtcgatgcggcccttggtgtcgccggtcgggccgaggttgcccgcatggcaatcgccacagatccagattgccgggccatgaggcaagcggcggccgggttggctgtgcagccattcgtaaaactgcaccgtgctgccacgcacataggcgtgggcggagcgcgccatcttcaaattgcgtagttgcgtgaggtggggcatgcggtcggcggggcgcggggttttcatggatgaactcaaggcgggagaaactgtagatcgctaccgccgagaaaatgtttcattttgtttcaaaataatggccttaggacagctttcgatgcgccgccgacaattcctcgagccagcccttgaacgccagcatcgccgaggtctcggcccgcgactgcaagcgcgtcagccaataactgccggtggtaatgccgatgtcgaacggctggcgaatcacgtccgtcgccaattgccgcgagaacatcatcgccggggccagtgccacgccgatgccttgctgcgccgcgtccatcattgccagtgacgaatcgaacacaatgctgcgcggcacgacggtgtcggcgggcaggcctgcggcctggaaccattgggtccactcatcggcgcggtaggagcgcagcagcgtgtgcttcaacaggtcggccggcgtgcgcaattgctcggccagcgtgggcgtacacagcacggtcagcggtgctgcgagcagctcgcaggcgtcggtgccgtgccaggctccagcgccgaaacggatcgcgtaatccaggccttcggcggccacgtcgacgcggttgttgtgggtggacaggcgcaggtcgataaacgggtagcgcgcctgaaaatccggcaagcgtggcagcagccaacccacggtaaaggtgcccaccgcgcccacggtaagcacttcgcgataatgcccgccttcgaactggctgagcgtctgggcaatgcggtcaaacgattcgcgcaccaccggcagcaaggtctcgccctcgctggtgagcatcaagccgcgtggcaagcgcttgaacaaggtgacattgagttgtgcttccaggctcttgacctgatggctgaccgccgcctgggtcacgcacagttcaatcgcggcgcgggtaaagctcaggtggcgggccgacgcctcgaacgcgcgcaaggcattgagcggcagatgggaacgcagcatgcttgaccctaatttatctaatggctggtgcaagatatgatcgtttgatcgcggccggcaaactgcctacatttgccccgcctgcgcaggctatctatttaatcgatcacctcatggaagcgacatcatgccccaactttctctgtttggagtgcgcaatttaaccgccctggccgtattgctggcagccggcaactgcctggcggccaccgacctgcaagccgtggtagatgccaacgtaaaaccgttgatgcaacaacaggcgatcccgggcctggcggtcgccgtggttcagaacggcaaggtgcaatactttaactacggcacggcttcaaaggaaacccagcaaccggtcagcgaaaacaccctgttcgagatcggctcggtgagcaaaaccttcaccgccaccctcggcggctatgcccaggcgaccggcaagctcaagctgtcggacaccgccagccagcacctgcccgcgttggccggcagcgctttcgacacgatcagcctggtgcaactggcgacctacacccccggcggcctgcccctgcagttcccggacgcggccgacagccctgagaccatgctcggctacttccagcactggaagccggcttacgcaccgggcgcacaacgcctgtattccaacccgagcatcgggctgttcggctacctgtcggcgcaaagcattggccaaccgttcaacgtggccatggagaaaaccctgctgcccaagctgggcttgaccaacacccacgtcagcgtgcccgccgacaaatccagcctgtacgcccagggttatgacaaaaacctgaagcccatacgtgtcagccccggcgcactcgacagcgaagcctatggcatcaagaccagcgcccaggacatggcccactacgtgatggtgaacatgcacccgcaaaccctggaaaaaccgctgcagcaggcgattgccaccacccacgcgggttactacaccgtgaacggcatgacccaaggcctgggttgggaacgctacccttacccgatcacgctgcaagccctgctggagggcaactccacgccgatggcaatggagccgcacaaggtcacttggctgacaccggcacagccgcaaccggcgaacgtgctgtacaacaaaaccggctcaaccggcggttttggcgcgtacgtggtgtacgtgccgagcaaggacatgggcgtggtgatgttggcgaacaagaactacccgaatgctgaacgggtcaaggtggcgcatgcgatcttgagtgcgatggatcactaagccacgcaaaaaaatcaaatgtgggagctggcttgcctgcgatgcagacacctcggtggatcaggtacaccgtgtcgatgccatcgcaggcaagccagctcccacagggttttgctgttttaaagagagctacatccccagccagtgcggcaacgccagcgagataaacggcaagtaagtcaccataatcaggaacaccaacaggatcatcagccacggcaacgccgcgcggatggtctgccccagcgtcaaaccggtcaccgccgaggtcacgaacaggttcaaccccaccggcgggtgcaccaggccgatttccatgttgaccaccatcacaatccccaagtgaatcgggtcaatgcccagcttcatcgcaatcgggaagaagatcggcgccaggatcagcacgatggccgacggttccatgaagctgcccgccaccagcaacacgacgttgaccatgatcaaaaagccaatcggcgtgaggccttcagagatcacccaggcggtgatttcctgcgggatctgttcggtggtcagcacgtgggcaaacagcatggcgttggcgatgataaacatcagcatgatcgccaggcgtccggactccagcagcaccttggggcaatcacgcagtttcatgtccttgtaaacgaacaaagccacaaacgccgagtacaccgccgccaccgccgctgcttccgtcggcgtgaacatgccgctgtagatgccgccgaggatgatcaccagcaacagcaagccccagaaggcacggcgcgcacaggtcagccattcgcgaaaggtcgcgcgtggctgcgccggcagctttttgatgcgcgcgacgatgtagatcgcgaccatcagcatcaggcccaacagcaacccaggaatcaccccggccataaacagcttgcccaccgacgtttccgtggccgccgagtacaccaccatcacaatcgacggcggaatcaggatgcccaaggtgccggcgttgcagatgatgcccgcgccaaattccttcgggtaaccggaacgcaccatgcccgccacggcaatcgaacccaccgccgccaccgtcgctggcgatgagccggacagcgctgcaaacagcatgcacgccaacaccgccgcaatcgccaggccaccacggatgtggccgacacaggcgttggcgaagtcgatcagccgttgcgccacgccgccggtagtcatgaacgcgccggagagcaggaagaacggaatcgccaaaaaggtataggcgtcggaggtttcaaacagcttgatcgccagcgaactcaccgagtcctggctgaacatcaggatcgacaccgcgccggacaacccgagggaaatcgcaatcggcacgccgaggaacatgaacacgaacaacagcaaaaacagacagagcacggccatcagtgacgctcctcatggctgccggccaacttgctggcctcaccggcctcgtcggccaggcccaacccgacctgacggtgggtgaatatgcggtagaaaatttccaggtagcggataaacaccagggcgaaaccgatgggcacgatgatcacaatatcgcccacgtccacgccgtattggtcgaggtcttcggcgccgatgtgggcggtcatcaccgcgctgacccacttgtagctggcgaccatgaacagcccggcgtaggccaggcagcacaggcacgcaagcatgccgagcaggcgctgcaccgggcgtttggtcagcttgaccagcgcgtccacgccgaggtggccggcggtgcgcacgccataggaaatgccgaagaaaatcagccagccgaacatggccttggtcagggccacgctccaggtcatgtcctgggcccaggtcatggtgtggtcgcccagggcgttgaagacactggcgctgaaggcccatttatcggccagggcaaagaacagcgtgtagatgttgttgagcatgacgtagacgaatgtcaccagggtcatggcggccagcaggaaggcgataaacccttcctccaggtgctcccagacgcgccttagcgtttgcatggcaaaacctcgcgaagcgggaatgatgtcggggtggaaagcgaagcggacctctgtgggagccgggcttgcccgcgatgggatcaactcggtgctacagatacaccgagttgcctgcatcgcaggcaagccagctcccacataaagccctttccacagtagttttggggggtcgcccaatcactggttggacgcatccgccgccttgatcaggtcagcgccaatctcaccctcgaacttctgccacaccggacgcatggcttcgcgccagagctggcgttgctcgggggtcagttcgatgatttcactggttttggcgtcgatgatcttctgcttggccgactggttcagcgcctcggcctgcttgttcacctcgacggtgacttcgaccatgatttgatccagggtggtgcggatgtccggcggcaggccattccagaatttggcgttggtgatcaccatgtagtcgatcaggccatggttggactcggtgaagtacttctgcacttcgttgaccttctggctttcatagttcgaccaggtgttctcggtgccattcacggtgccggtctgcaggccttggtagacctcggcaaagctcatcttgcgcgggttggcgcggatcgccttgaactgttcttcgagcacgctggaggcctgcacgcggaacttcaggccacgcgcatccttgggttcatgcagcgccttgttcgaggagagttgcttgaggccgttgtgccaataggccaggccgaggatgttcttgtcctgcatcgaagtcagcagggccttgccctgtgcggcctggaagcggtcgacggcagccaggtcgttgaacaggaacggcaggtcgtagatctgcacttgcttggtgtattgctcgaacttggccagcgaaggcgcaagcatctgcacgtcgcccagcagcagcgcttccatctccttgccatcgccgaacagtgatgagttcgggtacacctcgaccttgacccggcccggcaggcgttcttcagcgagcttcttgaacagcagcgcgccctggcctttgggggtattttcggcgaccacgtgggcgaatttgatcacgatcgggtccgccgcctgggccaggcccgcggcaaacaaggtggcggcgcacagcagcgcccgagaaagcttgagcatggaaaatcaccttcttattgttgtgttgtagggcaaggtgcctgatgtcacgcgtgtagtgaatttcgaattttagatacctgcgttcggtgtgggtgaacgccgatctcatcaactccactgatccccggtgggagctggcttgcctgcgatagcggtgtgtcaggcagtcgatttgttagctgagccatcgccatcgcaggcaagccagctcccacaatttttgattcggttttggtcagttagagttgggctgccagcaacctctgcgcccgcagcagcaccggcgcatccaccatctgcccatcaatctgatacgcccctgccccatgcgccccggcctccaccacgcgcttggcccaggccaaatcatcggcgctcggcgccagtgccgcatgtatcaccgccacctgcttgggatggatacacagcgcaccggcaaagcccatttcgtaggcgtgccggatcgaacgccgcaacccttcagggtcatcaattgccgggtgcacgccatccagcggcgcgaccagacccgcagcgcgcgagtgcacgatcaacgccaggcgtgcctggtcgagggcgaactgcgcagcaggcgagttgctgctcaggttcaagtccagcgccaggtccaggccgccaaacgacaggcgttccacctgcggcgcatgggcgatttcggcgactgccaacaaaccccgcgcgctttcgatgatcggccagatcagtttgccggtagcagccaccacggcgacctgggccgcgctttccaccttcggcaacagcacaccggccacgttggagtgggccttgcaaaacgccacatcttcaaagtgctcggcatgctccggtgcgttgatacgcacccacacttgggcctcgggatgctcgttaagaaacgcgccgaggttgtctcgcgcctgacgcttgagcggctcttccaccgcgtcttcaaaatccacaatcaccgcatcggcgccactggccagcgccttggaaaaccgctccgggcggctgcccggtacaaacaaggctgaacgcactaaaggctttggcatcaggtaaattccttattagataacgccgcgcgcgcgcaggctgtcgatggcatcggccgagtagccgagccggtcgagaatgctcatgctgtgctgccccagcgcgggcacagcgtccattcgcggtgtgaacgcggcattgcgcgccggtggcagcagcgacggcaatggcccggccgggctctggacttcgcgccagctgtcgcgcgccttgagctgcgggtggttccacacgccctgcatgtcattgacgcgcgcactggcgatctgcgcgtcttccaagcgctgaatcaccgcctcggcgtccagctgcgcaaagctgtcgacgatgatctggcgcagcacttcgcggttggccgaacgcttgaagttggccgagaagcgctcatcggtcgcaagctcaggcgtgagcagcaccttgtcgcagaacgccgcccattcgcgctcgttctgcaaaccgagcatcaccgtgccgccgttgccggtgggaaacggcccgtacgggtagatcgtcgaatgcgccgccccggcgcgcggtggctggggcgcgccgtcaaacgcgtagtacatcgggtagcccatccactccaccaggctttcgagcatgctcacatcgatgcggctgcccttcccggtcttgccgcgcagcagcagtgccgagaggatgccgctgtaggcgtacatgcccgccgagatatcggcgatggagcaaccggccttggccatctggtcatcaccggggccaccggttaccgacaaaaagccgccctcgctctggatcagcaagtcataggccttcttcttctcgtaaggcccgccttcgccatagccggaaatatcgcagacgatcagccatgggaaacgctcatgcagcgcctcgaacgacaagcccatgcgcgccgccgcaccgggtgcgaggttctgcaccagcacgtcggcgtcggccagcaagcggtcgagaatgtcgcccgcctcatcctgcttgaggtccagggtcaggctttccttggagcggttggtccacacaaaatgcgaggccaggccgcgcacgcgttcgtcatagccacgggcaaagtcaccggcgccggggcgttcgatcttgatcacgcgggcacccaaatcggccaattggcgggtgcagaacggcgcggcaatcgcgtgttccaggctgacaacggtgatgccgtccagcggtcgttgagtagtcatcacagttcctcagagccagtgggccatggacgccgcgttacgcaggttccagaccttgtcgatcagtgcattggcttgcgcggctgtacgcgcgccgctgaaaagggtcaggcgctggaatttatcggccagctccacacggctcagggtgttgcctgggtcgcccttcggctcatcaatggcgccgtgcagcgtgcggccgtcgagcgtggtgacggtgacgcggcccagccagcgttgcggataggcgccgtcgacttcagggtcgagggtcatgctgaccttgtcgcgaaacgtcgagacggctggatcagtcagcgccagttcgtggaactcggtgagcccggccttgccatgcgcggcgatcaggccgagcacggtgcccatggagaacttggcctggtgcacgctggcgggaacggtgacgcgccccagcacatcaatggcgccctgatgcacacgggtttccacgcgcccaatctgatcggcgcccagcccttcgcgttgcatcaactccaacagcgcatcggcggccggatgggtgtggcggcacgaggcgtggaacttgaacgaggtttccagcagtgcccagcgcgtgccgaggtcggcggacaatttgctgggttcagcgtcgctggacatgcccgccgccaagccctggtcgccttcaagaatattgcgcgcgccggtcagcccgtccgccgtcaggtaggcggcgagcaaaccatcggctgcggccttggcggtgtgcagctgcttggaatcggcggcatcgcgcaaaaattcccacagccctgcagcctgagtgccggcactgccgagcaaattgatgaattgctcctggttgaaatccagcagcttgcccacggcaacggcggcggccaaggtgccgacagtcgccgtggtgtgaaagatgcggtagtgagaacgccccatgaattcgccgatgcgaatcccggcctcatagcccgccactgatgccagcagcagctcgcggccggatttgccgaggtcttgcgcggcggccaaggcggcgggaaacaccaccgtggccgggtgcagcaccgagctgttgtgcaggtcatcctgctccaccagatgggacgaggcgccgttcaccagcgcggcgaaatacgcgctgctgctgccgccgttaacaatgatctgcgccgggccagtgctcgggcccatcttttgcgcgtagcgttcgaacagtggaatcgggtgcgcgcctttgctcgccagcgccgaggccagccaatccagatacaggtcttcggtgcgcgccagcacgttgtcgggcaactgttcgtagctcaactcggcaaggaaccgacacaaggcgtgggtatggctcatggtcaggccctcagaagctgcgtggcagttcgagcagatgctcggccacgtaggacaggatcaggttggtggagatcggcgccacttggtacaggcgcgtttcgcggaatttgcgctccacgtcgtattcgcaggcaaagccaaagccgccgtgggtttgcaggcaggcgttggccgcctcccaggacgccttggccgccaggtacttggccatgttggcgctggccccggcgttctggccgctgtcgtattcctcgcaggcacgccagcgcatcaggtccgccgcttcgatttcgatgtgcgcttcggcaatcgggaactgcacgccctggttctgcccgatgggccggccaaataccacgcggtcgcgggcataggcgctggccttttcgataaaccagcggccgtcgccgatgcactcggcggcgatcagcgtgcgctcggcattcaggccgtcgaggatgtatttgaagcccttgccctcctcgccaatcaggctatcgaggggcaattcgaggttgtcgaaaaacagctcgttggtttcgtggttaaccatattggcgatgggctgcacggtcaggccgttgccgatggcttcgcgcaggtcgaccaggaagatcgacatgccttcggactttttcttcacctcggccagcggcgtggtacgcgccagcaggatcatcaggtcggaatgctgcacccgcgagatccagactttctggccgttgatcacgtatttgtcgccgagtttgatcgcggtggtcttgatcttggtggtgtcggtgccagtggtgggctcggtgacgcccatcgattgcaggcgcaattcgccgctggcgagcttgggcaggtagaaacttttttgcgctgggctgccatgacgcaacaaggtgaacatgttgtacatctggccgtgaaccgtgccggagttgccgccgcaacggttcacttcttccagaatcaccgaggcttcagccaggcccaggccggagccgccgtattcttcggggatcatcgccgacaaccagccggcgtcggtcagggccttgacgaaggcttcggggaagcctttttcttcatcgaccttgcgccagtaagcggcgtcgaattcggcgcacaaggcgcgcacgccttcgcggatggcattgagttcttcgttgtcattcgggttcattaacggctctccgcctgttgttctggtgttagtcgaaatgcagttcggctgtttgcgccacgccatcggcattgcctgcccacaactgggccatgccgggcgctgtcacgcgcccgcccacggtaaatggctgtggcgcaatcaacgggcgcacgccgcgataggcgaaacggcgcaaggtggcgcccgggtgcgcgcggcaaaaggcgcgcaggctcaaggtggcgatcaacggcccgtgcaccaccaggcccgaatagccttcggtgccggtgacgtaggggtagtcgtagtggatgcggtgaccgttgaaggtcacggcgctgtagcgaaacaacagggttggcgtggggtcgacactctcacgccattcaccctcggcgagtgcgtcgccgctgcctggcttgggcggcgtcggttcgcggtagacgatgtcctgttcttcgcgaatcgccaggcgcccgtcctgggaatagtcatggcgcacggtgacaaacagcagcgcgccggtgcggccggttttttcttcgacgtgggtgatggtcgacacgcgggtcgccgcctcaccggcgcgcaaggcatgcaggaactcgatacgcccaccggcccacatgcgattgcgattttccgccggcggcagaaacccgccacgggccgggtggccgtcagtgcccagcgccgattccggcagtgggtcttgaaagaaacaccactgccacagcggtgggacggcttcgccctccaggggcaccgcttcgccgaaggtcgcggcgatgcgcttgagcaggttgtggctcaggtggtcgtgggcggtttcgcttcggccgatccaatcggtggcgctcatcgggtacacatcctctggcagtggtggtctgccccggatcatgcaagcgcctgcccgttctgagaatttgcatttcaataaaccagcgttcggttatgctgaacgccactcgtcacacctccaattcactgtgggagctggcttgcctgcgatggcgatgtatcaggctgcacatgcattgcctgatccaccgctatcgcaggcaagccagctcccacaattgatcttcaccgttgccgaaataggtgttttgcatgcacttcgatctcgccgacctgcgcctgtttatccatatcgccgaatcccccagcctgacccagggcgccaagcgtgcgttcctctcgcccgccgccgcgagtgcgcggatcaaggcgctggaaggccagctcgacacgcggctgctgtaccgcgacagccgcggcgtggaaatcaccccggccggtgagcgcctgctgcaccacgcccggctgatcatgcgccaggtggattacctgaaaagtgagttcacccagtacggcgtggactcggccgggcatatccgcatctttgccaataccacggcggtcaccgagtttctgcccgaggtgctggcgggctttttgtcccagcgccccggtgtcaccgtcgacctgcaagagcgcctgtcccgcgatatcgtgcgtggcgtgctggatggcaccagcgacatgggcatcatcgccgggccggttgaagcggcaggcttgcaggtgctgcacttcagcaccgacgaactggtgctgatggtgcccgtgggtcatccgttggccgaccagccttcagtgacgctggaccaaaccctcgcctaccaacatatcggcctgcacgaaggcagcacgctgttgagctttttgcgtgagcacgtggaacggctcggcaagcatttgtcgctgcgtatccaggtgtcgagtttcgaggcgatttgccggatggtcgaggctggcgtgggcatcggcatcatccccgaatccgccgcggtgcggcacagccggaccatgcagttggtggcggtaaagctcgatgagccctgggcgattcgcgagcggagcattttggtgcgcgaactggaagccctgcccggcaccattcgggcgctgatcgccaccctgatgccggacccactcagtgcaggctgatgttgcgctggctggcggtatcgatattgatatggctcagtcggccctgcccgtcgaacagcaataaatcagaccccaggcggcgaagctgggccggcgattgcggccagtgcaacgtgacgcaaagccgatcgctggtacggtggatcacgtgccagcaggtatcgtgcttctcaacccgataactgatcagcaaccagtcctcaaatagaaacgggctgactgactcatcccattcctcgtccggcaagttgccaggcagcctgtagccctttctaaccccgtgctgcttaaggaccagaatgggagtgccatcgtcgtgcttgatccgatactgcgccgattcagcggtggcactgggcacctggaagtccgtcgccacgatgtcaaacgcgctttcgcgactgaccaggcgccgctccggcagacgataatgccacagcatcaggcacccacccggcgctgacaaccacaggtattcgttgtgttcatcgaccttgatggcccgcaccgactccggcagatcactcacatgccagagcgtttcaaagccacgatcaacatccaccacgcgtacctgcgggcctttgccgatggtccagcggctgccatcaaacgcgtttgcgaagacatccatggccagcacgccgaggtctttggcgacacgattgaccaggtccagtttgctcacgcgccatacattcccccgcccgatcagcaccaacgcgacctgtcggctatgggcaatcacgatcttctgcgccggcaccgcaaagtgaaacaacgctgcgcccgccgcatctaccaccatcacgcccgcctcgcccagcgccaccaggtaacgctcatcctccagcggcgccgcgtcgaaaatcggccggctgccggcggccggtgcagaccactcgcggagttcacccaaacgctccagcgagaccacaggcgtgcgcttcagcgcctggcccggcaagtccgcttgaagtgctttgtcgcgactcatcttgaccagcgcttgtagctggttatgggtcagttggccttgatcgctgaattgatcggccagaatcgcgtgcacggtggcaccggccagccaggccagggcggtggtgttggccttgtgcagcaataaggcctgcgccagggcggcgcgttcgctggcgcgtgcggggtcgtcacgcagttgctcgacgcacggcccgtaagcctgcagcgtttcgggcaacaggatcgcgcgtttaaccagcgcctcaatgcccaagcgcccgccggccgcctcggcgttgagcagccattgcgcggcgcgtggtcgttcagccggcaggctccagatcacatcgacggcttgcaaccacaggcctttggcgatcaacgactcggccaattccaggcgcaagcggtcggcggcttccggcgacttggcctggagcatcaccacggcgtcggcgaacgcattgtcgcgccgcgccaccagcacggcgcgctgccactgctcggccaggcacagcaggcgcacgatcaccgcgggcggcatgtcccaggccagggccaggtcggcggcctgctgatagcgcgcgtgtttctccaggtaatcgagggcttgctggtgctctttgagcaattcggcgagtacaaacaccgcttcctcgatacgaccggcacggtccaggcgttcaaaagtctggcgatacacctggcgcaagtgctcggtcaaatcgtcttcgaacagcatcgagcgcgccgggccatcctgctggctgaggctcaagtcctggcgacgctgcggcgtaccaaagctctgttcaccgctggaggcaccgccgttcaaagggatggcgtgacgcaaggcttcttcgaaattgccgtcttcgaacatctcaagcatgcgctgcatataagcggcctggcgtttgccatacagcttggagagctgggaatgctgggtcagccgggtcaacaggcggcgccacacggcaggtttgtgccggcgcggggtggcacgcgcagcgatgcctgggtcagcgggtgcgcgggccactggcctcggcgccgctttggcgggtgccgacgcgccacggtgcaggaagcggttcaacccgaacagcagcgcggtgatcaccaccatccagatcagcgcgcccaggagcgtgccgccgagggactgtgtatgggtggccaacatggcggcgggctcgctctggccgaagaggcggaccagcccacccagcagtagcaagccgatcacgattttcagcaccggggaggaaacttcgcgggcgctgtttgcgttgttttgcgcagacgccgcgctggcgcctggccctttactcggcgtgtgacgcgggcgctccagcagcgcttgcatgattgcttcgcgctccgggctgaccggctccagtggcccgccgaggatttcacgcaggtcggtgaccaccgcttccggcagcgttgccggcaacggggtatggcagtcaaaggtgtcgagcagcgggtaggtgctgatgtcgagccacagcccgggcttcagcacctgcgcatcgcgcaactgcagggcgtggacatggctgccgcgcaccagccacaggtcggcaacgggcagcccgcgcaattcctcggggtgcagcgcggcagacgacaaaccccggccctggcggatcagcggccagccgtgcaggctttcgcaatgcaccgggcaaggtctgtggaactgcaacaagtcgccgtcggcaaagcgataggcgcgcgcgtcggtttgccaatagtcgaggatcaaacgcctgcgctcaccttcatcaaagcgctcggcggcaaaccataggccgtcaatctgttggtgcccggtgagtaccgggcggcgaatcagcatctgttctggctcaagcattggcagcgtcctgggtgagctgcggtgcctggttgcacatcacttgcaagcgcatggcgcgctcgccaaccgagtaaaccagtaattcgcggtcattggtcagtacggcgatcaagccgctcatggggcaaaagctcgcgcgggcaatcggcgccgaggtggtgaacaacgtgcgctgttgcccctcggcgtacagcccgacgctgtgctggttcggccccagcagcaccagtgagtaagccggccgttgggcgtacgtgtagtgcaggccgatggctttccagccgggcgccaagtcgatctgctcgtgtttcttcggaaaactttcatgggtcaccaggcgccaactctggtggccgccctcggtggtcagcagcgcgcaaccgccgcagtactggcgccagtaaaagttggcggccagcaacacctggctgacgcccgctgccgagccgaccgcatgaccattggtacgtaaaccgtcagcagaccccgaatacgcgacgatctgcccgccttcgctgcgtgcataagcgatggtcaaggggtcgacctgcaccaggctcatcacgtcatccgccacccggcagagttcacgcgacttccagtaggcaagccgcccctggctgtcgagcaagtacacgcgcacggagttctgactgtgcagccacacactcggcaggaacgtggcggtgcccggtggcagttgcagctcttcacggttgggtttttcgacggtaggcataccggggatgttccagaacgtcaggctgtcgttatcactcaacacggcaccgaggctgcggtggtgaaaggtggtgctcaagacgcgctgatgtttgccccacagacggcgtcgaacctccagggactttttctggttcttgtgcggcagcttgatcaccaccatgcccggctcatcgagcatgcgcagcgccacatagttgccggcgctggagattaccggcggcaaggtcaaggcgacgcgtggcaccccatttgcgagcttcgacggcggcgcctggccttcatcgtcgaactggcctttgagcagttgcaccgcgcgcccttcatccggcataggcaacagcacgcgccgcaccgatccggcctgcaattcaaaggacaggctttggccatccaggctgcgctgcacctgcacccggtgcgtacaggtcttgctcgtgtccttgggcaagcgctgcccgacggtccagcattcacccagcgtctcaccctgcgcggccagccattcctgccaggcgtgccagtgcgccggggcgacactttcgtaggtgcgcgccttgagcagccgtttgagctgccccgcgctatcgaatgcatgcagcaccggcgcgccttgcaggatgccccaacgcaactgtgcgcccgcctcctcggcacgccgggccagcagcatcagcaaggcgatatgcaccagccgcgcggcgccccactgcaacgggccggcgtcgaacagcacgacaatcaggcggttggcttcacgggcgcggtattgcggcgccaggaacatatgctcgccgccgacagcccggcgcataaattcatccggcacttcatcggccagcagccattcgctggaaagcaggcgctcgtaaggcccacggcgttgcagatcacctacgccatccggctccggcaccccgccttgctgccgaccgcgcagtggcccgagcaccgggttgagacgccccagcaagtcggcgaacagcggcagatgctgcggcgcaaaccactccagccactggcgccagggttgcagggcttcaggcagttgcatggcgggctccccactgcgtcgcgatgcgctgaaggtgttcaaccgtcaccggcaacaggcgatccaacggcacgacggcttgcggttcacgccacagcagcaagggcgagcgcttgaaccgtgccgacagcgtttggccgagcacgtccaccggcgctgtcggctcccaactggtgggcagccacagacccggcgcgtcggggtgcactgcggcgtaggccacgccgtcgacccacggcaaatccgccgccgccccggtgaccaccaatacgtcgccgctggcggtagcgtgcaagcgcgtcgcctgttcatcggcgagcagcagcaagcgcgcatgcaagcggcgcgcggcgtcgccccaggcgacggcggcttgagggtcggccggcacctgccttgggcgccaggtccaggcgtagtggtcggcactcatggcgtcagcattcgggacagttgcccgcgtacctgctgcaagggttccggcatggtctcgctattgaagttggcgtcgatctcgcgcagcagcccttcgagcgcgggactggcgggcggctcgctgcgcgccaggtagtcttgcgccgtttcgagcaagcgattcaagcgcgacatcggctgcaaggtcgcctcttcgaccgcgctgaacaaatggctgttgctggacgcggcaaacaggtcgcgcagtacctcgcggccatgctgctgagcctctttggtcggcagcacatacagcagcggccacaggtcagcgtcgctggcttgcagccgcccgcccagcagcgcggcagccgcgatcagccgttgggacttgacgatacggcggtccgacagcgggatgccggcttcgcgcaggcgtcgaatcgcctgggccagggctggacgcacggcgcccaggtcgacgtttttcagggcctggctcagcgtgtccaactgcgccaacccgagcaactgttgcacgggccgctgttccgactgccaaccgcccgccagcatggcttccagttgattgtccggcaccgactcgacaaacaggtgcaacaggaagcggtcgccaaatgccgccagcgcttcatcgtccggcaagccgttggccgcgccgacgcacacccgcagcgggcattggatttgggtatggccacggcgaaagcggcgctcgttgagcacgcccagcaaggtattgaggatggcggtggagcccaggaagacttcatcgagaaacacgatatcggcttccggcagcatgccgctgacgtcggtttccaccgtgccttcacgcagtttcttcaggtccacggcaccgaaaagctccgacggctcagtgaagcgccccagcaagtattcgaagtaacgcccgcccatggactgcgccacacgccgcaccacggcgctcttggccgtgccgggcgggccgatgaccagaatgtgctcctgggcgaccgccgccagcacaatcagctcggccaattgctcgcgcccgaccaagccttcggtcgccgtgcgcacagcgtgacggatttgcgtggcagcgctttgcaactgagcaatcatgggtgtcttccctgaaaccaaagcggggaatcttgcctgaggctaaggtattagcaaagcgttgttacaacctgccttgaggagtcagcccatgcaactcgaaggatcctgccattgcggcgccgtaacattcagcctgaacagccagcatccatacccctatcagcgttgctactgctcgatttgccgtaaaacccaaggcggcggtggctatgcgatcaaccttgccggtgatacccaaagcctgaaggtgcaggggcgcaagcacatctcgatctaccacgccaggctcaagcccgagggggccagccgcgcgcacgccagcactgccgaacggcatttttgctcgcagtgcggcagcgccttgtggctgttcagcccggagtggccggagctgattcacccgtttgcctcggccatcgacacgccgttgccggtgccgccggagcacacgcacctgatgctcggttccaaggcgccgtgggtggaagtcagcgtgcgcaagggtgacttgcagttcgacgaataccccgaagaatccatcgcccagtggcatgcacgcttgggcctgtcgcgttaacagtctttgacagtttcccgacaaagctcacaaagattgttggccagccgcgccctagcattcgagcatccaaaccagccttcgggtgctcttcatgtttcgcacattgcgtggtattccgctgttgggttgcctgctgggcacgctcggttgccatgggcaaccgcctgccccgccgccaattcccaagggcgattacggcgcgatcattcgttacctgcaagcgcgtattccacgggaaatggcccaggagaatgtgcccggcctgtcgattgcactggtcaatggccaggaactgatctgggcgcgcgggttcggcatggccgacaaggcccagggtgtgccggtcacgccgaacaccgcgtttcgcgccggtggcatctccaaactgctcaccgccacggccgcgttgcaactggtcgagcagcaacgcctgggcctggacgcaccgatccagcagaccctgcgcgagttctacgtgcgctcgcgctttcacaccgaccagggcgccgctgaccgcgatatcaccctgcgccgtttgctcagccatcagtccggcctgcccagtgaacacctgcgcgacctgcgcagcagcttcgccatgggccagatgccgatgcgcgtgtcgggtgtgtggctgagcagcccacccggctcgcaagtggcgtattccaaccttggctattcgttggtgggcgcggcgattgagcgggtcagccacaaaagctttgaagcgcagttgcagagcagcctgctcaagccgctggacatgagccagtcgagctttgtcggcaccggcacgcagctgagctttcgcgccctgggctatgaggatggcgtggcgagcaccgacgcccaagtgcgtgaccttgccgccggcggtttgtgggccagcccgaaagacctcagccactacgtgcagatgctgttcgcccagggcctgtacaaaggcaaccgcgtgctcggcagtgcgtcgattgacgcgatgttcacccagcagaacaccggtaacgcgctggacttcgattgccagatgggcctgggctggttcctcgcgccgtgcggcgatgagccggtcgcccccggcgtgcgcacctaccagcacagcggcggtggcgatgattttgccgcgcagttgaccgtgctgccggacgcgcaactggccgtgatcatcatggccaatgacagcaatgccgaagagctggtcgccaggctcgccaccgacgccctgcgcctgatgctgcaggcacaaaccggcgaagcggtctgcgccgacgactgccaggcacccagccatgggctcaaggtgcgccatgtgccggccgccgtcgaccgcaaacgcctggccgggttttacgcgacggcctggggcgtgttccgcatcaaggacgacaacggtcgattggccggcgagttggccgggttcgacttcgagctgttacgcgatgaatccggctggctgcgggcgcagaagaagatcctcggcttctggctcaaggacctcggtgatctgggccgcgtgcaactcgacgtggtcacggtgcagggccgcccgttgctcaccgcccgcagccacggccagcgcattgcgatcggcgaacgcatcgacccgccgccgctgccgctggcgtgggccgacaccatcggcacttaccaagtgctcaacacccacgagcccgacgcgccgttaagtggcatcagcgtgcgcctggaagaaggctttttggtgattcgcggccaattgcacgacgagccgctcaccgactacatcctgctcccggtcgacaacgcccacgccgtgctggccggcaacggctatggcctgggcgacaccgtgagccgccaggtcaatggcctcagcgcgtcgggctactccttcaaacgcacccgctcccccaaccaccgcctgaatttctaacacggacgaacaccctgatgcgcgcaaaaaacctctgcctgtcgttcacctcgttgtgcctgctcgcggctgccaacaccgcgactgccgaagactggcaatacagcctcaaggccggcgtggccaacgcgccccgctacagcggcagcgacgaacgtatgactgcgccgctgctgggcggcaaaattatcagcccctgggggattttcctcgacaccgacaagggcctgggctggggctacgaaggcaatgccttgagcttcagcgcttatgtcggcgccagcagttcacgcaaggataaaaaccagcgcttgcatgccggctccaaacgcctcaaaggcatgggcgaaatcaaggcgcgcccgcaattgggcgtcagcgccgcctacaacctgggcggcgtgatcgtcggcgcgacgctggaacatgccctcaaggaagatgaccacaaagacaccggcaaggcctacacccacctggaactgaacctcggcaccaacctgtatgaaggccgctttggctcggtagatgccagcctcagcagccacttcggcgaccgcgactacttgcaaacctggtacggcgtcaccaccggccaggccgcgcaaagccgcttcaaggcctacaaggccggtgcaggcaacatcggtaatggcatgaatttggtgtggagcatgccgatcagcgagcgcacgcagttttcgacgttattggacgtgcagtacctggcggatgaagcaggcaagagcccgattgtggagcggcggttgcagacgtcggtgatgggggtgttggaatacagcttctagcttgataacccatccgggcaatgtgggagcgggcttgctcgcgaatgcggtgggtcagtcagcttatctgtaactgacccaccgcattggcgagcaagcccgctcccacaatttgaccgagttcggccgtcagacttctgtgctttgcttttctgtgggagctggcttgcctgcgatgcaggcaactcggtccatcaggcataaccagttgatgccatcgcaggcaagccagctcccaccctgaatcggttatcaccctgacccttgcttaacgtcaggccttactcggcatacgcccaggtcatccgaaacgacgcaccgccccactccgaatccagcacttccacctgcccgccatgccattggctgacccgcttgaccagcgccaggcccaggccaaagccgccggtgcggcggtcgcggctggtgtccaggcgcaaaaagggttcgaagatcttcgcccggccttccagcggtacgcccggcccgtcgtcattaacgcgcacttcgtaaccgctgccgaatttgaccaacgacacttccacacggcgctcggcgtagcgaatcgcattgcgcagcaggttgatcagcgcgcgcgccataaagcgtggctcgatctggataaagtcgacctcacaggtgcgcaacgacagctgcacccccgccgcctcggcttccagggccacgctgccgatcacgctgtcgagccagctgtgggcctcgatattttcccgcgtgacctgggtggcgccgcgctccaggctggcgtaggtcagcagttcggagaccatttcttccagctcgcccaggtcggcgtacatgtcggcgatcagctcgcggctttggcgtgggtcgggctgttgcttgagttggtccagctcgaacgacaagcgcgcaatcggcgtacgcaactcgtgggacaccgcgttggtcagttcacgctggttggcgatcaggctttcgatgcgctcggccatctggttgaagtgcccggccagttcgcgcacggtggagcggcgcggcagcagaatgcgcgaggccaggtcgttatcgccaaagcgctgcgcggccaggcggatatgctcaaggtcacgccagtgcgggcgcacccagaaatacagcacgatggccaggctcacaccgaggaagccgtaggcccacaggtacagccatttgggctcttccggcagtttgatttgcagcaattgcgggccaccgtcaatcgtggtcaggaactccataaagtccccacgtacaaccagttggccgtgggccagcaatttttgttcgcgttcgttcagcgccaaggcatcgctcggcaccagcttcaggcgcaagccgtaatggggttgaagttcatccagacgcgcctgccgcgccgcaccttgcaggggcttcagttgctccaccaaaccataggccgggccacgcagcgcctcacggttgtagacttcgttggcctcgggcaataactcgtcgaaggtgtagttgaccagccagatcgcccccgccaaacccagcgccaggatcacatacaggcgcagaaacaggcgcagcatctaaacctcccacgcgaacgggttgaacaggtagcccttgccccaaatggtcttgatgcacaccggctcacgcgggttgtcattgagtttgccgcgcagtttgctgatgtacacgtcgacgctgcggttaaggccgtcgaaggcgataccgcgcatgcgattgagaatgtcgtcgcgggagaggattttccccgagctgctggccagcagccacagcaactcgaactccatggtggtgaggtcgatcttctcaccgcccaggctgaccacccggcagctgcgatcaatcgacagccggccgaactccagcgagccgcgtacggtgggctcgggcacctggcgacgttgcagcgcacgcagccgtgcgagcaataccggcggtttgatcggtttgatcacgtagtcatcggcgccggactccaggcccaggatgtggtccaggtcgtcctccttggccgtcagaatcacaatgggcgtgtcagacacattacgaatctcgcgacacacgtgcaggccgctctggcccggcaacatcaggtcgagcacgacgatcttcggcttgaagtcgagaaacgccgccagggcttcgtcgccccgatgtaccacgcgcacctcgaaaccgtgctgcgccagaaagtgcgcgatcagccctgccagcttctcgtcgtcctcaacgagcaagaccttgcccaaacccaggttttccataaattctcagtgtaagaacgcggattgaagtaccggcattataagtggcaagctggccggaaacggtactgtacaagcgggaaaatccgatgttctccgcgttttttgtacaaccttcatgtttttaagagttttttacatttaccgcatactttttaacctgcttttttgcggagcgtgcgcggccccttctcgcagcactgaaacaacctgcgcgccgcgaatcatcaagtaataaatcagtcacgcgattgtgaactacactgcggcatagttaaatttcattcctgcaagagccacttaactatgcgtcatacccaactcaatacccgaagtaaaagtaaccctgggaaaaccctgcgtaacgtttcaaccattgccgggctcgtcggtatcttggccggatgcagtagcggcgccgtgcccaataccctgcccaacaaggccaagtttatcaacccggccgggctttccacgcccaccggctatacccatgtggtagaagcgccagtggggcgcacgctgtatatttccgggcagatcgcgttcgacaaacagggacaacttgtgggtccaggtgatttcaccgcccaggctgaacaagtgtttgccaatttgaaagttgcactggaggccagtggcgcaacctttaatgatgtgatcaagctgggcgtctatgtcaccgatgtggggcaactaagtgccttccgagccgttcgcgataaatatatcaatcagaaaaatccgcctgccagcacactggttgaagtatcgcaatttattcgcaaagagttgttattggaaattgatgcagtagtggtagtgcctgctcaacccgcaacggcacagtagcgcggtaaccgactcgctcaacgccgaccctgaaccgccgttgccctcgcaaaaaagcctgtccacgttacactcgcaacgtggattcgcgcgttggcgcagatgaccaagggaatcaaggaaggcattgaaccgctttcagttgtcgcggtggttactggaacgggagcagcatgcgcaaggactacctggctttttttatctcactgttcctgtcgcggctggcggaccagatcctgctgtttatcgtgccgctgatcgtgttccagaccaccaacagtgtgtcgtgggcagggctggcgttctttgtcgagtcactgccgcgctacctggcgttcccggtgtgcggggcgttgtgcgacaagttttcgccgatgcgcatcctgcatatcagccaggtgtaccgggcgctggcctgcgtgatggcggtggcgttgtacggcgtgttcgacggcatctactggctggtgatcctgtcggcgctgtgcggcgtgttgaccactcagggcatcatggcgcgggaagtggtgatgccgcatatcttcaagcattacacctacgccaaaaccttgtcctattcgcaaattgccgaccagagcggcctggtgctggggccgttggtggcggcgctgatgctggaggtctgggcgtggcattgggtggtcatcgggattgccggcttgtttgtgctggcggatatggcgatgtgggtgtggcagcgcaacaccacggtgaatttgcacagccatgagcagcacccggatatctggctgcaaccgctgcgcgtcgcgttcgggcatatacgcaagctggtggagttgaaacggatcatcaccctggcggtgggtgtgaacctgatgattggcgtgacgctggccacgtctgccgcgatggtcacgggccaatacggcgccggcaaggacacctacgccctgctgcaggcggcgggtgcgctggtgaccatcggcattctgttttatctggcgcgcgccacgctaccgttgaaggtgatgggcgggctgtcttacgcgatgatcggcgtgggtgcgttgatcaccgccctgagccccaatgtgtgggcgtataccgttggattcctgctggtcaccggcttcgacaagatgttcaacgtgtacctgcgcagcacccgtcagcgcgtgattccggtgcaggacttcggcaaaaccgtcggcgtgattaccttgctcaacaacctgtcccaacccttggcaggcttgttggtggccgtatgggcggcgccgctgggcacgcagacggtgatcctgctgctggtgggactcaccgcgctgcttggagtggcggtggcctcaggctggcacgccactgtgaaagcggaactcgatatcgggtgattcgatcagttcctgctcggtcgccctcacccgctcgatcacttgggcgatgtctttggcgtcgccgtactggtaggccagtttcaagtaaccctgaaagtgccgggcctcgcttttgagcaaaccgaaatagaacttgccgagttcttcgtccaaatgtggcaccagtgcttcgaaacgctcacaactgcgcgcttcgataaaggccccgaccaccagggtatccaccagcttgaccggctcgtggctgcgcaccactttgcgcaaacccgacgcataccggccggcgtgcagttggcgcagttcgactttgcgcttcttgatcaggcgcatgacttgctcgtggtgcaccagctcttcgcgggccaggcgcgacatcatgttgatcaggtcaacgtgggcgtggtacttggcgatcaggctgagggcggtgctggcggctttgaattcgcagttcttgtggtcgatcagcagggtttcctgatcggccaaagcagcctggacccaggcgtcgggggtgcggcagccgaggaattcgtggatttcgggcaggttcatcgggctcacgggcaaaaggattacaaaagggcgccgattataccgaccccgccgcagaccaccagccactggcgttgatgtgcatcaacatgacgtctggcgagcagcaactatagttgtccagagcgccttttccccgtctctggagatccgtccatgcaagctatccgcagcatcctggtggtcatcgagcccgagcactcggaaagcctggccctcaagcgtgccaagctgatcgccggggtcaccggcgcgcacctgcacttgctggtctgcgacaagaagcatgagcactcggcgctgctgagcctgctcaagtccggcctgcaggaagacggctacagcgtgaccaccgagcaggcgtggaatgacagcctgcatgaaaccattatcgacgtgcagcaggccgagggctgcgggctggtgatcaagcagcacttcgccgacagcccgctgaaaaaggctttgctgactcccgccgactggaaactgctgcgctactgcccgactccggtgctgctggtgaaaacggccacgccgtgggccgacaaggtggtgctggcggcgattgacgtgggcaacaacgacactgaacaccaggcactgcacaacaccatcattgaccacgggtttgaaatagccagcctggccaaggcgcaattgcacgtgatcagcgcgcatccatcgcccatgctgtcggcagccgacccgacgttccagctcaaggaaaccatcgaggcgcgctatcgcgagcagtgcaaggcgttccaggccgagttcgacgtggatgacgcgcgcctgcatattgaagaaggcccggccgatgtgttgatcccgcatgcggcgcataaatggcaggcggcggtgacgattatcggcacggtggcgcgcacgggtatttcgggggcgttgatcggcaatacggcggaagtggtactggatgaggtggagagtgatgtgctggtgctcaagccgcaggagttgatggatcacttggaagagctggccacaaagccctgacgccgccccttcagcccctctagatcaactgtgggagctggcttgcctgcgatagctgtctgtcagttgatgcaacttttgactgatctatcgctatcgcaggcaagccagctcccacattgaccggtacagtcagtgccccagtgcgtctttcaaaaaacctggggagatatagcgctgataatgcgcctcggacaggataaaaaactcgcggtcaatggcatcgcgcagttccggcaatgcccaatcgcgaaactccggcatcagcaccatgccataagcctccagattggaaatcacccgcgccccccgggcaatcaactggtaggcccagcagtattcggactggtgcggcacaaagcgaattttgcgttgctccaactgcccgcgcagcatcttggggtcgaaaacctccactttgccggccatcacctgcaccaacagttgctcaagccgcagccagaccgcgcgtttttcttcctcgttatagccattccactggatcacttcgtggtggaaacgcttgcagccacggcacaccagatcgccgtaaaccgtggagcacaggccgacgcagggggtcttgatggtttggttggacatgggcagcgacacacaaatcagcgaaacagtgcgccatgttagccctttgtctaaggttgatcacccagcaaacttggttaggcaacttacctttagattttttttgccgtagaatcatccggccttgtaaggcgccaataatccgctggaagctgttttcaaagcgtcacgagcacagtcgttccttcagaacggtgttggcgatggttattacccggtaggtaacagccagcgccaaccctcatcagctccgttctgcaggcgtaaaactttgaaagcagcttctgtgaggaatgccggcagcgctggctttgcggcccaaaaagcccccgagcgcatgcgtgccgttcatttctggatgagcgtcccgtgggaccactgatgagggtaataactgtgcttgaagcctaccgcaaacatatcgaagagcgtgcagcactgggtatcgttccccagccgcttaacgccgaacaaaccgcaggcctggttgagctgctgaaaaatcccccggctggcgaagaagaattcctcgttgacctgatcaccaaccgcattccaccaggcgttgacgaagctgcctacgtcaaggccggtttcctgtctgccctggccaagggcgaagccacttcccccctgatcgacaagaaacgcgctgttgaactgctcggcaccatgcaaggcggctacaacatcgtgaccctggtcgagctgctggacgacgccgaactggcgcccgtcgctgccgcccaactcaagcacaccctgctgatgttcgatgcgttccacgacgtcgcggaaaaagccaggaacggcaacgaacacgctaaagccgtgatccagtcctgggccgatggcgagtggttcaagaaccgcccgaccctggccgacaagatcagcctgcgcgtgttcaaggtcaccggcgaaaccaacaccgacgacctgtcccctgccccggatgcctggtcccgccctgacatcccgctgcacgccctggccatgctgaaaatggcgcgcgaaggcatcgtgccggacgagcaaggcaagaccggcccgatgaagcagatcgaagagatgcgcggccaaggcttcccgatcgcctacgtcggtgacgtggtcggcaccggttcgtcgcgtaaatcggcaaccaactcggtactgtggttcttcggcgacgacgttccttacgtgccgaacaagcgcgcaggcggcttctgcttcggcagcaagatcgctccgatcttctacaacaccatggaagatgccggcgcactgccaatcgagttcgacgttaccaacatgaacatgggcgacgtgatcgacctgtacccgcatgctggcaaagtctgcaaacacggcaccgatgaagtcctgaccaccttcgagatgaagaccccggtgctgttggacgaagttcgcgccggcggccgtatcccgctgatcatcggccgtggcctgaccgaaaaggcacgtgccgaactcggcctgccgccttcgaccctgttcaaactgccggaagctccggctgaaagcgacaagggctacaccctggcgcagaaaatggtcggtcgcgcatgcggtctgccagaaggcaaaggcgttcgccctggcacctactgcgaaccgaagatgaccaccgtgggctcccaggacaccaccggtcctatgacccgtgatgaactgaaagacctggcgtgcctgggcttctcgaccgatctggtgatgcagtcgttctgccacaccgcggcatacccaaagccgatcgacgtgaccacccaccacaccctgcctgacttcatcatgacccgtggcggtgtatcgctgcgtccaggcgacggcatcatccacagctggctgaaccgcatgctgctgccggacaccgtcggcaccggtggtgactcccacacccgtttcccgatgggcatctcgttcccggccggttccggtctggtcgcgttcgctgcagccactggcgtgatgccactggacatgccggaatcgatcctggtgcgcttcaaaggcaaaatgcagcctggcatcaccctgcgtgacctggttcatgccattccttactacgcgatccaggctggcctgctgaccgtagagaagaaaggcaagaagaacgccttctccggccgcatcctggaaatcgaaggcctgaacgacctgacgctggaacaggctttcgagctgtccgacgcctcggctgaacgttcggctgccggttgcaccatcaagctgtcgaaagattcggtcaccgaatacctgaactccaacatcaccctgctgcgctggatgatcggcgaaggctacggcgatgcacgcaccctcgaacgtcgcgcccaagcgatggaagcctgggttgccaacccggaactgatggaagccgatgccgacgcggaatacgccgaaatcatcgaaatcgacctggccgaaatcaacgagccgatcctctgcgcaccaaacgacccggacgacgcccgtctgctgtccagcgttgctggcgagaagatcgacgaagtgttcatcggttcgtgcatgaccaacatcggtcacttccgcgctgccggcaagttgctggaacaggtcaagggtcagctgccaacccgtctgtggctgtcgccgccgaccaagatggacgctcaccaactgaccgaagaaggctactacggcatctacggcaaggctggggcgcgcatggaaatgccgggctgctcgctgtgcatgggtaaccaggcacgtgtagagccgaactcgaccgttgtgtcgacttcgacccgtaacttcccgaaccgtctgggtgacggcgccaacgtctacctggcgtcggctgagctggcagctgtagcttccacgctgggtcgcctgccgaccgtcgaagagtacatgggttacgcagcgaaactggacaccatggccagtgacgtttaccgctacctgaacttcgaccagatcgccgagttccgcaaaatcgcagcaagcgccaacatcccggtgattcaagcctaaggtgtgttgatgtagctacaccgagtaaatcagcgccgcgtatcgagaagtacgcggcgtttttttatgcctggaatacagcctcgacaacaccacaaaacccctgtaggagctggcttgcctgcgatagctgtccgtcagttgatgcatcgttgacagacctgccgctatcgcaggcaagccagctcccacagttgaggctttgcacattcaggacgggtgccgcagcgccaactgcacagcaccgtcaacgctcaagccgctgagcaagacctgtggcgcaagcgcctccggcaaggcttgcagcacttccaacgcgtcatgccgcacgcgcgccagcaccaaacgcttgccctccccgcgcacctgcgcgaaaacgccgccagcgcctcgatgtgagttgatgtaaaggacgccgcgtatcgagaggtacgcggcgtttttttatgcctggaatacagcctcgacaacaccacaaaacccctgtgggagctggcttgcctgcgatagctgtccatcagttgatgcatcgttgacagacctgccgctatcgcaggcaagccagctcccacagttgatgctttgcacattcaggacgggtgccgcagtgccaactgcacagcaccgtcaacactcaagccgctgagcaagacctgtggcgaagacgccgccagcgcttcgatgtgagttgatgtaaaggacgccgcatatcgagaggtacgcggcgttttttatgcctggaatacaaacacctgtgggagctggcttgcctgcgatagctgtccatcagctgatgcatcgttgacagacctgccgctatcgcaggcaagccagctcccacagttgaggctttgcacgctcagtgctgggttctgtagcgccatcagagggtttccaggcacaaaaaaagccgattcacgcaatgcgcgaatcggccttgaggtgtgcagctcggtgtcaggacagcagcgagtagatcagcgcggtaatcgcgaccagaccgactgcggtgacaaacacgttggacgcttgcccacggtacttggccatggccggcaccttgcggatcgcgtacatcggcatcaggaacaggatcgacgcgatgatcgggccacccagggtctcgatcatgccgaggatgctcgggttcagcgtggcgacgatccagcacaccaccagcatgaacgcggcggtcatgcggtccagggacttggcagccgggcggcgaccggtcttgagcaccagacctttgaggccttcactggcgccgatgtagtggcccaggaacgacttggcaatcgccacaaacgcaatcaacggcgcggcgaaggcgatggtcgggttgtcgaagtggttggccaggtacgacaggatcgacaggttctgcgctttcgcctcggccagctgcgccggcgacagggtcagcacgcagctgaacacgaagaacagcaccatcaccaccatcagcaggtgcgcgcgcgacaggatctgcgagctgcgctcatcggcgtgcgcgccgtactgacgcttctggtccaccgcgaaggccgagatgatcggcgaatggttgaacgagaacaccatcaccggaatcgccagccacagcgtgttgagcagcgccgagggcgccggcacctcgctggcggtgctgagaatgccaccggtccagtgtgggatcaggtacacggcgaggaacagcaacgcgacgataaacgggtacaccatcaggctcatggccttgacgatcacttgctcaccgcaacgcaccacggccaacaggcccaggatcagcacaaacgccaggatcgcgcgtggcggcggcatgatgtgcagttggtgttccatgaagctgccgaccgtgttggtcagtgccacgctgtagatcagcaggatcgggaagatcgcgaagaagtacaacaaggtgatcagtgcaccggccttgaggccgaaatgttcttcgaccacgtcggtgatgtcggagccttcacgcccggacagtacgaaacgggtcaggccacggtgggcaaaaaacgtcatcggaaatgccagcaacgccaggatcaccagcggccagaagcccccgaggcccgcgttgatcggcaaaaacaaagtaccggcgccgatggcggtgccgaacaggccaagcatccaggtggtgtcctggcggctccagcttgtgagggttgcaggtgtcgttgcatagcgttcgtcgacgctattggcctgatcattcatccggtcggatctccgcatttccatggccgggacgagtcagaaaaacctgacaggcagcgccccgaccataacaagcgcgcaattgtccgggattctcttgaataagcaaagacttagctgaggaacggtggtgcggtgcaggtgcttgagtgcggccgtaggcggcggttttagcgggctgcgcacatcgaatgcatgcccaaacactctatttttgaccgctgcccaggctcgcgctgacgctgcgcgccctggcgccttcacgatcatcacgcactcaaacttaaagagaattctcacaaaagaaacagatgaaacctgcatctaaattattttttcacagcaacaacgtaataactgttacaggaatataccgagccattgagcaaccgatagacgtcaaactaacatccttcgtcgcaccacttacaaaacaataacgacggcttcactttacgcctcaggagttcgaaaatgcgaaaacatacgcttgttctttccggcctactgcttataagttcattaagcccgtttgcaagttacgccacacagcctatatccgacccttatgccctgggctcttctcctcaatggttgaccaccaaggtttatatcgagggggcgccggaacaggacgtcaaggccagctaccccggcgtggtggggatatcgatgtgggacccgcagcgcaaccgctacgagtttttttacaccgacaccgggcaatcaaaatatgccgacggcggtggcggttacttcctggtcagcggcgacaggaagacccatgttctgatacccgacaagggaccgaacagaacaattgtccgacgcctggaaaaacttgataaccgcgagttcacttactcgcgcgaagtgcctcgcgacatggtagccaccaaccctcccgttcgaatttacgtggtgcacgccccttacaatggcccgatcaaaacggccatgtcgaactagccaattattcaaagccttataactgtcactcgcccacattttaataataaccagtgagttacccacatgaatataagcacccgcatcaagtcgtggtatatccctgcactgctggcggccaccttgctgccaggcgttgccattgcacagaccactccagcccagcccgcccacaccaatgccgctacgtccgacaatgcagtcatgttgaccgttttccttaaacacgatcagtcacggccgctcagcgcgctgaaagcacaacttgcccagcaggaatttcacaaagtgttccctcctgccggcgtggaagtggtcagttggaatataaccatgggcattgggcaggtgatcgtcctgcgcctgcctgcgcggcgcctggcagaagttaatctagcgatcgaaaacaccgcctggggtgtttacacaacagagttctttcccacgtacgacttcatgcccatcgcacaggcggaacaaaacaaggcacgccaggctggcgctgtgcagtaatgatggccaggcggctggacgattgcactgtgcagccgcgctggaactgacacgggaggcaatttataggcaccggctttggctgaataatacattccctagaaaatctattttagaatcgacctggttcctgtacgttgaggctgtgcccgcctttttttctgagagccccgccatgcctcgcgtttcccgcaaacaagccgaactcaaccgtgaaatcatcgtcgaggcggccacgcacctgtttcgtgagcgcggcctgcacggcatcagcctgtcggatgtgatggccgccgccggcctgacccacggcggtttttatgggcactttgcgtccaaggaagccttggccaccgaggctagccagaaggcattcgagcaatccaaccagggctggcaggagaaaatcgagcgctgtgaagacccacactccgcccgcgaagccatcctgcgtcactatttttcagccaagcaccgcgacaatcccggcgacggctgccccatatccgccttcaccccggacatgtgccatgagcccgccgacacgccgctgcaccacacctttatcgctggggttgaacagtcactggagatcttcgcccagcttcaggatgacgaccgccaggccatgctggccaagtacgcgatgatgatcggcgccgtcacgctggcgcgtgcgacacgcggcagcaacttgtcagacgaattcctggaagccgcgcgaaacacgctgctccccgcgacgaaatcggatgcaagcgttgacagccgcgcgcccagcccagcatgatcggggcatgaacctaattcagctgcacctcacccgcaccaccaccacgaccgccaatggcgggtcgtgcggttgctgtgggtgcttgaactaaacacacacggattcaacccaaggccccgccagcaatggacggggccttttttatggtcccgccacctggccactgcaaggagcaagaccatggcaaacgccctgctgatcatcgacatgcaaaacggtttatacgatggcccggaaaaaccctttgaacgcgaacgcgtgctggagaccatcaaccaactgattcagcgcgcccgcgcagtcaacgcgccgatcttcgtcgcccgccacacgggtccggctggctcgccgattgaagccggcagcccgctctggcagctgtggcccggcctggaagtcgacgcagcccgtgactacctgttcaataaaacccgccccagctgctttttcggcactgacctcgcccagcaactggcggcggcgcaggtcgatgaactggtgattgtggggatgaaaacccagttctgcatcgacactacttgccgcgtcgccgcggaactggggttttcggtgatcttgccggaggacggccatacctgcatggacaccccggcgttgtcggccgcggcgatcatcgagcatcacaatgcgaccctggcgggggcgtttgtgaagcgggtcaaggcgcaaagtattgagttctagcgtgacctgtgcgggatttttatgactgaacaaaacgttccgtcgtacaaatcccgcatactcagccttcaaacccttcaggaagagccttccgatgtccaccactgttctggtcctggttgaaaccatcaacgaatacctgcaaatcatcgagagcaatgactttcatgtgattctggccccgacaccggccgaacgcgcccaggcgatcaaagcccacggtgggcagatcaaggccgtgctgacccgtggcccgctggggctgtatgccgaggaaatcgccgcgctgccgttgctggagatcatctgcgtgatcggcgcaggctatgaacatgtggacctgcaggcggccgccaaccgtggcatcgtcgtcaccaacggcgccggggtgaatgcgccgtccgtggccgaccacgccatggcgttgctgctgtcgttggtacgcggcattccccagactgacgcggccgtgcgccgcagcgaatggccgaaggtgatgcgcccttccctgggcggcaagcaactgggcatcctcgggctcggcgcggtgggcatggagatcgccaagcgcgccgccctcggcttcggcatggaggtgagctatcacaaccgccagccccgcgatgatgtggattacacctattgcgcaacggcggtggaactggcgcgcaattcggacttcctgatcctggctacgcctggcggcgcgagcacccgccacctgatcgatcgccacgccctggatgcgctgggcccgaacggctacctggtgaacatcggccgtggcagcgtggtggtcgccgccgacctggtggccgcgctggaacaacggcgcattggcggcgcagcgctggatgtgttcgacgatgagcccaaagtgccggacgccctcaagcgcctgagcaataccgtgctcacctctcacgtggctggcttgtcgccggaagctgcccacgacaccgtgcagcgcgtggctgacaacctggttgaatactttgccggccgccccgtgctgaccccggtgaacctgccgccgcgcaactagtagcgaatagccagcgccgacctgaaacctgactacactgcttggcggggatgctcaggacgccggtgcatgactggcgaaggaacgcagaatgtttggccatggacgcggcccggcccgccaacgcggggccatcggcttgatgggcgcggtgacccttggggtcgcactgttatttctgttgttggtggtcgacagcggtcggctgtacctggaaaagcgcaagttgcagcgtgtggccgacaccgccgcgctggaagcggtgagccgcagcggcaagtgcgtggcgcccaacaacaatgccgcacaatttgcgaccgaaagtgcggcgcgcaacaactttaaggtcgacgccaatcgcacgctggccattgcctgcggcaccctggccaccggcgccgactttatgcgcaccttcagccctgacgccgccaaagccgacgccatccgggtgatcgccacccaccgggtgcacaccagtatcgcccacggcctgcttacgctgttctcggcccagcccgtcaacctgaccacactcctcagcgccaccgccgtggcctcgacacccgccccgacggtggcgtcactcaccattcgcagcacgttgttgaccgtggacagcacccagtctaaagccctcaacgcgctgatcgggggtttgctcggcggcaagttgcaactcgacgcggtcggttggaacggcttgatcaataccgatatcagcctgctcaaatacctggatgccttggccatccagctgaatgtcagcgcgggcaactacgaccagttgctcaagaccgacgccaccgttggccagctgatccaggccgccattgacgtgctcaagctcggcggcgacgcggtcaagttggtgatcaacaacctcgaagccatcaagttgatcgcccccggtacgcagatcctgcacctgggcgacttgatcaatatccagaacggcacggacaagagtgcgctggatgtcgacctgcaactgttcaacctgatccagggctttgtgcagctgtcgaacaaggccagcgcgctggcggtcgagctgccggtggatgtgctggggctgatcggtgtcaccgtcaccaccaaagtgatcgagcccgcgcagttgtccagcattggcaacccgaaggacatcgacaagcagcccatctttgtccgcaccgctcaagtgcgcacactgatttcggtaaagttgcccatcgtcacggtggtcaatagcgtgctcgggggcctggtggacaccttgaatgttgtgctcggcggcctgctcggcttactcgaccccaattgttgtttggtcaccagccttgaaatcggtgacaaactcgacatcgccctggaagccgccggcggcaacgccgaggtcaccggctacagctgcgacggcgataaaaagtctttgtcggtgctcggcgaaaccgccgcgttgcgcgcgatgattggccaggttgatccgcagaacttgttctcatccaaagaagaactcagcgtcgacgagtacccggtggtcgatatcggcaccaaaacctgcaagcgcggcaccggcgtgtgcagcgacaggcaggcctttgcagcgggcggcctgggcatccgcgtcgacagcaaagtgctgaaaaccgagcgtgcgcacacctacaccgccccgcccgcgattaatcagccacccagctattttcagttcgccgcctcgaatgtggtcagcagcctcaaagagaccctcaccggcatccaactgatcaaccacccacccaaaatggccagcctgctcggcgctgtgctgggcctggttaccggcctgctcaacggcttgctttcaaccctgggcgggttgatcgccggggtgctgggcccgctgcttgaccccatcgtcaacaacctgctcgccggccttggcattgacctggcaaaagtcgaaatcggtgccaacctgtcctgcaaccccggtggccgggccatgctggtgatttgagcacatcatgcccgctgatcatcggccaacacgctaacctattaagccgccccgaccttgtcgctgggcggcggtgcgcattagattagccaatagtccaaggcctttagaataagcagaagggataagcatggcgcttaacgaccaatccacccagattcgcccaggcgaagaacttgatgccggcctcatcgatccctacctcaaggcccatattccgggcctgagcggcacggtcaagatcagccagttccccggtggcgcgtccaacctgacttacctgctggaataccccggccaggagttcgtactgcgccgcccgccgttcggccacaaagccaagtccgcccatgacatgggccgtgagtaccgcattctcaaccagctcaaagatggttttccgtattgccccaaggcttacgtgcattgcaccgacgagtcggtgatcggcgccgagttctatgtgatggagcgggtcaacggcatcatcctgcgttccgacctgccacccgagctgggcctggacgcggccaagaccgaggcgctgtgcaaaagctttatcgacaagttcgtcgagctgcaccaggtggattacgccgcgtgcggcctggccgacctgggcaaacccgaaggctatgtagagcgccagattcgtggctggagcgaccgctacgaaaaagccctgacgcccgacgctcccagctgggaggctgtgcgcgcctggctcaatgacaagatgccggccgaccacccgacctccagcatcgtgcacaacgactaccgcttcgacaacgtgattctcgacccccacaacccgatgcagatcatcggcgtgctggactgggaactgaccaccctgggcgacccgctgatggatttgggcaacaccctcgcctactggatcgaagccgccgacccggcgccggtgcaactgatgcgccgccagccgagcaatgcccccggcatgctcacgcgccgccagttcgtcgattactacgccgaacgctcgggcatccagatcgacaatttcgatttctactacacctacggcctgttccgcctggccggcatcgtgcagcagatctactaccgcttcttccatggccagacccaggacaaacgctttgcgcagttcatccagatgaacaagctgctggagcagatgagcctgaacgtgatcggcaaatccaccctttaaggagttgttatgtccaagacccacctgttcgacctcgacggcaaaattgcttttgtctccggcgccagccgcggtatcggtgaagccattgccaagttgctggcccagcaaggcgcgcacgtgatcgtgtcgagccgcaagctcgaaggctgccagcacgtcgctgacgcaatcatcgccgacggcggcaaagccacggcggtggcctgccacattggtgagatggagcagatcacccaggtgttcgccggcatccgtgaacagttcgggcgcctggatatcctggtcaacaatgccgcgaccaacccgcaattctgcaacgtgctggacaccgacctcggcgccttccagaagaccgtcgacgtgaatattcgcggctacttcttcatgtcggtggaagccggcaagttgatgcgcgataacggcggcggcagcattatcaacgtggcgtcgatcaacggcatttcccccggtgtgttccagggcatctactcggtgaccaaagccgccgtgatcaacatgaccaaggtgttcgccaaggaatgcgcggcgttcggcattcgttgcaatgccctgctgccggggctgaccgacaccaagttcgcctcggcgctggtgaagaacgactcgatcctgaagatggccctggcgcagatcccgctcaagcgcgtggccgacccgagcgaaatggccggcgcggtgctgttcctggccagcgacgcttccagctacaccaccggcgtgtcgctgaatgtcgacggcggcttcctgtcctgatcacgcatttggcggttgctggcgaaagctcaccgccaggcggttccagccactgatgctggacaccgccatggtcaggtcgaccaactcctgctcgctgaactccacgcgtgtcgccgcgtagagttcatccgagacgctggacgtcggcagccttgccaccgactcgctccaggccaatgcggccctctcccgcgcggtaaaaaacggcgaatcacgccacacacacagggcaaacaagcgtcgttcggtctcgccgcgctggcgcgccgccattgaatgcatgtcggtgcaaaacccgcagtggttaagctgcgagacgcggatcttgatcaattccaacagcggtttttcgatggacaggtcaaaggtcgccgcctccagcatcaacatgcctttcagcgcttgcggtgaggcggtgtagtaatccagacggggttccatgggcggctctcgggcggggcaagtcatcctgcgcaagcgtagagcccgcagcccataagccctatagccaatccggcgatttatgtgcagaccattttgagcccgccgcgccagcgagtagtctgggtgcagagcgaatgccttgggatgaaacatggaactgcacgtggtgatcaacggccgcaaggacctggccgaacagttgtaccgccagttgcgcgaggcgattgcgtccgggcgcctggcggcgggtgcgcaactgccgcccagccgcttgttggccgaacagatcggcgtatcgcgcaaaaccgtgtccgacacttacgccaccctgacctacgaaggcctgctggtgggcaagaccggccgtggcactttcgtcaatgcgcatgcgctgcagaccgagcgcatccaaaccgccgccgacctggcctgcgccgccaacctgagcaaatgggcggcgctgccctcgcccatgcgccaccccacgcgtgacagcacattgcgttatgaatttatcggcggcgccaccacgcgcaatcaattcccccaggatgaatggcggcgctgcacccaggatgcgttgcgccgcattgcccgcgacagcggcttctacagccagcccgaaggcctgccggcgctgcgagaggccatcgccgggcacatcgcgttttcccgcggggtgaaatgccgcgccgatgacatcgtagtcaccaatggcgcgcaacaggcgctggacctgatcgcccgcgtggtgctggaaccgggtatcaccgtggccatggaagaccccggctacagcccggcgcgccagttgttcatggccatgggcgctcacgttgccggggtgccggtcgacgcccagggcattcaggtcgaccagatcccggagggcacgcggctgatctacgtcacgccgtcgcaccagttcccgctcggtatgcccatgagcctggcgcgccgcgaagccttactggcacgtgcgttcgagctgggggcaatcattatcgaggacgactacgacagcgaattccgctacgaaggccgccccaccgactcgctgcaaagcatggacagccgtggcctggtcacctatgtcgggaccttctcgaaaaccctgctgccggagttgcgcctgggctacgcggtgctgccaccggcgatttacccggcggtgatcaaggccaagcaactgaccgaccagcacagttccacgctgccgcaatgggcactggccaagttcatcagcgaaggctacctgctcaagcatattcgccgctgccatacggtgtacgccgggcgccgcgagcgcatcctgcaacgcctggcgggtgatctgtcgccgtggttcgacgccgtgcccaccgaagcggggtttcatatggccgcactgtgcaaggtgccggtgaacatcccgttgctgatggagttggcgcggcgggttgaagtggggttgtacccggtggacgtgttcttccatgacacgcccgtgcggcacggcttgatcatcggcttcggcgccatcgagctgctggacatcgacccggccctggaccgggtgcgcgacattctccagcagattggctagcgggttttccgcaggattggtcattggtccagggctgcctgcggcgtagggtgaagaggtctcgaacttctcggaaacctcatcatgaaacgattgctcgctgccaccctgatgctcgcctcgctcagcgccttcgcccacgagccggtgtacaaccaggaatcgatcaaggtgctgcaagagcacgccctgaccaacgtgcccggcaagaaaaccatcatgctcaccgtcgattacgcgccgggccaggccaccgtgccgcacagccataccggcacggccgtggcgtatgtgctggagggcgaaattacctcgcgggtcaatgatgaaaaagcgatcacctacaaggttggtgaatcgttttatgaaccggccggttcgcggcactttgagtcgagcaatgccagccagaccaagccggccaagctgctggtggtgatggtgctggatgacaaggctgaggtgctgacgccgcttaaacaataattcgccacgctgctgaacaaatgtgggagcgggcttgctcgcgaatacggtatgtcagtcaccgaatgcatcgactgaaataccgtattcgcgagcaagcccgctcccacattttgatctcggtgtgcttggggttcaggggcgtttgaactggcgacgcaggtgctcgatctgcgctcggcaagcgcagccctccaggtgatcattgaccatgcccatcgcctgcatcaacgcatacatcgtggtcgggccgacgaaggtccagccgcgttttttcaaggctttggataaacgcagcgacgccggcgacgttgggttgccggtccagtaagcccagtccaccaccgccgggcgctcctcctcggctggctcaaacgcccatagccaacgcgccagcgagccggtttcgtccaccagctcacaggccctgcgggcattgttgatcgtcgacacaatcttcgcccggtttcgcacaatgccggggtcattcatcaggcgctcaatgtcggcctcgccgtactgcgccacgcggcgaaaatcaaagccttcgaacgccgcccgaaactgctcgcgcttgcgcaggatggtgatccacgccatgcctgcctgaaaaccctccaggcaaatcttctcgtacagctggatatcgtcggctaccggcacgccccactcgtggtcgtggtaacgcgggtactccgccgccgctgtgcgccaggtgcagtgggtcagccctgtttcgtccgtggtcagccctggtttgtccatccgtcacctcacgtatccaggcgcggatgataagcgaatttttttccagcccgccaaccgctcaagcatcacgcttgccgaccaactggtcagaccgggacctgtcaaccgtcgaatatttacttgtggtttcaaaaaaacccggcgtagactggccgggcactggacttaccggtatgaccacaacaattaagccctggaaccaccagggcaccgaatagagatccctcccatgctcagatggtgctcgcgttcgattttcctgcaagtcgtgattggcctgatgctcggcatcatctgcggcctggcccttcccgaattctcctcgcaactcaaacccctgggtgacggcttcatcaagctgatcaaaatgctgattggcctgatcgtgttctgcgtggtggtcagcggtatttccggcgccggcgacttgaagaaagtcgggcgtatcggcctcaagtcagtgatctactttgaagtgctgaccaccgtcgccctggtgatcggcctgatcatggcgttcagcaccggcatcggcaccggggccaatatccacctggagcagttgtcctcggccggcctcaatgagttggccgacaagggccagcacattcgcggcaccagccagttcctgatggacctgatccccaactcggtgatcggcgccttcgccgacaataacgtgctacaagtgctgctgttctcggtgctgttcggcagcgcgctgaacctggtgggcgaagccgcttcgggcatctcgcggttgatcaacgagctgagccacgtgatcttccgcatcatgggcatgatcgtgcgcctggcgcccatcggcgtgttcggcgccatcgccttcaccaccagcacctacggcctggattcgctgcaacacctgggcagcctggtgggtttgttctacctgacctgctttgcctttgtcgggctggtgctcggcctggtgatgcgcctgtccggcctgcgcatgctgccgctgctcaagtacctgcgcgaagagctgttgatcgtgatgggcaccgcttcgtccgacgcggtgctgccgcagatcatgcgtaaactcgagcacttgggcatcggcagttcgacggttggcctggtgattccgacgggctactcgttcaacctcgacggtttctcgatctacctgaccctggccatcgtgtttatcgccaacgccaccggcacgccgctgtcgatgaccgacttgctgacgattctgctggtgtcgctgataacctccaagggcgcccatgggattccaggctcggcgctggtgattctggcggcgacactcaccgccatcccggcgattccggtggtgggcctggtgctggtattggccgtggactggttcatgggcattggccgcgcattgaccaacctgatcggcaactgtgtggccaccgtggccattgcccgctgggaaaaagacatcgacatccagcgcgccaacaaggtgctcgacggccagcaaggctatgcgttccaggccaagaagccggtgctgccggcgcatcaggagttctgacccattctatgagcgacacaaatcaactgtgggagcgggcttgctcgcgaatgcggtgtgtcagtcaaccggtgcatcagctgaaagaccgccttcgcgagcaagcccgctcccacattttgagcgtcgccagcgtggcgatcgtatttgcaacatcaaggagccatcgacgtgataagcacctcaaccgtcgtcaattcagtcgtagaaaaactgcgcgccgccctcgcgcgtggccagtggcggcgtggcgaaatgctgcccggccagcgtgaactggccgaacagatgggcatcagccgccccagcctgcgcgaagcggtgatcgtgctggaaaccctcggcctggtgcgctcgatgcccggcaaaggcgttgtcgtgctggaaaccagcgtcagcgaaccccaggccagcgatgccgtggccgatgccagcctcgaagatatcctgcaactgcgctacaccctcgagccgtttatcgtcggcctggtcgcccaatccatcagcagcaaggaagtcggccaattgcgcctcaccttgatggacatgcgcgaagcccttgatgccggcgatgccgaagcgggcatgaacgcctacatcggcttccatgaagaactgtttgcgctgacctccaacccgatcttccagaacgtggtgcaacagaccagcaatgcgctcaagcaaagcgcccaggtgctgcgcaactcgcccgaacacctggccgaacgtctgcaggaaaacgaagccgtggtgcgcgccatccgcaacaaaaacagcgccctggccagcgccgaaatgcgtcggcacatcctccaggaaggcctgcgcatgggcattcgcttgaacatcccggacgaccatctgggcagctgattttttggagaccggccatgaccgcccacgccctgcaacgcaattccatcctccctgccctgcgcctggtgtccggtaaaaagccttcggtggatgacatctacccgcgcttgttcgacgccatcctcgaacaacgcatcgcgccctccagccgttttaccgaagaaggcctgggcgaaacgtttggggtgagccgcagcgtaattcgccgggtattggccaagctgtcgcaccagcaagtcatcatcctgcgccccaaccagcgcgcccaagtggcggcgccggatgcccagcaaacacagcagatcctggaagcgcgacggctcacggaaatcaccgtggtgcagctcgcctgtgcccaggccacgcccgcgcagatccgccagttgcgcgaattgatcgctaaagaacgtgagtgcatcgagcgcgaccagcgcggcccggcgattcggctgtccggcgaatttcacctgcaattggccgcgatggcacgtaacgcgcccttggcgcagttcctcaacagcctcgtgccgttgacctcgttgatcattgcccaatacgaggcgcaagcctgcacgtattgcgcgtggcaggaacatgtagcgattgtggatgcggtggagcaacgcgacgtgaagcacgcggtcggtttgatgacccagcacctggatcatctggaagcgaaattgttgaagctcaactgacggtcaccgccgcgtcggtgttttgtgccatcaggtgtcttctcgcttgatccacttgggcacgttgggcgcctgatagctcagcaccgcggccagcaaacgctccacattcggttcaacgataagcatgtcgcggtgcaccggtttcaaaaacgcttcgctgacaacggtgtcgaggaacgtggccaagccgtcgtagaaaccgttgatgttcaacaaagcgcaaggtttggcgtgctgcccaagctgcgcccaggtccacacctcaaacaactcttcaaacgtgccgatgccgccgggcaacgcgataaagccatcagacagatccgccatcaaagccttgcgctcgtgcatggagctgacgatgcgcaagtcttgaaggccggtgtgagccagttctttctcggccaggaactcaggcatgacgccaatcacttcaccgccgctggccaacgcagcgtcagccactgcgcccatcaaaccgaccgaagcgccaccgtagaccacaccgatgcccgccttggccagcgcagcgcccagttgagcggccatttcggcatacaccggcaaccggcccgggcttgagcccgagaaaatacaaagtcgcatacaccctcgcttgatctgattgtgtggagcacagccgtcatttaaccatgccaggccccacactggatcgttcccacgttccacgtgggaatgcagcccgtgacgctttgcgtcacaagcgtcggcgcgggctggcggggcgcggagcgccccatgaggcattcccacgcagagcgtgggaacgatcgacatgtggccaagggtgtttggtaaatcgtggcgaaacaaaaagcccccgcatctcacgatacgggggcttttgttttaccgcaggatcaagccggctgcagcaccgactgaccgctcaacgccaggtccagcaactcacggttggcgaccgcgtacatggcgtagtccgtgccgacggcggcacgaatttcgaccatcattgcgcgccagcgatcggccatgtcctggtgctgctcaagccacagggccacgcgggcttccatgtcttgtggcgcgtcggccatttgcagaaccgagatggtgatcgcccgttgctgccagtccacgtcgtcgcggaacgcttcgcgggccgcggcctgccagttgttggccaccggcagatcgctgatctgctgcaagtaccatggcaagtccagggcgctgccgacggcgaagtaggccttggccacttcggcggcgtcatgcccggtcacgtcggcggcttcgatgataggcagcaaggtgtacaggtgagtggtgcctgcaaccatgcgtgccaacaactccggtacgccggcttcggtgtaggcctggtagcggttctgccagccttcacgggtcgggccttccagcagttcgtcgagcttgaggcccaacgccgccaggtgcggaccgaagtgcgcggtgtcacggccagcgtcctgctcgttgcgacggctgcgcaggaaccagcgcgtggcacggcggcccaggcgcatcagctcatccatcagctccagttgcacgtcggcggagacctggtggtccagggcttcgatctgacggaaccagtgcgggaggtggaagatgtcacgcacgatcacgtaagcaccggccacgttcgccgggctcatgccggtcgactctttgagccgctgcacgaaggtgatgcccatgtggttgaccaggtcgttggcgatctgggtgctgacgatttcgcgcttgaggcggtggcgacgcatggcttcgccgaacttggcgaccaggctcggggggaacgcggtctccatgtcacgggtcaggtagtcgtcatccggcaccagcgacttgagcagggcttccttgagatcgatcttgctgtacgagatcaacaccgacagctccggacgggtcaggcccttgccggcggaggcgcgctcgctgagctgctcctcggtcggcaggtactcgatggcgcggtccagcttgccacggccttccaggtcgctcatcaggcgtttgtactcggctgcacgctcgtaggctttgcgcgcggccagggacagggcctgggtctgcttgtagttgttgcccaacaccaggttgccgacttcgtcggtcatgctcgccagcaactggttgcgctgcttgtcggtcatgtcaccggcctgcaccacttcgttgagcaggatcttgatgttcacttcgtggtcggagcagtccacaccaccggcgttgtcgatgaagtcggtgttggaaccgccgccattgaggccgaattccacacgacccagttgggtcatgccgaggttaccgccctcgcccactaccttgcagcgcagctcgttgccgttgacgcgcaatgcgtcgttggccttgtcgcccacgtcggcatggctttcggtgctggccttgacgtacgtaccgataccgccgttccacaacaggtccaccggcgccttgagcaaggcgttcagcagttcggtcggggtcagcttgtcggcctggatgtcgaagcgctctttcatctgtggcgagatggcaatgctcttcgcgctgcgcgagaagataccgccgccttcggacatgatgctggtgtcgtagtcggtccaggccgaacgcggcaagtcgaacaggcgctgacgctcaacaaagctggtcgccgggttcgggtttggatcgatgaagatgtgcaggtggttgaaggccgcgaccagttgcagcttgtcggacatcagcaagccgttaccgaacacgtcaccggccatatcgccgacgcccactacagtgatgctgtcttcctgcacgttgatgccgcgctcacggaagtgacgctgcacaccgacccacgcgcccttggcggtgatgcccatcttcttgtggtcgtaaccggcggaaccaccggaggcgaacgcgtcgcccagccagaagccgtagtcgatggcgataccgttggcgatgtcggagaaggtcgcagtgcccttgtccgccgcgaccaccaggtacgggtcatcgtcgtcatggcgcacgacgttggccggtggcaccagggcgccgtccttgaggttgtcggtgatgtccaacaggccggaaatgaagatgcggtagcaggcgatgccctcggccgcgatctcgtcccggctgccgcccaatggcaggcgacgcggcaggaagccgcccttcgcacccacgggcacgatgaccgagttcttcacttgctgggcttttaccaggcccaacacttcggtacggaagtcttcttcacggtcggaccagcgcaggccaccacgggcaacgttgccgaagcgcaggtgcacgccttcaacgcgcggcgagtagacgaagatttcgaacttcggcaccggtttcggcagttcaggaatcgcacgcgggtcgaacttgaagctgaagtaggacttgttctggccgttggcgtcggtctggtagaagttggtccgaagcgtggccttgatcaggtccaggtagcgacgcaggatgcggtcttcgttgagcacctgaacgtcgtccagggcggtgaggatcgcttgttccaggcgttgctgcttgtcttccaggtcatcggcggtgagcttgcgcgccaggtagaagcgcgtcttgaacaaccgggtcaactcgcgggcgatgtcggtgtggttgttcagggtgctggcgatgtagccgaggtcgaagcccaggcgaatctgcttgaggtaacgcgcataggcacgcagcagtgccacgtcgcgccacggcaggccggcagtcaggaccagacggttgaacgcatcgttttcggcatcgccgtgcacgatgtgcacgaacgcatcctgcagggtgtcgttgagctgctggatatccaggttcacgccttcggcggcgatgaaggcgaaatcatgaatccagaactcgcggccattggcatggcgcaggcggtacgggaattcacccagcacgcgcaggccgaggttttccaggatcggcagcacgtcggacaatgccagcggcgtatcagcgtggtagagcttgcaatgcagctcgcgctggccggaaacctggcccagcggctgatagaagctcatcaccagcgggttggcttcggtcaggctgttgaggtgctgcatgtcgaccacggccgaatgcgcggcaaaacgctcgcggtagccggccgggaagcctttcgggaagtccgccagcacgttggtgccctgggcttcgccgaagctctcgaccaccaggctcgagtagtcgtcctgccagctgcggcaggcctgcaccacttctttttccagttgcagcgggtcgatgtccaggcggttcttcgggtcaacccgcagaatcagctgcacacgggccagcacggactcggagaagaacgtccagaattcgcagtccgaggctttcaggcgatccatcagcacttgctggatcttctggcgcacttcggtggaatagatgtcgcgcggcacgtaggccaggcagtagcagaaacgaccgtacgggtctttgcgcaggaacacgcggatcttgttgcgttcctggatctgcacgatcgacatcacggtgctgaacagctcgtcgaccggggtctggaacaggtcatcacgcggcagaacttccaccacttgagccagctctttgcccaggtgcgccttgggctggaagcccgatcgacgttcgatttccgccactttgcgacggatgtacgggatcacccgtacgctttcgccgtacaccgaagaggtgtagaggcccatgaagcggtgttccttgatgactttgccgtcggcactgatctcgcggatcgacacgtagtccgggtacgccgggcggtgcacgcggcttgggtgcgcggctttggcgaacgacagcacggtcggttcacgcaggtaggccacggcgtagtcttcgatgcgcagttcttcagcggtgaggccggcacgcagcagcttggtcagaccgaggaaggagctggcgtcatattcgatatgaccgccgtccttgtcgtcacgtaccacgaattcttcatagccgaggaaggtgaagtggttgcccaccagccattccaggaagtttttgatctcggctttttcttcgccgtcgatgctgaactggctggcgtcgataccggccagcaggtcctggaccttggccttcatcggttcgaaatcggccacggccacgcgcacttcacccagtacttgctcaagctctttgctcagcacgttgagttcggcggcattggcgcagcggtcgatttccaggtacatcagcgattcttgctggatgccttcgccctgggtgccttttggcaggatttccagcagttcgcccttcttgccacggcgcacgctgagcacggtggtttgcagggtgtggatgctgtagccacggcggttcagctcggtgcgtaccgagtccaccaggaagggcaagtcatggtgcagcacttcgaccgcggtgtgggtcgactgccagccatgacgttcgtaatcggggttgtagacccgcacttgcggttgggtgtgatcaaagcgctcaagcaggcgccaggcagacaaggtgcaaccggccaggtcggaaaggcgacgttgggtcagttcgtccagggaaataatgccgaaaaattgctcagcgaacagcgccacttgtggcagtgcctgttcactgatgtgctgcgccagtgccgcttgcagttgatgctggaagtcggccttgctggctgcggtgaagaacgccatctgtggtactccgcttgggcttgttattgatggaagcgtcgcgtgttatccccttgcggggagaccgtcagcgctggtcgtcggtgctgataacaaacaccttaaacgaatcagggtgacaggtgggtgaagctggacaagacaatgaggtcacatacaacttccataagaggtgcgccatgcagggtgacggtacgacgggcaggtcagactcccggcacagggcacatccgttgcgcagcttaacgagtgtaggaagacagctgcttgcgacgctgcgacatattcggtcatcggtacgcaggcttgcggttgcgacttgcgcaacccggatttttctgcagaaaaaccggctattttcaagcccgcgagtaccgaaaatgactggtatggcccgccaggtcatgcactgggtctgacatacgatgcagcacaaaattcgccgcagtggcacaattgcctggctgcgccctccccaaagacaggatttcccatgctgcaactgaacaccgacgcactgatggccaccccgtgcgacgacgaagaagacaacatggccatgctctgctgccacggtaaaaacggcgagatgttcatgctgtcccgttacccggatgaagatgaagtggagctcacctgggattacgagccctcgaccctggatggcctgaaggtcaccctgagcgacaccacgttgcgaatcgagctggcggcgggcgatgcggatgcgctggggggcaaggatcagttgctgatcaaccacagcaccgccgcgtcggatttggctgaagttgaagagacgttgcagaatattctcaagggcaccggcacctatacccgtagctgagccgcagcagagatcaaaggtgggagctggcttgcctgcgatggcatctaccgagttcatctgaaggaccgtgtcgtctgcatcgcaggcaagccagctcccacatagatcaggcaagcctcagcgcaatctgatcgttcccacgctccagcgtgggaacgcatcctgtgacgctctgcgtcacccgtgcgcaggattgaagccttgcatgcgctgcctggacgcggagcgtccggggcggcgttcccacgcagagcgtgggaacgatcaaaaggtgggagctggcttgcctgcgatggcatctaccgagttcacctgaaggactgtgtcgtctgcatcgcaggcaagccagctcccacatcgatcaggcaagcctcagcgcaatctgatcgttcccacgctccggcgtgggaacacatcctgtgacgctctgcgtcacccgtgcgcaagaattgagccttgcatgcgctgcctggacgcggagcgtccgggcggcgttcccacgcagagcgtgggaacgctcaaagttcacctgaaggactgtgtcgtctgcatcgccggcaagccagctcccacatggatcaggcgagcctcagcgcaatttgtgcgatacacacaaaattcctacaagttttcctaaaaataccccgcgcgccgttagtctccgcccccctcgatgcattaaagtaagccccccaggccaggcgtttttttctcaacgcccggtcaatctctccaggaaccgtcatcgatggaacatcgtgaagcgctgctcgcgctgcgaacttttctttctacgcagattctcggccaggaaaaactcattgatcgcctgctgatcgcgctgttggccgacggccatatgctggtcgaaggcgcaccgggcctggccaagaccaaggccatcaaagagttggccgaaggcatcgaagcgcagttccatcgtatccagttcacccccgacctgttgcccgccgacatcaccggcaccgagatctatcgcccggaaaccggcagcttcgtgttccagcaagggccgatcttccacaacctggtgctggcggacgaaatcaaccgcgccccggccaaggtgcaatcggcgttgctcgaagccatggccgaacgccaggtcagcgtcgggcgcagcacctacgagttgtcgccgctgtttctggtgatggccacgcaaaaccccatcgagcaggaaggcacctatccgctgcctgaagcccagctcgaccgcttcctgatgcacgtcaagatcggcttcccggacgccgccgttgaacggcgcatcctgcagcaagcccgtggcgaagcactcaatggcgaaaccaaacccgaacgccgcgtcagccaacaggcaatcttcgccgcgcgcaaggaaatcctcggcctgtacatggccgacgccgtggaggaatacctggtgcaactggtgatggccacgcgcaccccggccaagttcgacccggaaatggccgagtggatcgcctacggcgccagcccgcgcggctccatcgcgctggaccgttgcgcgcgcgcccacgcctggctggccggtcgcgactttgtcagcccggaagatatccaggcggtgctgttcgacgtgctgcgccaccgcattattctgtcgtttgaagcggaagccgccggcatcgaccaggaccgcgtggtgcaacgcattctcgacgtcgttgccgtcgcttgaaacccatgaatgccagcgatggaatccgcgtcacgctcagcgaactgattgagatgcgccaccgcgtgcgcgaagtgcagctgttttccacgccgagccagcgcagcccgctgatcggcctgcaccattccaagctgcgcgggcgtggcgtcgactttgaccaggtgcgcgtgtaccaggccggcgacgacgtgcgcaccatcgactggcgcgtgaccgcgcgtactcaagagccgcacaccaagctgttccacgaagagcgcgaacggcccattttcatcatggtcgagcaaagctgccggctgtttttcggctccggccaaatgttcaaatcggtgctcgccgcccaagccgccagcctgatcggttgggccgcgctggggcataacgaccgcgtcggcgggctggtgtttggcgacagcgagcactacgaaatcaaaccccggcgcagcaaacaaagcctgctgcaactgctcaaccggctggtgcgcgtcaacgagagcctgaataccgaaagccgcccggaagccgacgccttgggcatggcactgcgccgtggccgcgaagtgctgcgaccgggcagcctggtcatcgtgatttgcgatgagcgtgcgctgaccgaaggcgccgagcaacagctgagtttgttgtcacgccattgcgacttgctgctgctgccgatctccgacccgctggaccacgccctgcccgccgccgggctgctgcgtttcgcggagcgcggcgcacagctggaactggacacgctgaatttcgacttgcgccaggcctataaagcccaggccgaagcccgcgtcgcacgctgggaactgctcgcgcaaaagttgcgcatcctgctgatgccgctgagcacccaaagcgaaatggtcgagcaactgcgcgaatacctcaacccgcaacgcccggttaaaaagcaatgagcagcctcgaccaactgcaaccgctgattgccccgccggccatcggcttctggccgcctgcgccgggttggtggctgttgctgctggtgattccgctgttgggctgggggctgtggtggttgcgccgcttcttgcccacgcgccgcccgctggcgcgcgccgaacaaccgctggacccgctgcgcatcgccgccctcgccgagctggcgttgatgcccaaaccctacgacggcgcgccggccggtgcctggctgcaacaactcaacggcctgctcaagcgcttgtgccgcaacgactacccctacagccagagccataccctcaatgggcgaaaatggctggcattcctcgacaaccgctgcccggctgccggcctcacgcgctggatggtgctggtggaaggcgcctacaaacccgaatgcaaactcgacgacaaggccatcgccggcctgacgcaagccgtcgacacctggattcgcaaacatgtttgagttcgcctggccgtggatctttgccctgttgccattgccgtggttgatgcggcttgtcttgccggtggccgacagtggcgagcccgcgttgaaagtcagctacctcgccgacctcgaaggcctggcccgccgccgtgcacgcgtcaacctgccgggctggcgccagcaagcaccgttcgtggtgctgtggttgctgctgctcaccgccgccgcgcgcccggaatggctcggcgaaccgctgccgattgccgccagtggccgcgacctgctggtggcggtggacgtgtccggctccatggatttccccgacatgcactggcaggacgacgacgtcagccgcctgagcctggtgcaacacctgctcggcgatttcctcgaaagccgtgaaggcgaccgcgtcggtctgatcctgtttggcagccaggcttacctgcaagccccgctgaccttcgaccgccgcaccgtccgcacctggctggacgaagcgcgcatcggcattgccggcaagaacaccgccatcggtgatgcgattggcctggccttgaaacgcctgcgccagcgtccggcgcaaagccgcgtgctgattctggtcaccgacggcgccaacaacgccgggcagatcgacccgttgaccgccgcgcgcctggccgctgaagaaggcgtgaaaatctacccgatcggcattggcgccgacccggagcaaaccggctcgctgggcattctcggcgtcaacccgagcctggacctcgacgaacccgcgctgaaggctatcgccgaggccactggcgggcgctacttccgtgcccgtgacggtgacgaactgcagaagatcaaggaaaccctcgaccagcttgagccggtggcgcaacagccgacccaggcccgcccggcccaggcactgtacagcgcgccattggccctggcgctggtgttgagcatgttgctggtgatccaggagcgctggcccaacaacgcgctgcaacgcgccttcaataaactctcgaccaagggcaatttcctgcaacagcaccctgaatggcgccaacgccttaaacgcctgcgtttgcggaggcggcgatgatcgacctgtggccgcactggttccgcccttggtggctgttgctgctgccgctgctcggctggctgctgtggcaactgtggcatcggcaaaagcgcgccgggcgctggcagatgattttgccgtcggcctttcatgcggtgttgctcagtggcggcaacggccgcgaaagcaaatcgccgtgggtggtgttgggcatcgcctggctgttggccgtgctggccttgctcggccccagctggcaacgggttgaacagtccagccagaaacctgccgacccggtggtggtgctgctggaattgaccccggaaatgctcgccaccgacagcccgcccaatcgcctggagcaagcgcggcgcaagctgtatgacttgctgcaggcgcgcgccgatgcgcccaccgccatcatcgtgtacgccggcagcgcccacacgctggtgccgctgtcggacgacttggccaccagccgcaacctgctcgacgccctgcgcccctcgatcatgcccgagcctggccatcgcgccgacctcgccgtggaaaaagccctgggtttgctcaagcaaggcggccttggccagggccgcctgttgctggtcggctcctcgctgtcgaaacaggaacgccaaggcattcgactgcagctgcaaggcgcccaggccccgaccttgtcgatcctcggcatcggcagccgcgaaggcacgccggtcacccaggaaagcggcgagttcctcaaggacgaacagggcgcgattctggtgccccgcctggacagcccgactctcaaggctttcgccagcgaaatgggcggccgctaccgcgccgcacgcctggacgacaaagacctgcgccaactcaacctgctcgaaggcccgcaaaacctgcgcaacgacggccaattgctgcacctcgacacctgggccgaccagggttactggctgctgctgccgctgttgctgctcgccgcctgcgccgggcgtcgtggctggttgttttgtttgccgttgctgttattgggcgcgccgcaaccgagctatgcgtttgaactgcaagacctgtggctgcgccccgaccaacaaggccaatacctgctgaagaaaaagcgccccgccgaggccgccgaacacttcgaagacccgcaatggcaaggtgtcgcgctgtatgaagcgggcaattacgccgaggcgatcaagcgttttgcccagagcaatgacgcttattcccactacaatcgcggcaatgccctggccaaatccggcgagctggaagcagcggttgatgcctacgaacaggcgctggaagcccaacccgacctgcaaccggcgctgaaaaacaaagccctggtcgaaaccctgatccaggaaaaggccgagcccgagcccgccaaaccggcaaaaaaggaagatgacgaaaccacccaacccggccaaactgcgcaaccgggcaccagtgggcaaagcgccacgggcggcgagcaatcgccccaaggccagggcgaggccagcaccggcgatagccaaaccggcggcacacccaaggccggtggcaatgatgtgccgggcagcgagctgggcgatgagcaaaccaccacgccgccgttgcgccccgccgatgccaacctcgacggcgagcaccgccaggccctggagcaatggctgcgggagatcccggacaaccccggcgaactgctgcgacgcaaattctggtacgaacagcaacaacatcaggacaagactcgatgagccgccgcaccacccttctgctcctgctggcgttaacggcaggccacgcccaggcggcgaacctggtcgccagcgttgaccgcagccgcctcaattccggggaaacggtggaactgacggtcgagtccagcgacgtcacccagttcggcaagcccgacctgtcgccactggatgcgatgttcgaagtcagcggcacgcgccagatcaaccaactgaccacactgggcggcgacaaccgcgccaccacgcgctggattatcactctgctgcccaaggaaaacggcaccgtggtgatcccgccgctgcaagtgggcgagctcaagacccagccgatcagcctgcaagtggtggaaaccgccagccagaacaccagcgccgaactggcgccggtgttcatcgaagccaaccttgaccagagcagcgtgtacgtccaggcccaagcgctgttgactgtgcgcgtgtaccactcggtgtcgctgtacgacgacagcagcctcacaccgttgcagattcccgacgcgcgcatcgagcaactgggcgagtcgcgcacctacgaaaaagtcatcaacagtattcgccatggcgtgatcgaaacccgctacgcgatctacccgcagcacagcggcgccttggtgattccggcgcagactttcagcgccacgctggtggaatcgcgcccgccgcaggagaacacgctgcagggcaccaagccgggcaagctgattcacgtcagctccgccgagctggcactgagcgtcaaacccaaacccgcgctgtacccggcggacgccccgtggatcccggcacgcagcctgaccctgagcgaagcctggaacccggagcccgagcacgtgcaagtcggcgactcgctgacccgcagccttacggtcaaggctgaaggcctgtccagcgcgcaactgccggccctgcccagcaccgacatcaatggcctgcgccgctaccccgaccagccggtgctcggcaaccagaacaacgaccgtggcctgatcggcagccgcgaagaccgcgaagccctggtgccgacccacgccggcgccgtcgagctgcctgcggtggaggtggtgtggtggaacacccacgaagaccacctcgaacgcaccagcctgccggcccgcaccctgcaagtggcgaccaacccgagcctggtggtcgacacaccggccaccccgaccgtgatcaccgcaccggacgatgaccgcctgtggctatggcaactcagcaccttgattctcgccttcaccacgctactgggtttcggcctgtggtggcgtgcgcgccggcagcccgccgtgcaacgtgccgcacaaaccggcccaagcccgcgcacgctgctcgacgacctcaagcgcgccacccaggccaacgacccacacgccacgcgtcaggccctggacgcctgggcgcggcaacagccggaaaccctggcagacatggcggcgcggtttgtgccgttgtcggacgcgctggatggtttgaacggtgcgctctatagcgagagcgggcatttctggctgggcgaggatttgtggcgtgcggtcaaggcgattccggtcgccgagcgcgagcaagacccggcgacggacaccaccagtttgccgccgctgtatcccaaataaccctcctgcagtagatcgttctcacgctccgcgtgggaatgcatccggttgacgctgcgcgtcacctttgcgcaaaaaactgagccttgagcgcgcagcctggacgcagagcgtccagggcggcattcccacgcagagcgcgggaacgatcaaagccaggcctcatcaggcgggcatcagttaaaaaatgctgtggtaattaggcgccaaacgggatgagtgtttttttgtatgatcgacgttgtccatatcgaaccgcccatcttccttgcctgggcggcctcgataaacgccaatatccaacttacgcaacaccttggggcgagccaggatttccgtcgcaacggcttgtgcctcagcagaataggtcttatcgctgggtagcagcccggcagcttgcttcaattccttgaaattcacatattcatcaccgccaccgaattcattaaagtgcttgcccacctgctcaatcagccggtagtcactccaatgtgagggcgggctttcggggcgttgagcaggtactgggttccaggagtcaccactgcggggaggcgttacaacaacgggttggattgcaccaatagacatcgcgttctcactctctaaaaaataataagaagccctgctgccagatggccagggcactcattgagtgatcaacaggtagtgctcggttccttggacagtctaagtatgtgcgacaaaacatctggcaacggatacccaccccctgcccccgctgtagcccaagtaaatctctagccacctgacagcacaaaacactttgtgggagctggcttgcctgcgatgcagacaccgcggtttttcagtcacaccgagatgcagccatcgcaggcaagccagctcccacacctgagcgccatgagtgtcaaagactgatgagtctcggtaggtaagatgcggcgtctcggtaggtaagatgcggcaccttgtagccacgacgggggaatcggtagtgatggggctacattaaaacttattccactgatcctcggcctgcttgccaaaaatcacataggcattgctattgttggtgccactagacgtgacatggcggctagagtttgcatccaaacggtggtcactgcgtagcgccctgtaaccctgctctgtgaagtccttccacatcccggccggcgtgccgcgacgagcatcgccactgcgtgtgatgccttccaggtcgccgttatccgagtacttgccacgacttttaccggttgcggtcaacgaggtgtcgatccagttgaggacacgggcggcattgaaagcggcgtccgccctggactctggatcaggattattggcagtccagtcacccaggcgctcataggccaattcacgcttaatatctttttgaaagcccaggtttttcaaaatggggttgtcattaatgatctgctcggcgctacggttatcgccctcaggccgtttgacgttctgctggggaacaaaatgctggttcctctcgctgcggtagttggacgtaccagtatcagcagcgacgctcgtgtggctgctcgcggagtaggcgcctacgctgacgttcgcagtgtagaccgtaggctgtgcaggaagggaagtcgtcatcttaggtagtactcttcgttatttatgataagaacccactgtcaaagccagtgcgaaaagtgattggtacctgagagcagttcggttccctctgcatccgacgcgcaggtatgacgaaacatgtgtgcatagttaaaggccagcaatccatatcccctaaatttgcaggatatttcctaggcaatcctttggccttaagcgctgaccggggatcaacgcgacattgccagcgccaccgaacacctgatcaaccacgccaaaacccacgccgaccgcgcactgaactgcctgcacgccgcgtaacccttgtgggagctggcttgcctgcgatgcaggcacctcggtctttctgtcacaccgaggtgatgccatcgcaggcaagccagctcccacatctgataggcattgcctgatagacatgcagtgtcaaaggccggcaatccatatccctttatttggcaggcagcgggcttgtactaccgctcgtcgcaactgtcaattctgacagtagattcaacttccttcccaagcgctttattcaccttgcccgtcgcgctagtcccgcgccccccctgacccgccaaggtaaatagctatgtctaccgtcccgcttccttatgacgaatcgctcaccatccccttccagccgttcgatacggtggatctgaccaagaccttgtatcctgaaaattcctccgagggcctggggcgtgaagccttggtacctcgttcgaggtggggtctcaacgcttgggatgatcagacccctggcgacttaaggggcctatacatgggcgttccgccccagcagctagtcttgggccctcttgatagccttgggccttttgaatacttcttcgttgaggcagacaagattcccgacggggacaacccctattatgcccgggtagtgcgtttcggtaacaaacaggaaagccgctcagttgtgaaaacgatgctgttcaaacagtccatccccggaggggaagaccagcggcctgaggagccatggcacagcggtttattcatgtggacggaaggccttgaccttattaaaggcggggttatcaacaaagaagtagccaagaacggtttcgactgcctgttccagccctatctgaacattcgccagaacgaccgcatcatcattcgatttgacaagatttgtgtggagcatgtggtaagccccgatgaggccaagagccttaagcccatcaaggttcatatcgataaagcgactatccaacaactccccaagaacggtgaagtgttgctcgacttcacggtgatagatgtagtggggaacacacctgaagggaaatacaagtactcgaagccgatcaaatttatcagcgaattaaacccagacctgttgcagtttccattgattctattgggcaagacccggcttgacccgatcgacctggacagtttgaagcaggacgacaacctctatataaaagtcacgttaaagggtgagaacaaggcgccgcagccaccgcacaaggtctatgtcacgttggtagcaacccggctgaataatgaccccatcactatcgagttgccggcggttattgatacaaacctgcacagcgaattggtcccgctcccccaagagtacgttaacaatttggccgactggagcctgcgggtctcgttcgtggtgaaaagcgatgccggggagttgctgggcacgtcgggcagcacctcagtacgcgtggtgggcgcaccaaccttgatggaggcgccgaatatcatcccctgcgaagcaggtttgtccccggccaagacagaactcgcaggcgtcattcccagctatcagccgcataacccggactacttggaaattttttatgtggaatcggccagggcggatgggagcggcctacaaatttcacagaatcaactggcgggtccgcagggtggcacacgccgattgaccgcgcaggcgctgagtgtgttcgaggggcgcggcccgctccacgcttattatgaaacgatcaacgaagaccagaccccttcagttatccgtcaatcgaagagaatgaccttcgaaataggcgagcgcatcccaacgctgccgagaatctatttagccgatgccgtcgacgacaacatcgacccgaacacgttggtgtatgacaccacatcgatgtacatccccgtggccagcacagttaacggcgaccgagcggagtggtcggttacaggcaaggacaaaaggagttcaaccagcggcgttatcaagattactaaatcgctcgaagggccgggtttacccaaactggagatccccttagatgtaaagattatcaccgacaatttaaatggcagcctcctgtgcacctacagcgtcatcaaggctgggcaaccccccaaggttttgcgctctgagccttatgaagtcaccatcggcctgccagtggtactcacctcgcttgaagtgctggaagcgaatcccaaagagcgcacccttgcgcccaaagacgtgatcaatggtgccaccgtggagatgaagtactcgacggcgcgggccactgacaggattgctttcaagtggaaggggcaatacgacgtcagcctctatgagacggtcgtgtcggccgacccgaaggccaagagcgtcaagatcaccattccggcagatgtgattgccaagggcattcgccaggacggcaataacattgaaatcacctgcaagattatgcgcggaaagttccattacgagtttgcgcccttaaaagtgcgcctgttggcactcaagtcgctgcctgcaccgcatatcagcgggcaggagaacaccaccgtgttgcccgtggacttactggatgtatcggctcgaatttttatagcgatttgggagtttatgcgtgtgggccaacacatgtggctggagtgttcgggtacctttgcggatggaacgccgtataccgagaacatttttactgccaacgaagtcaccacagacaacctgaccaagggtgtggcgctgagcttgccggtggacaaggtgcgtaacctccaggacggatcgcacttcgaaatcaagttttgggtgagcttcccgggccttcctgttctgcatacggcgacgccgttcaacacggcaagttttatcatccaacaactgccggcttcgttgccgtacccaacccttaacggggcctccagtacggcgcaagagacgaccgttgacccgctgacgattcagaacaacaccagtgtgacggtgaaatacccaggcatgctggccacggatatcatcccgctgtgctgggtcttcgaaaatggcactcagtatcaaaccacactcaaggggcaggcgagtggctcagtggtggttgatctgaccgccgctcaagtgttgcatagcagtgtgaacagcagggtgcagttaaagtattccgtcgtgcgcggtggcaaaactacgctgtctaatgttcagacgatcaccgtcggtactattgcgcaggccaacttacccagggcgctgattaatggcctggccccgggtacggcccttgtcttgaacagcatcaagggcaatgccacagcggcattggccatatggccgctgattaaagctggacaacgtgtatggttgagcctcattacggatggaggggagttgaaggtgctggagggttatcccatcaccgccatagaggccaggcagggcttatccggcctgccagtatcgcgtgattggatagcgggcgtgccgcataacaaagccgtcacggtgaaggtgtgggtggcgtttgatggcactgataacaggccggggagcgttgaatttccgacgaccactcacacggcgaacacccgggtcaacccacctgttatcacgattgggatcgtggcgtcatcgggcagaggcatttacaacggaggttccaccactgctgcggaaggccttgcaacagaaatgcacggaacttgcgatgctcgtcccttcgccagagggatgagaatcggtccctacgccgggggcggttacgggatccagattcccgcaggtaccacgacatggaaatgctggacgttgtggtattcctggaacccccaagacatttatgttgttgatagctcgccaggttccgacgtctattccgccccctttagaatatacaggggctaattgaacgggtttgtttgcccgaaaatagtgcttgggtaaaacaaccggggcagctctacttagcggtaggctgcccctttttcatccccccacgcacgctgggcgacatgcatggttaaaggccagcaatccatatccctttaatttgcaggacgtttcctagacaatcctttggccttgcgcctgctcagtccactggctagccttcgctctgtcgctgcatatcagcgatcaggggtgagatcctgtggaaaggggtgccaaggtcacaaccgcgagcaacatgctctatggcggctgtgtgcgggcagacttcggtctggccgggggactcctaccggttatctcaccccgcacatagctgccaccttttgtcgagtgagatctgcaaaagaatggctctcagtcttttaggagtctcattcatgcataaaatcgtcccagacccaccccgcttccccctcgatcgcgaaatctttgagcgcgccctgagccactatctgcaacccgactcaccgcccgcgttcaccgtgcatcacgacctcagcttcgaagacgccctcgcccaactctgctacctgttgcgctgcgctgccgccaccgccgccatttccacccaagcgctgaccggcgatcaacgcgacattgccggcgccaccgagcacctgatcatccaggccaaaaccctcgccgaccgcgcgctgaactgcctgcacgccgcataaccctctgtgggagctggcttgcctgcgatggcagcacctcggtctttctgtcacaccgaggtgctgccatcgcagcataggtatagacacaactttcaaaggccgccacatccctctgtggcgagtgggcttgccccgcgttgggctgcgcggcagccccattacaggcgcagaggtcatccagagaggactcggtcgtcaggttttggggccgcttcgcagcccaacgcggggcaagcccgctcgccacaaaagctcggctgtgacagttgatcttggccagccgcgggcaccgagtgggcttttacaggtaaactcccctccttttcatcttctccacggagttcgccttgcgtctgttccacacctccgactggcacctcggccaaaacctgcatggccaggaacgcgacttcgaacacgcctgttttcttgagtggctactgggccagttaacagcccatcagccggatgtgctgctgatcgccggcgatatcttcgacacggtcaacccgccgctcaaggcccaggagcgcctgtatgacttcatcatcagcgcccacgaacaaaaccccacactcacgattgtgatgatcgccggcaaccacgattccggttcgcgcatcgaattgcctgcgccgttgatgcgccgcctgcgcacccatgcgttgggccgcgtgctgtggctggatgacggccaactggatgccgagcgtttgctgatcccgctgcccgacgccaagggcaagatcgccgcctggtgcctggcgctgccgtttttgcgcccggcggaagtcaccggcgcgcacttgggcgacgattacctgcgtggcattggccaagtgcatgaatggctgatcgccgccgcgaatgccaaacgcaaaaaaggccaggcgctgattgccatcagccatgcgcatatggctggcggttcggtgtcggaagactccgagcgcagcctgatcatcggcaatgccgaggcgctgccggccacactgttcgacaaaagtgtcggctatgttgccctcggccacttgcacaagccgcaaaaggtcaatggcgaagaacgtattcgctatagtggctcgccgattccgctgtcgttttcggaaatcggctacaagcaccaggtgctcgacgtgacgttccagggccaatgcctggtgagtgtcgaaccgctgctgatcccccgctcggtcgacctgcaacgcctggaagccgcgccgctggcggatatcctcacgcagttgtcgcagctgcccgacgtcgacctgctcgccgaaacccaacgccacccgtggctggaagtccgcgtgcgcctcgacgaaccgcagccggacctgcgccagcaaatcgaaagcgccttgcagggcaaggccgtgcggctggtgcgcattgccgctgaatacgccggcaatcgcggcagcgacgccactgacgatgagcgcctgatcgaactcgaccagctcacgccccaggaactgttcagccgcgcctggcaggacaactacggcagtgaagtggatgaacaaaccttgaaggacttcgccgtgctgctccaggaagtgcaacaggagggcgaacagccatgaagatcctcgccatccgcctgaaaaacctcgcctcgctggcggggccgtttgaaatcgactttaccgccgagccactggccagcgccgggttgttcgccattaccgggccgaccggcgcgggtaaaagtaccttgctggatgcgttgtgcctggcgctgtttggcgcagtgccgcgcctgggtgacaccggccaggcgaaaatgccggatgccgacagcgatatttccatcggcgacccgcgcaccttgctgcgacgcggcaccggcggcggttatgccgaggtggattttgtcggcgtcagcggccgtcgctaccgcgcacgttgggaagccaaccgcgcccgcgacaaggccagcggcaagttgcagaacagtcgacaaagcctgatcgacctcgacagcgaccaactgctggccagccagaagaccgaatacaaaacccagctggaactggccctgggcctgaatttcgagcagttcacccgtgcggtgttgctggcgcaaagcgagttcagtgcgttcctcaaggccaatgacaacgagcgcagcgaactgctcgaaaagctcaccgacaccgcgctctacacccagctgggccgccgcgccttcgacaaggccaaggaggccaaggacgcgcacaaacagctgcaagaccaggccacgggcgtggtgcccctggctgccgaagcgcgtgccgaactcgatcagcagttggcagacgcccagcagcagctcaagactcaacaagcccagctcaagcagctggagtcgcagcacacctggctcaaggaactgcgcgaatggcaggaacgccagcacagtgcgactgagcaactgcaacgcgcgcaagccgattgggagagccagggcccgcagcgccaggacttgagccgcctggaacaactggcgccgcaacgccatcaatttgctcgacaggctgaacttggcacgctgctgacgccactcgccgcgcagattcagcagcaccttgagcagcaaaccgcgctgcatacccgccaggagcaggcgcaacagcagcaagcggctgcccaggcggcactggctgacgccctcaagcaccaggccgatgccgtgcccttgctgcgtcaggcgtttgaagaacaaagcaccctcgcccacctgaccaaggacttggccaaacgcagcgaggacaagcagcaacttcaaagcgcctgtagcgaaggccaagcgttattgaagggcttgcaggacaagcacagccacgtcgccgaacgcctgcagcgcctggccgccgagcttgagcgcagcgccccgctggcgccgctgagcgatgcctggggcgcttaccgcgaccgcctgcaacagctgatggtcattggcagccgcctgaaaaaaggccaggaagaactgccgcagctcgaacaacgcgccacccgcgccgccgagacattcgcccagcaacgcgacgcgttggacctgctgtatcaggaagccggcgccgagccacacgcggtcaccgaacagatccagctgctcgccagcctcctgcaggacaatcgcaagcagcaacgcgcctttgaagcgctgacgcgcctgtgggacaaccagcaacagctggatcaacagagcgccggcctcacgcaaaagctcgcggacgcgcagcagcagcgcgaacaactgaaccagaccggcctgcaaaccaaggccgagctgaccgtcgccgagcaaaccttgtcggtgaccaagcaactgctggagcgccaacgtttggcgcgcagcgccagcgtcgaagagttgcgcgagcagttgcaggatgaccagccatgcccggtatgtggcagccatgagcacccgtatcaccagcccgaagccttgctgcacagcctcggccggcatgatgaaaacgaagaggacacggcgcagaaagccgtcgatgtgctcaaggaaaagctcaccgagctgcgcggtgaagtcggcggtttgatcgcccagcaaaaggaatacctgcaacagcaggagcaactggcgacgcagcaacaagcgctcaagccaagcctggacgcgcacccgctggcggcctcgctgctcaatcaggatgccgcccagcgcagcgcctggctggcccagcaattggcacaactgacgcaaagcatcactcaggacgagcaacgccaaggcgccctgctcaacctgcaacaaaatgccgggcgtttgcagcagcaactgcaagccgcccaggacgcgagccagcaagctcggcagttgctggtggaccagcagcgcgagctgtccaacgaccgcgaacgcctcgacgaagaactcaatgccttcgccagcctgttgcccgccgacaccctcgaaggcctgcgccgcgaaccggccgcgacctttatgcaactggaccagcaggtcagccagcgcctggaacagttgggccatcagcgcgacgaactggctgaacagcaggaacgccagcaggccatcgagaaacaacaaacccatcagcagcatcgccaacagcaactggacgccttgctccagcaggtcaccgagctggccggccaacaacaggcggcccaggcaaaactcagtgccctgctgggcgatcacgccagtgccgaacagtggcaacagcagctggatcaggcggtggcgcagtcacgtcagagcgaaaccgacgccaatcaacagctgcaagacattcgtggcgccttgattcaactggcggccgacctcaaggcccaacaggaacgccaagcggcactgagcgccgagcaacaccacctcggcgagcgcctgggcgaatggcgcacgctgcaccccgaactggatgacgacgggctgacgcgtttgctggcctttgatgacagccaggtcagtgcattgcgccagcagttgcaacacagcgaaaaagccgtggaacaagccaaggtgctgctgcaagagcgtgaacaacgcctggccgaacaccaggccttgcacaacggcaacctggaagccgaacaactcgaaggcaccttggctgcgctcaatcaacagttggccgacagcgagaaacactgcgccgaactgcgcgcacgccagcacgaggaccaacgccgacaggacgccaaccacgccctgaccgaacagatcaccaaggcctacgaagaatggcagcgttgggcacgcctgaatgcgctgattggctcggccaccggcgacaccttccgcaagatcgcccaggcctacaacctcgacttgctggtgcaccacgccaacgtgcaattgcgccaactggtgcgccgctatcgcctcaaacgcggcggcagcatgctcgggctgttggtgatggacacggaaatgggcgatgaactgcgctcggtgcattcgttgtcgggtggcgagacctttttggtgtcgttggcattggccttgggcctggcgtcgatggcttccagcacgttgaaaatcgagtcgctgtttatcgacgaaggctttggcagcctcgaccccgagtcgctgcaattggcgatggacgccttggacggcttgcaggcccaaggccgcaaggtggcggtgatttcccacgtgcaggaaatgcacgagcgcatcccggtgcagatccaggtcaagcgccagggcaatggcttgagcaccctggaggtcaagtgagccaggcgctgctgtattcgtttcggcgctgcccgtatgcgatgcgggcgcgcctggcgttgcgctattcaggcgtggcggtgcagatcgtcgaagtgagcctcaaggccaagccggccgagatgcttgcactgtcgcccaagggcacggtgccggtgctctgcgtgggcgatcgggtgatcgacgaaagcctggagatcatgcaatgggcgctggcgcagcacgaccccgataattggttgctgggcgatgacccgtcggcgctggaactgatcgccgagaatgatcacgtgttcaagcatcatttaaatcgatacaaatacgccgagcgttacccgcagcagccgatggagcattatcgcgccgagggcgaggtgtttttgcgccggctggaagggctgcttgcgcagaacgactatttgttggccgatcatgtgagcctggccgatgcagcactggcgccatttgtgcgccagtttgcgcatgtggatcgtgagtggtttgcgcaggctgcgtatccgaagttgcaacaatggctaaagcattttttggccagcgcattatttctcgatgtaatgaaaaagactctttaaaacaaaaggtcgacactttaatcattaataaacacgccagtaattatcccgttacttatttattgccgcgcaacaactcacaataattactcgctcgcccagccgccaaaaatagctactatccgccgatcgaactgccccgttagttaggggacattcaacgtgtcaatccgaggagtgtagtgtgagttcaatatcagcgcgttcagttatcaatagttacacggccccgttgactgtccccttcccaaaggctgtatcaccccctgttcatctaacccatgatcaagtccagagcgcgcagaagttaacgcatcacagccggggcagaccgctttccgctacgcctgcgcttcaaacgccgccgtcagatcgaaccgaaaacacgctgcctccgctatccactgaccccctcggcgacgctgtgcgccagcagttttccgagcgccctacgctgcgatcagtcgtatcggaattactgcgcgagaccctgcgcaacagcaccggcaacgaggatatcgacatcagccacctcgtcctcagcgaacccgacccggataaccccacccggaacacacagaccccgcttgtggagctcgcccttgactatctggtgaagggcacggcattggatttcaccggtgaccgtacactggtcgacacacgctcgcgccagacacaaggtgctacggtttcaaccgttaacacgctgccaatagacctgcgcgcactggaacaggccgtgcgtcatttaaccacccagctccaacctgccttcatcagcagcgtggtgagctattggaacagcccggcgctggcggcgcccgccaaggggcaagaagccaccgctccagccatcagtcgcaggcaatggttcagcgatatcctgcgagacaacctgcgcatcaccgggttgaaacatccaggcctggacgatgtgcaacgcgataccctggaccaggtggtgagataccccgatcaatccgtgcggcctgaatcggagggcgcaaccaaagcgtcggtgttcaccctcaacaccggcttgaaacacgacccggattcgtggggcgcctatacggacgaactcttgattgtaaggacggtgggaaaccggcaggtggttatgctgtacacacccaatggagacatcacaccctacgactctctccaggatttccagcgcgcctgggagcaacgccttgaccaacagttcccgctcgatcaattgaagtttggccttgaagagccgctggggtcgatcttcgatacgcaggctgacaaccttctgcatgacagcctgcgcaaactctccacgctggccactcccgatcccgggcagggcacacacgacctggcggggcaactttcccgggcaagcgaccctaccgcaggttttgttaccgcgaccagggcggacccacaggtgcttgagcaaacccaaaagcgcctgccgcaatggctgctccacgccaatgaccgtgatcgttatgcctaccgcactctgggcctgcaattagccagtaccttgcagcgtaatcaggggcgctcgtacgaccatggcatcccggacatcacccagtttgcgcagcagcaactcgatgcaaaattgccgaaggggtatgccgcccaagacgtgagcgtggtcttcaaggttgcagtgggcgacctgggcagcggctacatcgaacgtgtgcccatgagcctgaccaagatggcgctggagaaccttgcgggcctgccgaaaggcgaaatggaggtgtaccacaatggccggcgcgtgcctgaattggagagcggtgacaggctcaagaagctggtgcaggaagtcgacatcgggaaaaactatccggagctgattaaacgcacgctattgggaaagggccaggatacgcaagaacgtcgttcgctctttgccgaccagttggcggtcgagttacccctgcaggccctggaactcgccctgcagaaagactccggcttcagcgcccgcagttaccgttacgtcgaagcgatcgtcagccccggcgccggaaaaaaacgcgcagatggccaggaaatcgtgattcggcccctggcgttgcggcgcacacccaacgcgcagcccgacgttgtcgacaacatgtttttgatcgaacccaaggacaccacagccggcccgcacatcctttatcgcccgttaaccgacacgccgttgctggaattccccacacgagcggcgttgatggaggccattgcgcaaccgggcaccttgcaaacaaccgttctcgcctggctgcgtgaccaaaagacacgtgacgtctacgcacataacgggtttcgggagccgcatgtccatcagttcttccagggcgatgagtttcgaacctatgaagcgccgcggcccgcaacgctggcaacagtgagctatgacaccgcagactcgctgcttgagggcctgcatgacggcaagctgatggaccacttgtacgacgccaacgcccacagcctgacgagcctcgccgacgagcaatcggtgtcgaacagcgaaagccgctgggcctctctcaaggaaggcgggttcctggtactcaatgccgtgctgcctgcgctgcgtacaccgggcatggcgttgggcgccatgctgcagctggacgcgatccagaatgaccttgagacgctggatgacgataagaaacaggacaaatcagcggcggtggtggatctgttactgaacatgatgtttgccctctcgccgctcagcacacacgaggccccacacagcctcggcgaggaccgttatgtggccgacaggttgccgaatacggtcgagaacgcgcccaataccgcagacacggcccctgtaaggagggtgccggacgatatcaaccatgcgttgcaatttcccaacttgcacccacgcacgcggctggtggacctgatcaattcgttcgaagtaccgcaaccaccccatcccggcctcccgatcgcgaaaggacggctcgcgggcctgtatagaatcgacggtaagttgcatgccaaagccaacgagaaatggtatcgggtaggtgctgacctggaccaggtgttcctgcttgacgataacgacaagtgccgcacaggcccgtttctgaaacccacggtcgatggcagctgggaattcaaggctgtcgagcgtctcaacggtggccagagaacctctgccgatgacaccgacatccagacgcgctatgaaacactgaagaccgatatggcggcattggataaaaagctcgaattttcaaaaatccttctgtcaaaaacactcgacacctatataaaaaaccgcgcgcagctaatggcgcggtggcaggcggttgaccccaacgtgcctgagagtgacgcccacacccgttatcaggaacaactgaaactgaccacaacgtctcgaacgcaactcaacaggatgcttgaaacccaccgctcgaatttaaaactcagcggcgacctgaagcgctccgcagtcgacatcctgacgcccaagaaaagcacggaaaaatcctcattctttcaggcgcagcgctccgagctatttctgaaattatttgaggagcaacaagcccttcaacaggtctataaaaccctcgctggagaaagccagcatgcgtcggatggcgaacctctggtcaggattatccagaacgtcaaagaggcaaactcaagcggctatcagaaatttgtcgcgaccctgggcaatacggttgatcagaatgagcagatgattcgctaccttggcgagcgctcggcacttctcgaggagtgggcaaatgactcgcctatcggcagagaacacgccaagtctatggtcgagcggctgaatgccgagaaggcattgctgatcctcgatgcaaacaccatggataaaatagcgctcgccaaagacacgctcaaccgagcacagcaagcgttcgcctccgaccctacgaacgatcaattgcgtgccgataaagacgacgctgaactgcgtacacttaagttgaccagcgagctgaaaatcactcaactcaacgctgaattggccattaataaagccaacatcaaactcagaaaaggccaacaaaaagcgctgatcgaactcggcgaccggagaacagccttggcggtgttgatggtcaaagccaaactgacacttgaacaatgtgatacccgcttgcagctcggcgatgcaaggcgcgcactgagcaacgaccctgccaatacccggctcaaagacgacatcaggctgacgcagaagaaactcgaagaaatcaagcaacaacttgccatgcccgacgtcatcgatgagctggccagtgatcgaaaatacacgcgcgtggatcaagacaaaatcccggcatccacccacaacgaagcgctcaatctgaagctgaattcgttagggtcgctcagagagctgagcctgaacaaagcgaatcaagcgacttacccgccggcagaactcgccatcggcacgcgtatcagccagcggccgttggcgccaatcgtgaaactccattgggagctgctcaacgagactgacgtttcagaggcaaaacgccggtcgcaactgacgcagctgattgacacgtatgaaagcctgttggaagactgccgccagctccaggccagccattcggtcatcattcgcccaaaatacaatgatctgctgatcaagcgcctggaagagctgctcgatcatgcccaacagcagcaagacatactgaaccaggcagaaagggacagcgccttgaacctggcctcctcgtcgggtcattcacagaaccggcaatcgcctattgagcgcaaacaaccggactctgcaacgcgtacaccctcacccactgaggttcagaaagaagaggctgccgagccggcggtgaacatcccgccccccgtgcaacccgcggcgccaaagccatcactcaaagccttgaaggctcaggcgcaagcggtgatcaaacaatgggagcaacaggaacggttagtgttgcacgagaaaaagaaactcaaacaacctgacgcactgcaaaagatcaaaccgcttgattgggaccacatgctgcgagagccggcgtcgaacctgcttgaactggccaacaagaccgaagcaacacacggcgatgatccggcgtgtgcgcagcttgtcgagcaatggcgcacacgtgctgaggcgatgcacaaaagcacctgcgaacatgtgcgagacgcctacgttctacaggcgccctctgccgctaatgtggcttacctgttcgatcagcgtctggtcaccctggaacctgtaggtcgggtatttcctacccgagcgggtgatgtattcactgaatacgtggtgcgcgacagccgggagcctcatgacgtcctttggtatgcacacttccactacgcgaccgaagaagacgcgctgacacgtcccgccagccatacgtttgcgcacctgaaactacccagccaacaaaaactgacccaaaaagacttgaacatggcggcagggaaaaacacgctcgccgataaaattgaagatgcgagaattcgcgcaccgctggatgagatttacctcaacgccaaaccctagggcgtggctgaactcacccgatacacaaacgccaaaccactggaacgcgagcatctgcgttccagtggtttggcgtttggcgtgtgccgcgtcaatcaacgctcattgctgggctttgtgatccagtgcggcgtagaagttggcgctttgttgcaggtatttctgggtgtaggcgctggtgctggattttttaccggcaacgtccacgctggcggcggctggcaatgccacggtggcggaaacagcggaagcggcgatgatggagaagaggttcaagttcatgtcggtaacccttgtgttcgttcgtttaggtggccggggaaggccttggaacccaacttacgcccgagggctgaaccttagaaatgctttgaaacagtagccgctattaatagaattaatacagagggtcaggccccgcactgcggggcctgtggcttattgacgcaccaggaacttgaggtcgctgggggcatcaatcggcaatttctgcacggttttacccagcaggccggtcttggggtcgcgttcgaccactacgatttcattgcttttctggttggcgatcagcaaaaacttgccgctcgggtccaggctgaactcgcgcgggtggtcgccttcaaccgaacggcgctgcagttccttgaggtgtgcggtggccgggtcgatgctgaacaccagcacttggttggcggtgccacggttgctcacgtagaggaatttgccgtcacttgaagcgtgcacagccgcacccgctttgtcggacaccggttgcccggcagcaaagtccaccaactgggtctggctgagcttgccgtcgttgtagtcgtataccgcaacctgcgcgctcatctcggtggtcagccaggcatgcttgccatcggcgctgaacagcaagtgacgcgggccactgcccggtggcaactgcacaaaggacggatcggccggggtcaatggcagttcgtggttggccttggggtcgtagcgataggcaaataccttgtcggcgcccaagtcctgcacgaacacgtatttgccgtctggcgatgacaccaccgagtgcacgtggttggaggcctggcgctcagggttcacgcggctggacggatgcccgctgagttgcaccggcgccgacagcttgccattggcgtcgaccggcagcaccgcaaggctgccgcccgggtcttcgagcaccgaatagttggccacgaacaggtagcggccatcagcggcgaggctggaatgggtcggctcattgcccaggctttgcacctggttgatcaggctgagctgatgattctgcgggtcgatgctgtagctgctgactcggccgaccgcgtctttctggcctgggccgttttcgttgaccacaaacaggtgcttctggtctttggaaatcgtcagccacgaagggttggccgctttggccgccagcacaggcttgccactgaattgaccggtacggctgtcaaattgcaggcggtagataccttcgctggtgcctgcggtgtagctgcccaccagcagttcataggtgtcggccggcgcggcttgcaccgacatcgcgccgacactgcctgccattagcaggggccagaatttacgcatcatcatccgcttcgtcctcgtcattattgttgccggtgacgccgctcatgcagaccaggcgatgctcgcccgagtcaccggtaagggtccagctttgcaacgattgatcaaagatcgccgcgttgacttgctccaggctgaaactccagcgtttctcggcacgaccgtccatgcagatgatcagcaacttctggtcgtccaggctgaagtcaaaggtgtgcagcccatcgatttcaaccatctggcagtcttcaaaagcgtcgagcaaggtagcggtgtcagcagtcatggcagtcaatcatttggggaaagtgccaatgatagcccacgccgcataggttggacctggaattaatgtgggagcgggcttgctcgcgaaagcggcgtatcagtcacccaatacatagactgaacaaccgcattcgcgagcaagcccgctcccacaatttgaccgagtacggccgtaaaaccactagtgcgcaaacaacgaattgcccttctgccccgccagcttctccggcttgatcaggaaacgcgccagcgccggcaacagccacagcgcgccgaacatgttccacaacagcatgaaggtcagcatcaggcccatgtcggcctggaacttgatggccgagaagatccaggtgcacacgccgatcgccaggcacaagccggtgaacagcacggctttgccggtggacttgagcgtctggtagtacgcctcttgcagcggtaaaccggcacgcaggaagctttccaggcggctgtagatgtagatgccgtagtccacgccaatccccacgcccagcgccaccaccggcaaggtcgcgaccttgacgccaatgcccatgaacgccatcagcgcgttgcccagcaccgaggtcagcaccagcggcagcacgatgcacagcgtcgccgcccacgagcggaaggtgatcatgcacatggtcgccacgcacaggtacaccaggatcaggatggtcagttccgactctttgatcacctcgttggtggccgcctcgatcccggcgttaccggcggcgaggatgaattccaggccgtccttgttattttccttggcgaagtcctgtaccgcatggaccgcgcggtcgagggtttcggccttgtggtcgttgaggaacaccagcaccggcgccagcgagcaattgttgttgtacaggccatcggcgcgggcgatggaattgttcaatacgtcggggttacgcgaaagggtttcccatttcaggttgccctcgttcatgcccttgatcatctgcttggacacggtcaccaacgagatcgccgactgcacgccttcggtgttctgcatcttccacatcaactggtcgatgggcgccatggcttcatagcgcgagcaaccttcggcctttgtcttgaccatcaccaccagcacgtcggaactggtggagtagttgctgatgatgaagttgttgtctttgttgtagcgcgagtcggggcgcagttccggcgcgccttggtcgaggtcgccgattttcaggttctggctgtaccagaggccgccaccgaaggcgatcagcgccaacaggatcgacaccggcgcgactttggggctggcgaatttggacagcaggcgccagaacgggtgttcgcggtgcgcgtcctttttgctcttggcgatggcgcgtttgctgatgcctacgtaggaaatcgccaccggcagcaggatcaggttggtgaacacgatcaccgccacgccgatggaagcgccgatggccagctcgcggatcacaccgatgtcgatgatcagcagggtgatgaagcccacggcgtcagcgagaatcgcgatcatccccggtaggaacagctgccggaacgtgcgccgggccgccgtcagcgcgttgtccgcctcactcgattgcagcgcgatgccattgatcttctgcacgccgtgggaaataccgatggcgaagatcaggaacggcaccagcatcgaatacggatcgaggccaaaaccaaagaagtgcatcaagccgagttgccacaccaccgccaccagcgtggtgctcaacaccgccaccgtgctgcgcaagcagttggtgaaccacaacagcaggatcagggtgatgacgaacgcgatgccgaagaacatcaccaccatcaccaggccgtcgatcaggtcgccgaccttcttggcgaagccgacgatgtgaatcttgacgttggggttttgcgcttcgaatttgtcacggatcttgtcttcaagctcatgggagaacttgcggtagtccagggcgagtaatttgccttggtcttgcgggtccgggtaggactccagcagcgggatgtcgacgatgctcgacttgaagtcgttagccaccaggcgcccgacctggccggacttgagcacgttattgcgcaattggtcgaggctttgcggcgaaccgttgtagctttgcgggatcacttcaccgccggcaaagccttcctcggtgacttcggtccagcgcacgctggggctccacagcgacttgaggcccgagcggtcgacgccggagatgtagaacacctcgtcgttgatctggcgcagggtctccatgtattcctttgaaaagatatcgccgtccctggcctccaccgagatgcgcaccgtattgcccaggttggccaggtcgttgcggtgttccatcatcttttcgatgaaaggatgtttgagggggatcatcttttcaaagctggtggacgggcgaatcaacgtcgcctgccagaacaggaaaatgctcaccagcaggcagatgacgataactgccgggcggttattgaagatcaggcgctcaagaaaggtcgctttatcgttgtgatgactgctcattctctgtccgccttcttattgttttgtcggttcggcgccggtcggcgtggcgacacgaacaccgccctgcccgaccagaatcaaattgccgttgcccgccgccgtgaccgccgagagtgaaatgcggtccggtcgattgaacacgctgaaggtttgcccgtcgtcgtggctgactaccacgctgccgccgttgccgaccaccaccagcgagccgtcatcgagcaacgtggcgcccgacaagccgaactccagggcgccgcgcgcggcgtttagctcaacctgttcccacgtgctgccgaaatccgtggagcgataaagattgccgcgcaggccgtaggccaatagcgtttgcgcttgcgcggtgctgatcacgccaaacagcgagccttcgtacgggccttcgagcttttcccaggtctggccgtcgtcacgggagcggaacatgctgccctgctcgccgacgataaacaggccggcatccttgatgtgagcgatggcgttgaggtggaactggtcttcgttgtcgaggcggtcgctgacgtcttcccaggtgttgccgccgtcggtggtttcgatcagcgcaccgtaggcgcccacggccaggccgtgctcggcgtccttgaaccagatgtcgagcagtggcgcttcgcgcttgaggtcttggtattgctgggtccaggtggcgccgccgtcggcgcttgcgaggatttgcgcatcatggccgacggcccaaccgtgtttgtcgtcgacgaagaacaccgccgtgagcagttgccgagtcggcactttggcttgggtccaggtgctgccctggtcatcggaatagaggatgtgcccgcgatcaccaaccgccaccaggcgcgagcctgcgtggaccacatcgatcatcaagcctttggcggccttgggggtttgaatcgcaaataccggctgtgcggtgacatcgccggcggccagcacgggtgtcgacagtgccgcaaacagcgagagcgctgtggccagcatcgcaacccggcgtgcggcgcgcgggcggcaaacaacccaacccatgacaggctcactcatagacctttctcccgatttattattgttaggtcgtctcgccttcccgggccctgaaacctgcaatctagagcgcctgaaggaagcaggggccatcctatcgggctttcgaatcgtctgacaatcggcgctacgttatcttttgttaactggtggcgtttgccgatggcctgaatggcacagtattactgcgcatgatgatgatcattcccatgcccctgcgtgggaacgcatcccgagacgctctgcgtcactcgcaggatgcggagcgtccctggcggcattcccacgcggagcgtgggaacaatcagattactgcgcatgacgatgatcgttcccacgctcctgcgtgggaacgcatcccgagacgctctgcgtcactcgcgggacgcggagcgtcccaggcggcgttcccacgcggagcgtggggacgatcagattactgcgcacgacgatccggcagaatgaatttttattccatatcttgaattatgtgaatttttattccattaatagccctcctgaaaacaataattcaaaggaccaccgctatgcgtgaactcggaatcggcctgatcggcacgggcttcatggggcgcgcccacgccctggcgttcaacaatgcccgcgcggtattcgagctgccggtcaccctcaaattggccgccctggccgatgccgacaccgagcgcgcccagcgctgcgccagcgcatgggggtttgcccaggcccatggcgactggcaggcgttgatcgacgaccccaaagtcgatgtcgtggccatcaccacgcccaatcacttgcattaccccatggccatggcggcgattgccgcaggcaaggcggtgtattgcgaaaaaccgctggccgtcagcctggagcaggccgacgccatgcgccgtgccgccaatgcagccggggtcgtcacgcgggtcggctacaactatcagcacaacccgatgatcggcctggcccggcagatgattgccaagggcgagctgggcgagatcatcagcttccagggcgagttcagcgaagacttcatggccgacccgaattcaccctggtcatggcgttgcgaggtggaacacgccggaggggccctggcggatttgggcagccatttgctgtcgatggcgcgctatttggtcggcgatgtacacagcgtgtgcgccgacacccagaccgtgcacgcccaacgcccagtcgtcaaaggcagcagcaacctcaaacccatcgccgtggatgaccaggtgcatgcgctgctgcgcttcgccaatggcgcgcgtggcacggtgagcagcagttggctcaagcatggctacaagaaccacctgagctttgaaatcagcggcacccaaggcaccttggcgttcgatcaggagcgcttgaatgaactgcgtgtttgccgcgccggccaggacggcttccagcgtgtgctggccggccccgccctgcccggctacgccgcattcagcccggccgccgggcatcaactgggctacaacgaattgaagaccctggaagtgcacgagttgatcatggcgctggcggggcacggcgcggatggcactgatttcgagggcgcctgggcagtcgaggaactggcaacggcgattcgcctggcggccattcaaaaacggtgggttaacgtcagcgaactatagacaactggggcgcttcgtggggttggcgtgtgcgcccaatgcacgtcaacctgcatgagcggggtaacttttctctcgccccaaacaaataaaccccgacacaccgacactctttatcacacctgatctcgcacaacttcaacactctatttaactacccatttcaaaaatatacatttaagtcatacatagacatatacccctgattggcattccctgccgaaagacttactttaccgtttacacctactaacccatgcactacttctcacttctatcttatgccagggattgccatgcctattactcgaaccaacacgagcgcaccttattacgcccctcagcccacattagatcatccttcctcccccgttaaacaggactggccaagtgcttcgcctgaaggggatatccccgcacagctcacccgtgaaaactatagaatcaaagatcgaaacggcgatggcaaaataaccatcggctacagattcttcgactcatccgaccctcaagatccctggtataaaagcagtggaacactggcactcagcgacgccagaaaaaaagccttcagaagttcaatcaaggcgtgggaggacgtgattaaggtcaaatttaccgagaatgcaaaagacgccgacgccatgctggttgttcatggcaataacggcgtgggtggttacgccacaatgccttccgattacagtgggctcatgagcatcggaatcggcctgggcaacaagaatctacctctgaactcttcaatgattcacgaaatcggtcatagcctggggctgggccacccgatcggacgtcattccgaaaacaacaagacccatacggccatgtcgtacaacacccatttttggcggccctttgacgagcatggctccagcatctcggatagcaccgcgacgccgatgatgcgtgatattaccgctgggcagagtctctacggcgccaacgataaaacccgcacgggtgataccacttacggcttcaactccaatgccgaccgcgattactaccgcttgaactcccccgatgacctgaccgcgatctgcgtatgggacaacggcgggaatgataccctggatttttcgggttaccggcaagaccagaagatcgaccttaacgccgagcagctttcgaacgtaggtggcagaaaaggcaatgtgtcgatcgccaagggcgttgttgtggaaaatgccatcggcggctcgggggatgatgagctgatcggcaaccaggtcagcaatcgcctgacgggaggtgcgggggcggacaaattacacggcggcggcggcgcggatacttttgtctacacccgtgtcagcgactcgccgatggaaagcccggacatactggaagactttgttagtggtgtcgataaaattgatctttccggactattgaagaacgccggtattgcgaagccgatcattaccagtgtactcaccgatcgggccgctgaattagacggtcacaaaggcgaactggcattagactacgataaaaacttcaagatgcacagattgatactcgtgctggacaacattggctctatgctggttattctaagcaagaacccgataaaacctggcgacctagttaccggcgaccattcacaactaccgatcacaccgcccatgccagagcctgcaccccccacctataaaacctataactatgacgcagtctccgactcaccctaccaaaactcgcaattgctcacaaacttcacgacagccaaggacaaaattgacttaagtaacctaagtaaaaattcacgggtaacgctcaaccacgtcaacaggtacacaggacgaattggcgacactgttcttacggttaacccggcaaccaatcggtactacatcggtattgatatgacaggcgatcgcaggacggactttttggtaagaagtacgaagccgatcacgagccaagatgttattggcgtccagttccagtaatccggtggtcccttaacgccaagaccgggagcggcaaaccgccactcccgcgcgcattcaagtcagataacgaaccgcgccaccatcccattcaaatccaccgccaggcgcgacaactcatggctggccgcactggtctggttggccccggctgccgactgggtcgccaggtcacggatgttgaccaggttgcggtccacttcacgggagacctgggcctgttcttccgacgcgctggcaatcaccaggttgcgctcgttgatcaggctgatggactgggtgatctgctcgagtgccacgcccgctgcgcgggccatctccagggtggtgtgggtgcgctgattgctctgctgcatagactgcacggcttcaccggtgccggtctggataccggcgaccattttttcgatttcctgggtcgactgcgcggtgcgatgcgccaacgcccggacctcatcggcgaccaccgcgaacccacgcccggcttcaccggcgcgggccgcttcaatcgccgcgttgagcgccagcaggttggtctgttcggcaatcgcgcgaatcacgtcgagcactttgccgatgtcgcggccctgagccgccaggccttcgatcattaccgaggtgttgtgtacgtcctgggtcatggtctggatcgcgccgacggtttccaccacgcggtcacggccttcacgcgccgcctggttggattggctggaggcttcggaggtggacaccgcgttgcgtgcgacttcttccacggcggcggtcatttcgttgacggcagtggcggcctggtcgatttcgttgttctgttgttgcaggcctttggaggcttcttcagtgaccgcgctcagctcttctgcggcggacgccagttgcgtggccgaaccggcaatgtgctggatggtctggcgcaggttggtttgcatggccgacaaggcaccgagcaggcgcgccggttcatccttgccatagtcttcgatgggtttgctcaggttgccaccggcgatggtttcggccacttccacggctttgcgcagcggcgtgacgatgctgcgggtcagcagccaggccagcagcacggtcatcaaggcggccacgaccgacacggcaattacgccggtaatcgcgccctggtagctctgcccggcgtcatcgtcggcctgcttggcatccgccgcattgatcgcgatcagcctgttgagctgctcgcccatctggtcggtgccatctttgatgcgcgtgttgatcaacgtacgcatctcatcgactttgccttgtttggacaacgccagcatctcggcctgggcctggaagtagttgttcaaggtgctgacaaaggtcttgtacaaggccgcctcctccgtaccggcgggcagcacggcgtaaccggcctgggcggtttttaccttgtcggcaagtacggccatgcgggtttcggcttcctgcaggccggccggctcgcggttgaccaatacgcggaacgagagaatgcgcaggcgcagtacgttttcggtgatgttgcccaggtaggtgacgctgggcagttgcgtggcgctcatgtccaccgaggactgacgaatctgtgtcatgcggttaacggcgaacacccccaataacaccactaacaacgcaatgaaggcgaaaccgagaaacgcgcgaggggcaatattcagatgacgtagggacataggggtgctctcgagaagtagtgttggcgagcgtccctgctgcgacacgatcagtcggcgtcaacgcgccactctgacctttgcgcacccttgttgtaatagtggggtgggcttacctacgctatcggctggcgtgtgaattttatgcaggatgtttcgaaatatttttacacacttctgactgccggcactttctggcatcctgcgcgcccctttccctaccgggcctgtattttgtctgacgctcaaacccctcgcccccgctataaatccgacctgatctacggcctggaagaccgcccgcatttcaccgccgcgattttcgctgcgctgcagcatgtgctcgccagtttcgtcggcatcatcacccccaccttgatcgtcggcggcgtacttggccttgaaagcgaagtgccgtacctggtgagcatggcgctgttcgtgtcggggctcggcacctttgtgcaggcgcgcacattcggcccggtcggttccggcctgttgtgcctgcaaggcaccagcttttcgtttatcagcgtgattctcagcgccggttttatggttaaggcccggggtggcggcaccgatgaaatcctctcgaccatttttggtatctgctttttcgccgcctttatcgaagtggtgctcagccagttcatcggcaaactgcgcaaactgatcactccggtggtaaccggcacgatcattaccttgatgggcctgtcgctgatcaaagtggcggtcactgacatggccggcggttttggctccagcgatttgggcgcggcaagcaacatgggcctggcggcgctggtgctgctgaccattgtggtgttgaaccgcttcagcaacccgttcctgcgcctgggctcgatcgtgatcggcctgacgctggggttcgtcgtagcctggtggatgggtcgcgtcgacatggcggccttgccgcaagtgccgctgatcagcgtgccggtgccgttcaaatacggtttctcgttcgactgggtggcgtttattccggtcgcggtgatcttcctgatttcgccgctggaagccgccggtgacttgaccgccaactcgatgatttctcagcagccggtcaaaggcccgctgtacatcaagcgcatcaagtcgggcctgttggccgacggcctcaattcggcgatggcggcgaccttcaacagcctgccgatggtgaccttcgcgcagaataatggcgtgatccagctgaccggcgtggccagccgttatgtggcgtactttatcgccggcctgctggtgctgctggggctgttcccgatgattggcgcggtgctgcaattgatgcccaagccggtgctcggcggcgccaccctgatcatgttcggcactgtggccgtggccgggatcaagatcctcgccgaagccgggctgcaccggcgcaatgtgctgatcgtggcgatctcgctgggtatgggcctgggcgtagctgccgtgccggaagtgttgcgcgacctgcccaaggcgctgcacaacatcttcgaatcgccgatcaccgtgggcgcgttctgtgcaatcctgctgaacattttcctgccggaagagttcatagagctggaagaagatgaatttgatccggagtcctctaccctcaaggtcatgcaggacccggacgtcacgaaataggagcacctttatatgcgcaagctcatggttctatcgttactgctgctgaccttgagcgcctgcgcgctgttccccaatcgcgacccggtgaatattacggtggtgggcatcgagccgctgcaaagccaggacctggaagtacgtttcgccgtgaaactgcgagtgcagaaccccaatgaaacggcgatcgactacagcggcgtagccctggacctggacgtcaatggccggccgttggcgtcgggggtgagtgatcaaagcggcaatatcccacgcttttccgagaccgtgctgaccgtgccggtgagcgtttcggcgttttccgtgttgcgccagaccctgggcctgagccagacccagagtttgaacaacctgccctacgtattgcgcggcaaactcgcaggtgggctgtttggcaccatgcgctttgttgatcgcggcaccttgaacctgccgaacacggccacgtggtaaacgccatgcaaccgacgttgttcaccgacagactgatcctgcgcccgctaaccctcgacgacgccgaggccacccaggcgcagttcgcgcattgggaagtggtgcgctacctcaatgcccaggtgccctggccgtacccggccgatggcgcgcgccgctatattgaagaggtcgccttgccgggcatggccagtggcgaccaatggcattggtcgatccgcctcaaaagtccgccggagcagttgatcggcaatatcaacctgacggacgagcaagacgacaaccgaggtttctggctgggcccgcaatggcaaggccagggctttatgagcgaagccagtgcggcggtgacgcagttctggttcgaggtgctcaaacgcccgcggatgcgcgtgcccaaagccgcgccaaacttaaggtcgcggcggatttccgaacgcaccggtatgcgcttgatccgaacggatgaaggccagtttgtcgcaggcagcttcccccgggacatttgggagataacccgcgaggaatggttggaatttaaatcgtccaaacaatgaagcactcatgtgggagcgggcttgctcgcgaagacggtctttcagtcaataccttaggtggctgacccaccgctttcgcgagcaagcccgcttgtgtcttgagccaggtttaaactgaggttgagagcggtgagtggcaagctgaatgccc

SEQ ID NO: 30 - DNA, 223074 bp, Pseudomonas poae FL10F
cggtgtaccagtcaactttttattgactaatacaccgccttcgcgagcaagcccgctcccacacttaaactgtggtcggccgaacgattagcgccgacgtggacgacgctgctcatcatctgtgcgaatcggcacaggttgcagcggtggctcgatcaaaccgagtgcgacgccaacgtcgtggagccagttttgaattttctctttcatggttgtcccctttgcgggtaatgcaagtcggcgagagcttttcgccttttcctacagtgatagtagccctaagccctacgtaatgcttgaacgaaaacacaacgaactattactgaattgatccaaatccagacggatcgttcaagcaatcgcgcgggcgtcctgcaagaacttggctttaccttcctgctgcaggtcgatccatgcgttgaggttagcgccgagcataccctttcgccacatcagccaggtcgttgcagtagcaaaaggccctgtcaggggatgaacggacacactgcccttgcctggcaagctgtcgagcatcgattcggacatcaatgccacgccggatccggcaatgacgcaggcaagcatgccctgataggactcaatctcaatcgctcgccccatcgccacccgctcgtgagaaaaccaggtctccaaccgtgtgcggtaggcgcagctgcggcgaaaggtgaagaccgagcgaccggcaacgtcctgcggcccacgcacaggcgggtgatcagcctcgcaaatcaacaccaggcgctcttcgcacagcggcacgccgtccaacgtggcgatagtcagcgggccgtccaccagcgccgcgtccaaacggccggtgatcagcccttccagcagttcaccgctgggcgccgactgcacttgcaggttcaccatcggataggccttgtgataacgcgccagcagttggggcaaatgaatcgcggcggtgctgtacatgctgcccagcacaaagtcaccggcaggctgcccaccctgcacggcgccgtgggcttcgtcgtgcagtgcgatcagacgcgtgctgtagtccagcaacactttgcccgcaggagacagctgcaaacgctggcgctcgcgaacgaacagctcgaccccgagctgctcttccatttgcttgagccgggtcgacaggttcgatggcacgcggtgcaggcgctcggcagcacgggtgatggagccctcttccgccacagcctggaagatccgcaattgactgaactccatacctttctccaaaactgaacaagttactcactattattcatttttacagaaagtcaattcactttagcctgaaggtcttcgcttgcttgcaggaaacctgaacatgtcaccgctgattcgcttactcgccagctttatcgcgctaatgatggccatgggcataggccgcttcgccctcaccccgcaaatgccgcatttgctcagcgaggggcagatcgacctgaccggtgccgggctcatcgccgccgccaactacctcggttacttcgtcggtgcggtggattcgatttttgcgcgcagccaccatcacgtacgggggcgcctgtacggcgggctatggctgtgcgtactgctgactttggcgtcgtattgggcgcatgggttctgggcgcatttgctgttgcgctttggaaccggcgtcgcgagtgcctgggcactggtgatgatcaccagcttgagccagccgctggcaatcgctgccgggcgcccgcgcttgggcgcgttggtgtttgccggcccggggctggggattctgttgactggcttgctggcgctgggctccaacctgttgggccaggactctgccaccttatggctggtgtatggcgtggtggcgctggtgatgctgctggcgatcctgccgtttttaccgaaaccgaccgccacggttacccacaccaccagcgcgggcagcaacggcagcattgcgcacctgtgctggatttacttcctgtatggcctgggctacatcatcccagcgacctttttgtcgcagatggccagtgcgcaattcaagggcgcctggcaggccgacctgttttggccctgcttcgggctcgccgccgcactgggcgtggtggtggcgagcctgcgccgcaaagacccgaacaccacccgccgctggctgatgacaaccttgtggctgcaagcgggcggagtatttgcctgcttgctgggcaatggctggggcctggcgctgggcgtgttgctgtgcggcgcgccattcctggcctgcatgcaactggtgatggcacggttgcgtgaggtggcgccccacggctaccagcgcagtaccgggttgctgaccgccagctttgccatcggccaattaagcggcccgctgctggcgtcggtgagcagccatctcagcggtggcctgcaaccggcactgatagtcgcaggtgccggcttgttactcgcaggtgcagtgttgctcaaccggcaaccatcggcgtcgggatgcgaacctgctctcgccgcgccaggaccaggaaaaacagcccacccaggaagcagccggtaaaccaggcaaagttagccatgccctgcaacgccggcgtgaaggtgatcgcaacgcccaccagcgtcgccggcaccaaggctttgacggccgtccagttcacgccgccgtcgaagtaatagcgcccgctcgggctgtcatcgaacagggcatccacgtcgattttctgttttttgatcaggtagaagtccactaacaggatcccgaacagcggcccgataaaggcggcgagaatatccagggtgtagtgaatcatcagcggattgttgaacaggttccatggggtaatgaagatcgacgcgactgccgcgatcatcccaccggcacgccagctgattttgctcggcgcgacgttggcgaagtcaaacgcaggggatacgaagttggcgacaatgttgatgccgatggtagccgtcacgaaggcaaaggcgccaagcaatacggccatgctgttgtcgatacgcgaaacggtggcaatcgggtcgtgtagcatttcgccaaacaccggcaaggtgcccgacacgatgacgacggtcaccagcgagaacgccaggaaatttaccggaaggccccagaaattgccgcgacgcacgtcgcgcatgctgcggcagtagcggctgaaatcgccgaaattcagcgtcggcccggagaaatacgacaccaccagcgccgttgccacaatcacctgaccaacagcctgccagcccgacaaggatttttccgccagggtaaagctgatattggcccagccggccttccacacaatccagcctgccagggcgaacatcaccgcgtagaccaccggacccgcccagtcgataaagcgtcggatggattccataccagcccagaacaccgcagcctgcaacacccacaagctaaggaaaccaaaccagcccaagtaagacagaccggcaaaatgcggttctgcatacaccgccatttgtgggaaaaagcgcagcaccacgatgatcaaggcactcgaggccaggtacgtctggatcccataccaggccaccgcgatcaagccgcgtatcactgccggaatattcgccccgaatacgccaaaggccagccggcagataaccggatacggcaccgccgcttgctgactcggtttggccaccagattggcgatcaattgcacgatgcaaatgcccgcgagtaacgcgatcagcacctgccagctggccagcccgagcgcaaacaggctggcggcgaagacgtaaccgccgacgctgtgcacgtcgctcatccagaaggcgaagatgttgtaccaggtccacttttgcggcagtgggcccaggtcctggttgtacaggcgcgggctgtagcctttgggcaattgttcgatcatcgcttggctcctcgaaataccggcctgcgctgccgtaacagaatgcatacgggaggcggcatggtttgtatacgaggtgttcagcagaatacgtgccaatggcacacaatccctctggaacggcgctccaaagggattgataagggcttatagccgggcgctacgctcagcaacggtgcacattaatcctgtacacaatcagcgttgcacccgatgtgcacacaaataaccgacagtacaacacgcggccgtcaggaacgtgccccaggccatgtccatgaccgccaagccagcagaccagccttgcagcgtggcccagttgctcaagtcataggtgccataggccaccaagccaagcagcgcacccaggcgcgcggcccgttgccaactgccgcttggcaggactacgaacaccacacaaccgatgacatacaggaggtagaacagcacggcaggcagcagccgaggctgatcaagcatcagcgggccgagcaaggatttgtaggtcggccccatgagaacgccgagccagaggccgtcgagcaccaaaaaagcgagcaaggtgccgaggtaagcgaacagagtttttttggtcattcacgcagcctctgcaggagcacaattgctcctacagaagagcaaaacatgctcagcttagttcaatgcgatccgcgtgaatcacaatctgaccttgcttgtagagcgcaccaatggcctttttgaagttgcctttgctgacgccgaacaagttgctgatcaccgccgggtcgctcttatcgctgactggcaggctgccgttgttttcgcgcaacttggcgaggatcttcgagttcaggctggaggccgcttcctggccgaccggctgcaggctcaggctgatgttgccatcggcgcggatctctttgataaagcctttctcttccttgcccgggcgcaggaacttgaacacttcgttcttgtggatcaggccccaatgcttgttgttgatgatcgccttgaagcccatgtccgtagcttcggccaccagcaggtcgacttcctggcccacctggtagttggcaggcgtcttgtccagatagcggtccagccgtgcggtggcggtgatgcgcttggtgtgcttgtcgagatagacgtgcaccacgcagtactcaccggcggtcagctgacgtttttcttccgaatacggcagcaataaatcctttggcagaccccaatcgaggaacacgccaatgctgttaacctcgacgactttcaaactggcgaattcgccgacttgaactttcggcttttcagtcgttgcgataagtttgtcatcgctgtccaagtaaatgaacacgttcaaccagtcttcatcttcactgggaatatctttggggatataccgattcggcaagaggatttcgccatcttgcgcaccgtccaggtacaaaccaaagttagtgtgtttaaccacttgcaagctgttgtagcgcccgactaaagccatttccaaataccctcgttacgtggggcgcattctacccgagttgcgcctcgcacgcgcgcgcgcctgaaaaatcgtggcatggcgtggcgatccaatggcaccgccccgctcgtctgatcagagcaatgaattttgccaggggtgacggggcgttggttccggtgctttcgatttaaaacagtaagttagggcgttatttcaatgacaaactttggctgattcgaacaacctcaattattcctgagggatatttgccaagcaattgtcaagtatttcctgtacgatgcctggccaagttaattttctacaggttagtggccgccatgcgcgtaaaagcatccaacagcaaagcaaagccagctccagccgttgaaaccagcgaatcgatcaacagccagattgctgctttcctcaagtccggcggcgaaatccagcaaattgccaaaggcgtgagcggccagactttcggcccgtccaagcagatcagcctgggcaaaaagtaaaactcgcgcagtacatctggtccctaagcgtcttgtcctcaaggcgctaggactagagaccaaaacccctctctgcatcattcaataatgtgctaatcgacgaacgggcctcacctccaggcttacgccggtatgcttgcacacgtctagcacgggcatctgcccgattcttcctgttactgctcctcgcttttcatggagtgaagcatgctcaagccctgcttttttctcatagctgcccttgcggcaagccccgttgccgaagcgcagatttttcagcgtgagctgggcgatttcgacctgaagttgggtactacgccaagccgcagcatggcccagggcctggtaaagccaacgtcccccggcagcgactcgttccacggtggcctggacctgagccatgacagcggcctgtattttggccagttctcaccgaacatgggtttatcctctgccaataacctcgaagtcgactcctatatgggcttcaaacgccctttcgaccagaccttgggctatgaagtcggattgatccactacagctatcccaagctcagcccgctggacagccaggagttctacggcggcttgaatctgttgggcaatcgcttcggcgtctctttcagcaacgaccccgaccgccacgacagcaccctgttcgccgactttggcggcacacagcccttcggcatcggcgtcagcatgaagtacaccacccaccaactgggcaccccggcctccgtagagggcggcgccatcagctcgttcagtgactggtcggtacagttctcccgcgcatggaagggcatcgacctggacctgatctacagcgactccagcctcagcggcggcgactgctcggcctactccggacacaactcgcaatgcgatggcctgttgacgttgaaggccgctcggtcgttttattgacgggctgaactgtcgcaccccgcgcaggctcacatgcattaaccccctctgcgcaaggaatcgcccatgctgcgtcggctcaaactaatggtggtattgctgaccctgagcctggtgctcgcgggctgcaatcgcgtgggcctggcctaccgcaatctggatgtcattatcccctggacactcaacgactacctggacatgaacgccgggcaaaagagctggttcaacgacaaactcaaggatcacctggcctggcactgcaccacgcaattgccgggctacctcgattggcttgatcgcctgcaacagatggtcgacaacaaccaggtcaccgacgccgcgttgcaggcccgtaccgtcgaagccaagcaggcaattgccgaggtggcgcgcgagatcacaccgtcggccattcaactgctgcaaggtttggacgatcagcaggtcaaggagatgagcgacgctctggccaaggacttacgcaagcgtcaggacgaatacctcaagccgcctctggagcagcagatcaaggaacgtgcccagcgcatgagcaaacgcctggacgcctggatcggcccgctcagtgccagccagcaaaaccgcgtcaccgcctggtctattgccctgggtgaacaaaacgagcagtggatcggcaaccgcgcccgttggcagacgcagttcatcgccgccgtgcagcagcgcaaagacgccgacttcccgcagaaaatccaacaattgctggtggaccgtgaaagcctgtggacgccggattacaaggttgcctatgcccagacggaagcggcggcacgcagcctgatagtcgacttgatggccgaaagtaccgtgcaacaacggttgaagctgacgcagaagattgacggtgtgcgcagcgacttcaaggcactcaaatgccttaaaggtgccgccatttaaaatgtgggagcgggcttgctcgcgaatgcagtgaatcagtcacaacatgtatcgactgaaactccgcattcgcgagcaagcccgctcccacatgaggtctgtggtctatctttttaggcaatctgcgccttcgaagccacttcatcaaacgtcgccggctccagcgcatccgcttggtcatccagcacctcgcgcgggtgatcattgcccggaatggagctatcaatcagcgccagtagctgcgcgccgcgagcggtcaggatgaaattctcaccattaccgccctcttcttccgggcgcgattcgataaacccacgcttgaacagtagcgcctcgtaatccgcagcggtctttttcagcgtatccaggttaccggtggattcacccgccgtggccttctcagccgcctcctgctcagcgtatttacgcggggcaaagctgccttcgccgttctgcacttcatgcagcaaacgttcgatcaaatcccagttgtaagtcgtcatcctgattcctcctgcaggccggtggaaagtagcccgtctaaaggtgtgacatgcctcgtcactggccgttcagctgaatagacagccgtcatttctctgaactttccagacgttcgccacctcaactgaacaccactgccaaggaggtccgaccatgaaaaccctgctaaacctggccatcgccgccacgctgctgactgccctgccggcctgggcgtgtacgcctgaagaagccacggcgaaacgcgaacaactggctcaggaagtgaccaagctcacggagcaaaaccccaccaaagccaaagaaatgaatgcagaactgcagaagatggacatggacacgacggctgcggacttgcctgacaaatgccaattgatcgatcagcgcctcaaagacctcgaaaaagccgccgccgaaagcaaaaactgaaggcataaaaaaaccggacattgtccggttttttcacatcaccctgccttactcggcagccggtgcttcgggcttgcggcgcttgagcggcgccatgccatccttgctcacgagcgacaggttgtcggtcttcggccggttggcgatcttgcgtttggtcggcgacttggcaccggcctttttcttgtcacccttggcgtcgacctttttcttcttcacgccaaccgccttgcccgacgccttgaccttcttcggcccggtgtaggtgcctttgacttccttgatggtgcggcgctcgaacgactgcttgaggtagcgctcgatgctcgacatcaggttccagtcgccgtggcagatcagcgagatcgccaggccatcgttgccggcacgcccggtacggccaatacggtgcacgtattcgtcgccgctgcgtggcatgtcgaagttgatgaccatgtccaggccatccacatccaggccgcgcgcggcgacgtcggtggccaccaggatcttcacgccgccggccttgaggcggtcgatggccagtttgcggtccttctggtctttctcaccgtgcaggacgaatgctttgtagtcctgcgccaccaggcggccataaatacggtcagccgccgcgcgggtgttggtgaacacgatggccttctgataggtctcgttggccaacagccagttgaggatctgctctttgtgcacgttgtggtcggcggtgacgatctgctgacgcgtggtcgcgttcaggtcgctgacgttgttgacctgcaagtgctcagggttgttcaggaccttggcaaccatgtcgcgcaacgtcgaaccaccggtggtggcggagaacagcatggtttgctggcgattcacgcattcagctaccaggcgctgcacgtcatcggcaaagcccatgtcgagcatgcggtcggcttcgtcgagcaccagcacttcgacttccttgaggtcgaggttgccggcgttgagttgttcgatcatgcgccctggcgtgccgatcagaatatccggcaccttgcgcagcatggcggcctggactttgaagtcttcaccgccggtgatcaggccggacttgatgaaggtgaactgcgagaagcgctcgacttccttcaacgtctgctgggccagctcgcgagtcggcagcaggatcagggttttgatgctgacgcggactttggccgggccgatcaggcggtgcaaaatcggcaggacgaaagcggcggtcttgccactcccggtttgagccgtcacccgcaggtcacgcccttcgagcgcgagcgggatggccgctgcttgcacaggcgtaggctcgacaaatttaagctcggccacggctttgagcaggcgttcgtgcagggcgaattgggaaaacacgggtgctacctcgaagaaatacaaaatatcagctgcatagggtaacggtttcgggcgtccaaaccgagtttctttacgcgaacagggctaatcagctgcttttttgtcaggatatttgtctacaacgtcaactttgacgcacttaaatgctctaatcgccccgtgttgtcttacagaagaatcggtttcacccatggatatcaaacagttctggctcaacgtccaagacctttggggcgccctcgatcaacacccgatgctgcatgcgagcttgggtttgctggtgttgctggtggtggccctgctcgttgggcgggtcgcgcgctacctcatccttcacgccgtcaaactgctcggccggcaaccggcgctgcactggctcaatgacctgcggcacaacaaagtcttccaccgcctggcgcagatgacgccgtcactggtgatccagttcggcctgtacctggtgccggacctgagcaagaccgccaccttgtttatcggcaatgtggccctggcgttcaccatcctgttcatgacgctggctgtgagcgccctgctcaacgccctgctggatatctacgcgcgtaccgaacatgcgcgcacccgctcgatcaagggctacgtgcaactggccaagatggtgctgttcgtgtttgccgcgatcattatcgtcgccaccctgatcgaccgttcgccactgttgctgctctccggtttgggtgcaatgtcggctgtgatcctgttggtctacaaggacacgctgctgtcgttcgtcgccagcgtgcagctgaccagcaacgacatgctgcgggtcggtgactggatcgaaatgccccaggtcggcgccgacggcgatgtggtggacatcaccttgcacacggtcaaggtgcagaacttcgacaagaccatcgtctccattccgacctggcgcctgatgtccgagtcgttcaagaactggcgcggcatgcaggcctccggtgggcgtcgcatcaagcgcagcctgtatatcgacgccagcggcgtgcgcttcctgcgcgacgacgaagaagtgcgcatgacccaggtgcacctgctcactgactacatcagccgcaagcaatccgaactcaaggcctggaacgaagcccagggaaacagtgcgcagctgtctgccaaccgccgccgcatgaccaacctcggcaccttccgcgcctacgccctggcctacctgaaaagccacccggacatccagccgaacatgacctgcatggtgcgccagatgcaaaccaccgcccaaggcgtgccgctggaaatctactgcttcacccgcaccacggcgtgggcggattacgaacggatccagggggatatttttgattacctgctggcggtgttgccggagttcggcttgagcctgtatcagcagccgagtggcaatgacttgcgcgcggggatggtgccggcggtgttgggtgccagtcacctgccgaccctcgaacacaactctgcataacaccgccattccccttgtgggagcgggcttgcccgcgatagcggtgtatcagtcaataaatgtgcaaactgacactgcgccatcgcgagcaagcccgctcccacataggttcagcggtggatcgcctctttacgcacacccaaccggctgatccacaccgctccgagaatcaccaacccacccaacgccagcctccccagcggctcatgctgattccatatcagcaagttcagcaacagtcccaccggcacatgcaggttgttcatcaccgcaagggtgccaccgttcaccaggcacgcacccttgttccaccaatacatgccgagcgcggtgctgaccaacccgaggaacaccaacacgccccattgcagcggtgcgtcgggcaggtaattggccttgccgaacagcaggaatgccggcagcaccacgatcaaggcgcccaggtagaaatagccgaagcgccggtagtgcggcaaatcactcggatagcgcgccaccagatgcttgtacatcacctgcccggcggcgtaggtgaagttggccagttgcagcagcaaaaagccgccgaggaagtgcggggtgatctggtcgaagcggatcactgccgcgccgcccaccgccaccagcgcagcaatcagcgcccaagggttgaagcgccggttgagggcgtcctcgatcagggtcacatgtagcggtgtaaggatggtgaatagcagcacttccggcacggtgagcacacgaaagctcaagtacaggcacacgtaggtcacaccaaactgcagcgcgccgatcgccagcatgccgcgcataaacctcggttctaccgagcgccagcgggtcagcgggataaataccaggccagccaacacgacgcgcaccagcacggcgaagtagctgtcgacgtggccggcgaggtattcgccgatcaagctgaaggaaaatgcctgaatcagggtgacaaccagtaaatagcccatgcgcgcctcgtttcgaatgggcgcgactttaagggttttcggcgtttactgaaactcggggcaaaaaaaacccgacctcgctatagcggcagtcgggcaggagcactcaggagcaacaagtgcaaagggaggttcgatacgcgtacttgaagggtttgcgtggggcgatataaacaccacgcgattatgtgacgattaaacgatcacgcgacctgtgccagcagtgctttggcgtggttgatgcccttctcctggaagtcgccgctgaggttcacgccttcggcgtgaatgaaggtgacgtcgtgaatgccgataaaggccatgacctgacgcaggtacggttcctggtgatcggagctggcgccggtgtgaataccgccgcgtgcggtcagcacaatggcgcgcttgccggtcaataaaccctgagggccggtggcggtgtacttgaaggtcacacccgctcgcaacacgtgatccagccaggctttgagggtgctggggatggcaaagttgtacatcggtgcggccatcaccagcacgtcggcagcgagtaattcgtcggtcaattcgttggagcggtccagggacgcctgttcgatgtcactgcgctggtcggcgggcttcatccagccgccgagcaggttggcgtccaagtgcgggaccgggttaagggccacgtcgcgcacggtgatctgatccgccggatgagcaacctgccattggccgacgaactgttgggtcagctggcgggagattgaatcctgctggcgggcgctgctttcgatgatcagaacattggacatggctaggtaggctccatctgtaaatgctgtaaggcgatggagtgaagattaaacagagccaattcgataaaaaagcgcaaaaaactgctacaacccatctagaaatttgtttataagcggagtattgctgtgggcatgctccgctgccggtttattttggagtgcaggtcagtgcgatacgcattttgataatggcgcggctgaaattgaccgtagtgttggtggttttccccgccgcaaccgtgactttgcgagtgcgcggggcttccgggccgttggtaaagcgcaccttgcactccgcatcattggagccgtagttggtcagttggatcgaactgatagtgctgtcgacgtccgacgcgctgtaatcgatcttcacgccctgaatgtctttggtcacatcggtgctgaatgcaaacgcgctcatcggcagcagcgccagcaatacacaacagaattttctcattcggcagtctccaataaggaccgccagcttaggacaagaggagctcatcttgaaagcgccccgcgttaccctcgatcaatggcgcacgctgcaagccgtggtcgaccatggtggcttcgcccaggcggctgaagtgctgcaccgctcgcaatcctcggtgagttacaccgtggcgcgcatgcaagaccagctcggcgtgccgctgctgcgcatcgacgggcgcaaagcggtactcaccgaagccggtgaagtgctgctgcgccgctcgcgccaactggtgaaaaacgccagccaactcgaagaccttgcccaccacatggaacagggctgggaggccgaggtacgcctggtggtggatgccgcctacccgaatgcacgcctggtgcgtgccctcaccgcctttatgccgcaaagccgaggctgccgcgtgcgcctgcgcgaagaagtgttgtcgggcgtggaagaactgttggtagatggcatggctgacctggccatcagcagtttcatcatcccaggctacttgggcacggaaatgagcgatgtggaatttatcgccgtggcccaccccgatcactcgctgcatcgcttgaaccgcgagctgagtttccaggacctggagagccagatgcaggtggtgattcgcgactccggccgccagcagccacgggacgtgggctggctcggtgccgaacagcgctggaccgtcggcagcctggccaccgccgccgccttcgtcagcagcggcctgggctttgcctggttgccccggcacctgatcgagcgtgaactcaacgaaggcctgctcaaacagctacccttggaaaagggcggcagccgcaacccgacgttttacctgtacgcgaacaaggacaaacccctgggcccagccacgcagattctcgtggaattgctgcgcaccttcgacaccgctcccctggacgcgcctttcgccgcgcctgagcaagcctgaaacggagttcacgcatggcctggttcgaccatgaaggctgcaacctgcattacgaggaatacggccacggcagcccgctgatcctgatccacggcctgggctccagctgccaggactgggagttgcagattcccgtgctggcccgccactaccgcctgattgtggtggatgtgcgcggtcatggtcgctccgacaaaccgcgagaacgctacagcatcaagggtttcacctttgacctgctggctttgatcgaacacctggacctgccgcccgcccatgtggtgggcttgtccatgggcggcatgatcgccttccaattggcggtggacgaacctcatctgctcaagagcctgtgtatcgtcaacagcgcgcccgaggtcaaggtgcgcagcgccgatgattactggcagtgggccaagcgttggagcctggcgcgggtgctcagcctggccaccatcggcaaggcgctcggcgaccgactgttccccaaaccgcaccaggccgacctgcgccgcaaaatggccgaacgctgggcaaaaaacgacaaacgtgcttatctcgccagcttcgacgcgattgtgggctggggcgtacaggaacaactttcgaggatttcctgtccaaccctggtcatcagcgccgaccacgactacacgcccgtggcgcagaaagaaatctatgtaaaactgctgcccgatgcgcggctggtggtgatcgaagattcccgccacgccacgcccttggatcaacccgaagtctttaacgctaccttgctcgattttctaaagacagtcgaaaccactacccaggatcactgacccatgctgaaaaaaatcgccttctttgccggttccgtactgttcgctgccaacctgatggctgccgagcccgccaaggcaccccacgttctgatcaccaccaccaacggcgacatcgaaatcgaactggacccggtcaaggcaccgatcagcaccaagaactttctggcctacgtcgacaagggcttctacaccaacaccattttccaccgcgtgatcccgggtttcatggtccagggcggcgggttcaccgcgcaaatgtcgcaaaagccaaccgaagcgccgatcaagaacgaagccagcaacggcctgcataacgtgcgcggcaccctgtcgatggcacgcaccaatgacccgaactcggccaccagccaattcttcatcaacgtggccgacaatgcgttcctcgacccaggccgcgacgccggttatgccgtgttcgccaaagtggtcaaaggcatggatgtggtcgacgtgatcgtcaactcgcaaaccaccaccaagcagggcatgcagaacgtgcctatcgatcctgttgtgatcaagtcggccaagcgcatcgactgaggtctgcaggtagctccgcgcgtggcccacaaggccacgcgcgcatttgaacaggagagcccgccaggcgggcgtcaacctaatgctctatcgtcgttttgaacaactgatcgacatcttccgcgccgcgcccagcgacgccccccccgacaaagtcctgcccttctacctctactacctgcgccaagtgtggccgagctttgccgccctgctggtggtcggcctgatcggcgcgctgatcgaagtggcgttgttcagctacttgagccgcatcatcgacctggcccaaggcacgccgcccgccaacttcttccaggttcacagcgccgagttgatctggatggccgtggttgccctgctgctgcgcccgatcttcaacggcctgcatgacttgctggtgcaccagaccatcaaccccggcatgaccagcctgatccgctggcagaaccacagctacgtgctcaagcagagcctgaatttcttccagaacgacttcgccgggcgcatcgcccagcgcatcatgcaaaccggcaactcactgcgcgactcagcggtggcgaccgcggaagccatctggcatgtgtcgatctacgcgatcagtgccctggtgctgtttgccgaggccgactggcggctgatgattccgctgatcatctggatcatctgctacagcctggccttgcgttacttcgtaccacgcgtgaaagagcgctcggtgatctcctccgaggcgcgctccaagttgatggggcgcatcgttgacggctacaccaacatcaccaccttgaagctgtttgctcacacgcaaaatgagcaggaatacgccaaggaagcgatcatcgagcagaccgaaaaaacccagctggccgcccgcgtgctgaccagcatggacgtgaccattgccatcctcaacggcctgctgatcgttaccaccaccggcctggcgttgtggctgtggacccagtcgctgatttccgtgggcgcgattgccctggccaccggcctcgtaattcgtatcgtcaacatgtccggctggatcatgtgggtggtcaacggcattttcgaaaacatcggcatggtgcaggacggcctgaaaaccatcgctgcgccgctggcggtgaccgatcgcgagaacgccccgcgcctgaacgtgccccatggcgaagtgcgtttcgagcaggtggattttcactacggcaagcaaagcggaatcattggtggcttgaacctgaacatcaaagccggagaaaagatcggcctgatcggcccgtccggcgcgggcaagtcaaccctggtcaacctgctgctgcgcctgtacgacctgcaaggcggacgcatcctgatcgacggccagaacatcgccgaggtcgcccaggaaagcctgcgcgcacagatcggcatgatcacccaggacacttcgctgctgcaccgttcgatccgcgacaacctgctgtacggcaagccggacgccaccgatgaggaactcaacgccgccatccacaaggcccgcgccgatgagttcatcccgctgctgtcggacgccgaaggccgcaccggcttggatgcccacgtgggtgagcgcggagtgaaactctccggcgggcaacgccagcgcatcgccatcgcacgggtactgctcaaggacgcgccgatcctgatcatggacgaggctacctcggcactggactcggaagtcgaagcggcgatccaggaaagcctggaaaccctgatgcaaggcaagaccgtgattgcgattgcgcaccggttgtcgaccatcgcgcggatggacaggctggtggtgctggaaaaaggccagattgccgagaccggcagccatgccgagctgctcgcccatggcgggctgtatgcgcggttgtggcagcaccagaccggcgggtttgtcggcatcgactgaggctgacaacgctgaaccctgtgagagctggcttgcctgcgatagcgcagtgtcagtacccaattggctgcctggcacactgcaatcgcaggcaagccagctcccacacttaacagcgtcaggcagcctattcatgaggccgtggcgttcgggctcacggtgttgaccttggcgttcgccattgggtatgtcagcggccgtcatctcaacccggcccgcagtaccggcccggcactgatcgttggcgggtgggcgatccagcagttgtggatgttctggctggcgccaatcctcggcgcagtgatcggcggcgtgacctatcgatggctgggcaaggaggactcggcctgaggcaaacgggttcagccctgccgataaggcagggctgccctcgcctcttcggcatacgccagaatccccacgcgctcgcgctcgaggaaatcctcgacggcatgtttcaagcccgggtggcgcaggtagtgccatgaacgcgtgatcaccggctcaaacccgcgaatcaacttgtgctcgccttgggcgccggcgtcgaagcgttgcaggccgtgggcgatggcgtagtccatgccctggtagaagcaggtttcgaaatgcaggcggtcgaattccgccaggcaaccccaataacgcccgtagaagctgtcgccaccgatcaggctgaaggccatggctaccgggcgtgtgccctgtttggccaggaccacgcgaatcgcctcgggcatgcgctcggccagcacgctgaaaaacgcgcgggtcaggtacggcgactggcggcgcacggcgtaagtgttggcgtagcaggcgtagacgaaatcccactgcgcttcactcagctcatggccttgcagccattcgaactcgatgccctgcccggcgacttgctcgcgctctttgcgcatctgtttgcgcttgcgcgaactcaaggcgtcgaggaagtcctgaaagtcgcgatagccacgattctgccaatggaactggcagcccaaccgctgcagccagcccggctgcgtcgccagtgctgcgtcggccaacgggtcggtgaagttgatatgggcactggaaagcccttctatttccaggtagccgggcaggctgttcagcagctcaaaaccgtcctcggcgttcctcgtcaataagcgcggcccactgaccgggctgaacggcaccgccgtgagcaacttggggtagtagtcgataccggcgcgctcgcaggcatccgcccacccgtgatcaaacacgtactcaccgtaggaatgccatttgcgataaccgggcaatgccgccaccagccgatcgccctcccaatgcagcaaatgctcaggctgccagcccgaatgcgggcccaggctggcgctgtcttccagcgcactcaggaacgcatgccgcacaaacggctgggcctgcggcacaagggcatcccaaacctctggggcgatttcggacaggctgtccaggcgttgcaacggcatcggcatcctcactacatcggggcgtgaaagcttcgcgagtatcgcttatcgccaggcaatacacatcttcaaatcgcgcgacaagccccaaaaccaatagttccatttctaaatattttgtcatctacatgacatcacttagccacttcaccgtcataagtgatcgtgatactgacgcctgtttttagagcgcctggttctagcaggcggctattttccgtccgtcatcggtcggttgtgtcctggatggtttgccatccctcctcactttcggagattgatatgcgtcttgcttccactaaaactgcggcggtcctgtgcggcggcctgttactggccctgagcggtcaggccagcgctgcagtcgacgctaagttgctcgacatgctcaaggccaacggccagatcaccgctgcgcagtacaccgaactgcaagcggaattggccaaggaccagaaagaaaagcagatcgcacagcaagctcaacaagagaccaacgagcagatcgcggccaccgcgaaaaaaaccaacgagttgagcagcttcgaccagaagctggcctgggccgccaagacccagttcaagggtgacgtgcgcttccgtcaggaaaccgtgaagatccagggcgaatccaacaacggtggccgcgacaaggaccgtcagcgcatccgtgcccgcctgggcgcttacaccgagatcaactcgcaggtcgacaccggcattcgtatcgccaccggcagcagcgacgacgcgcgctccaccaaccaggaccaggacaactacttcgacaagaagtcgatctggctggacctcggctacatcgactaccacccggaccagatcaagaacctgcacgtgatcggcggcaagatgctgcagccgtgggtaaacatgggcgacgtgatctgggatagcgacatcaacccggaaggcctggccctgacctacaaatacccactgggcagcagcgccgagctgttcggcagcctgggtaactacaacctcaaggacaacgtcgatggcgacggcgtgcaatttcgccacgacctgcgcctgacgtccggccagctaggcacgcgtttctcggtcaccgacaacctgaaaatgaccttgggcggcagcgtctacgcctaccagaacgacaaggacagccgttgcacaaccaccaccacgccgtgcgcactggcggtcaatggcaactcggccgacaaccaattccgcctgtatgaagggttcgcccaggctgacatcggtggcttggcagtgccgctggcgttctacggccaatacgtgaaaaacaacgatgccgtgaccgatcaggacaccgcctggctgatcggtgccaagtccaaagtgttcggtttcaacctggactacaactaccgcgacatccagcgtaacgccgtggtcggcgctttcaccgattcggacttcgccaacggcaccaccggttcgcgcggtcacaagatgaaggtcagctacgacatcgacaagaacttcgccctcggtgccacgtacttcctgaccaaggcagactacgccagccgcacgcagcgtgacgccaacaccaacaccctgcagctggatgctgaagccaagttctaatgggtgtgcaataaaccttgggccaggacggcccgaggtggtttcaacagccttgcgtgggtgggtcgatccccatcatccgttcgactcacccacgcgagcctgcaatattcccgcttttactgatccttgagccgctcggccaccagccgatcagccaacgcatcagcatccttgaccggttcttccggcatgatcttcaacgtcgcctgcatcaggcgcatctgacgaatgaaccgccggcagttagggcaaaacatcaagtgatgacgcaccagcagacgctcgcgaaaggtcaattgcccatcgagatagtcactggaacgtgccacttgttctttacaggtcaacattcgcccgtttcctcaaaatgctccaccgtggcgaagactttaagccgtgctcgatgcaacagcacacggacattggagagcgacaacgtcagaagattacagatttcctccaactccaatccctggcgttcgcgcagcaccagcacgctgctttgcagttctgacaaactcagcaacgtatgttccaggcatttgcgcaattcatcctcggtcagcagtgcttccggggtgtcctggtgccaggcgtaaggcgcgacggcccagtggccatcgtcgggggtgaagcgttcatcaccaatggtgccgtggggcgaaggcaaatcgtcgagcaacacttcccggcgattctgtttgtaacggcctttggcggagttggcggtgatggtcagcagccaggtcttgaggctggagcgcccttcgaacttggcgaggttgcgcaccaccgacagccaggcgtcctgcaccacttcatcggcgtggcgctggccgacgatggcataggccactgcgcgcatggcgctctggtaggtggtgaccaattccttgtaggcccgctgctcgcccttgagcaaccgttcaagcaggtgcgtgtcgtccgctgctgccatcgtttacctcaatcctgctgtggaaatccgccacctgtgggagctggcttgcctgcgatagcggcggtggctgcactatcgtcatcgcaggcaagccagctcccacattgaccgcaatctgcctcgatattaacgtttacgcaggatcacgctgccgatcgaataacccgcgccgaacgagctgagcactgccacagaaccttttggcaaatcatcctggtaggtgtggaatgcaatcaccgagcccgccgagctggtgttggcgtaggtatcgagaatcaccggtgcttcttccaccgaggcttcgcggcccagcagctttttcacgatcaggtggttcatgctcaggttggcctggtgcagccagaagcgcttcacgtcagcgacgttcagctggttttcttccaggtgcacgccgatcagttcggcaaccatcgggcagacgtcccggaataccttgcggccttcctgcacgaacagcttgtcgggggcgccaacgccctcttccgcggtgcggttgaggaagccgaagttgttgcggatgttgttggagaacttggtcagcagcttggtgctcaccacgtcgaactggtgctcggaggtcgccaggtcggcgcgttccaggaccactgcggtggccgcgtcgccgaagatgaagtggctgtcacggtcacggaaattcaggtgcccggtgcagacttccgggttgaccatcaggatcgcccgcgcctggcccagctggatgctgttggcggcgttctggataccgaaggttgccgacgaacaggccacgttcatgtcaaagccaaagccttcaatgcccagggcttcctgcacttcgatagcgatggccgggtaggcgcgctgcaggttggagcaggcgacgatcacgccatcgatgtcggcggcggtcttgccggcgcgctgcagggcctgttcggcagcgccgacggccatctggcagagtaccgaccactcgtcattgctgcgctcaggcaggcgcggggccatgcgctgcgggtcgaggatgccgtccttgtccatgacaaaacggctcttgatgcccgacgccttctcgataaaggccgcactggactcggtcaatgcctgcacttcgccacgttcgatagcggccgcgttatccgtattgaactgctgcacataggtattgaaagactgcaccagctcttcgttggagatgctgttggccggggtgtacaggccagtgccgctgatgacgacgttatgcacggtcgttcctctaaatctgtcaggcagaagatattggtaccgtcgtaccaaactttaagtcgttcgattccgtccagcggtcatcaaactggcaacgctttattccatcgcgccgtggctgagcaacagcccattacgacgatcccggcatttataagcgcgaagtttgccacaacctcggagttttcgcgccatttcccggataaaccccgtgctgactgtgggagctggcttgcctgcgatgcagacaccgcggtgtatcagtcaaaccactgggatgccatcgcaggcaagccagcgcccacaaaccggggcagccgggagggcttcaggcctccacctggctccatcgcttgctcaaacgcttgtcggaaatcggcactttggtgcccaactgctgggcaaacaatgacacccgatactcttccagccaccagcgatacagctccagctgcgggtcgcgcttgccttcctgggtgtgtttgttcaagcgattctggtactgcgcccagaggccgcccagttccgtgctccacacgcgatctttctgcacctggcttggcagtttttccaggcgcaactcaatggccttgaggaagcgcggcagttccttgaaccactgcgccggggtttcccgcacaaaaccgggatacaccaggttgctgagttgctgcttgatatcgttcaaggctaccgcctgggccaggtcgatcttgcccttgaagcgcttctgcaagccatgccatagcttcagcacgtccagagtcaggcgcgccaggcgctcggcgtgttcggtccagctgccacgcttgcgttcggccaatgcggccaagccagcaccgtcgcgcggcaggctggcctcgccttccagtacgcaggtgtcgaggctggccagcagaatgtcttccaccagcgcgtcgatgcgccccagctcgcggtacatcaggcccaactcggtcaaccccggcaatttgccacgcaggaatttcgccggctccgccaattgctgcatcagcaggcgttgcaaggcgcggcggtgctggaactcggcctcggcggcggtcgagaaacgtccttccttgaccgtgccgttttcttcaaccagcgccgggtaaaccgtcatcgacaggcccgcgatcttttgctgggttttctcggccaccgccgcaaacaccttggcctcgaccggctgctggcttttggcggtttgcggcacggccaacgctgcctggctggcttcggcaaagcgtgcggtcagttcagccaagtcgcggccttcgccgaggaacttgccctggccgtcgaccacttcaaggttcatcttcaggtggttttccacctgctgcgccgcctcggcccaggcttcatcgctgacgcgtgcgccagtcatgcgcagcagttcgcgccccagcgcctggggcaacgaaccctggccgaactcaatacgttgcagcgccgccttgacgaaatccggcaccggcacaaagtttttgcgcagtgccttgggcaagttgcgcaccagcgcgatgcacttggcttcgatcacgcccggcaccagccactccaggcgctccggcggcaacgccggcaacagcggcgccggcacgcgcagggtcacgccgtcgcgcgggtggttgggctcgaagtgataactcagcgccaactccagatcgcccaagtgcaaggtgtccggataatgcagggccgtgacttcgctggcctcgcgggccagcacgtcttcctcgcgcatgatcagcagttgcgggtctttctggctgttgaccttgtaccagctgtcgaaggtggcagtctggtggatctccgccggcaaccgcgcgtcgtagaaggcgtagagggtttcttcgtccgccaggatgtcccgacggcgcgccttggcttccagctcatcgagctgctccagcagttgctgattggccgtcaggcacttggcccgggactgaatctcgccacgcaccaaaccctcgcggataaacagctcgcgcgacaccaccgggtcaatcggcccgtaatgcacagggcggcgccccaccacaatcagcccgaacagggtgatctgctcaaacgccaccacttggccgcgcttcttctcccagtgcggttcgaagtggttcttcttgatcaggtggcccgccagcggctcgatccaatcggcatcgatcttggcgaccatgcgcgcatacagcttggtggtttccaccagctcagcggtcatcagccattgcgggcgttttttgccgatgcccgaggacgggtgaatccagaagcgccgctgacgcgcgccgaggtaatcgccgtcttcggttttctggccgatctggctcaacaggccggacaacaccgccttgtgcaacttggcaaaatccgccggctctttattcaccgtcaactgcatgtcgcggcagatcaggctgagttggcgatgggaatcacgccactcacgcaggcgcaggtaattcaggaagttcttgcggcaccagttgcgcaacgggctggcggtcagttcctggcgttgttcttcaaacccgcgccacagattcaccagcccggcaaagtcagagtccgcatctttccactgcgcgtgggcctggtcggcggcctgctggcgctccggtgggcgttcgcgcgggtcctggatcgacatcgcgctggcgacaatcagcacttcctgcaagctgccgagtttggcggcttcaagcagcatgcggcccatgcgcgggtccaccggcaggcgcgccagctggcggcccagcggcgtaagctggctgttgcggtccaccgccgagagctcttgcagcaggttgaaaccgtcgctgatggccttgccatccggcggttcgataaacgggaagtcggtgatttcgccaaggcgcaggtgcagcatctgcaggatcacggcggcgaggttggtgcgcaggatttccgggtcggtgaattccggccgaccgataaaatcttcttcgctgtacaagcggacgcaaatgcccggctcgacccgcccacatcggcctttacgctggttggcgctggcctgggaaatcgcttcgatcggcaggcgctgcaccttggcgcggtagctgtagcggctgatgcgcgcggtgccgctgtcgatcacataacgaatgcccggcacggtcagcgaggtttcggcgacgttggtcgccagcaccacacggcggcctgggtgggactggaaaatgcgctgctgttcggccggtgacaggcgcgcgtacagcggcagaatttcggtgtgcttgagttgggccttgcgcaacatgtcagcggcgtcgcgaatctcgcgctcgcccggcaggaacaccagcacatcgccggggctgcggcgttcgctgcgctcataggcggcgatttcatcgagggtggcaaggatcgcctggtcgacggtcaggtcgtcctcgacgcggttgccctcttcgtcctgttccagggtcagcgggcgataccaggtgtccaccgggaaggtgcggcccgaaacctcgacaatcggcgcgtcgtcgaagtgcttggaaaaacgctccaggtcgatggtcgccgaggtgatgatgactttcaggtcggggcgacgcggcagcagggttttcaggtagccgagcaggaagtcaatgttcaggctgcgttcgtgggcttcgtcgacgatgatggtgtcgtagcgttccaggtaacggtcgttctgggtttccgccagcaggatgccgtcggtcatcagcttgatcagggtattggaatcactctggtcttcgaagcgcacctgatagccgaccagcgcgcccaacggcgtggccagttcttcggcgacacggctggcaacgctgcgcgcggcgatccggcgtggctgggtgtgaccgatcaggccgtattggccgcgaccgatttccaggcagattttcggcagctgggtggttttacccgagccggtttcacccgcaatgatcagcacctggtgcttgagcagcgcgtccttgatttcgtcgcgcttggcggcgatcggcaggctgtcgtcgtagcgaatcaccggcaggctggcccgccgcgccgtgacctgggcgcaggacgcctgcatgcgcgtgacccactgcgccagcttctcctcgtcgggtttcttgcgcagctcgagcaactggcgccgcaagcggtggcggtcggcgagcatggcgtggtcgaggtttttcagcagttggtcgatggtgggcgcttggtcggtcatcaggtacttacgagggcgtctatttatgcacggcctgcaagtgtggcagaaaagcagcttatctggcagacggcgatataaatgtgggagcgggcttgctcgcgaatgcggtgtgtcagtcaccttatttatcaactggcacaccgctttcgcgagcaagtcgaaccgtcgcaccgccgctcccacaggaatatgcgtttacagcgggtctttgcgtcggtacgggaatacgtcgataaccttgccggcgcgaatcgcctcctgcaggcccttccagtagtcggcgttgtacagctcgccatgcagctcatcgaacagcttgcgctggccggcgtcggcgaacaggaacggcgggaattcttcggggaacacatccagcgggccgatcgagtaccagggttccgaggccatttcatcctccggcgtgcgcggtgcggggatgtggcggaagttggcctcggtgagaaagcagatttcgtcgtagtcatagaacaccacacgaccgtggcgagtgacgccgaagttcttcagcaacatgtcgccggggaagatattcgccgccgccagttgcttgatcgccaaaccgtagtcctccagggcttcgcgcacctgggcggggttggcgttgtcgaggtaaaggttgagcggggtcatgcgccgttcggtccagcagtggcgaatcagtacggtatcgccctccacttctactgtgccggcggcgacttccagcagttcggccaggcactcgggttcgaatttgctcaggggaaagcggaaatcagcgaactcctgggtgtcggccatgcgccctacgcggtcgacgcttttgaccaggcgatacttctcgatcaccgtggcgcggttgacgtttttcgacggcgaaaagcggtccttgatgatcttgaacacggtgttgaagcccggcagcgtaaacacgctcatgaccatgccgcgcacgccgggcgccatgatgaactgatcatcggtggtggccaggtggttgatcagcgcgcggtagaactccgacttgccgtgcttgtagaagccgatggaggtgtacagctcggcaatgtgcttgccgggcaagatgcgccgcagaaagccgatgaactccgccggcaccggcacatcgaccataaagtaggagcgggtgaacgagaagatgatcgacacatcggcttcgtcggtgatcagcgcgtcgatctgaatgccgcgcccttcgcggtgcagcagcggaatcaccaggggccactgctcgtcgcgggtgtagatgcgcccgaccagataagcgcctttattgcggtagagcactgaagaaaacagctcgacgttaaggtccgggtctttgcacacccagtccggcaggttctcgcgcagttgggcttcgaggcggcgcaggtcggccgccaggtccgcgtagggctcgctgaaggcgtaatcggcaaagatctgcgccagcatcgccgccagctcgcccgccggcttatacacacgggtttgcgctgcacgcgcgcggcgcaggctcggccgcgtggtgtggatgaacatgcagccatcgctgatcaggtcatggctgaacaggccgcagaagatcgagttgtaccaggtctcagacaattcatcgtcgaggcgcacgtcgatcaggccgatgtacgcgctcttgaccaacggccacacgtcgacgtccagcaacgcagcctcgtcaatgccagcccgcagatgcgccgtcacttgcgcgactttttcttcatacaagttgatacgcgccgccgatgccgcttgcccctgctgccactgcgcctgctcaaaccgttcgcgagcgcccatggtgatctggcgaaaatgctcacggtaatcgtcgaagccgtcgaggatcatgcgagcgatagcaagggcggactgcgacatgcggaaacctcgaacggttggctggaagccctgagcttagccagtgaacgcaggcaggagaaggacgatttttcgggctgcgttgtacaactttgttcaaatcgtacatttactttcaatttttacaattcgaccaatcggtcaataaaagcacccttaagtcgcaccgacatcagccgaaggcccgcaaggccgtggcctgacgctagcaccaggaaaaacccggttctgtgtgaattcacagcttatgtaactgaactgatacaccgtaagggaaaccccgattaccaccttaatggcactttgatatatagcgcgccctctcccaccctaacaaggtctgaagaccgatccgggaacaggttcaaatcgcctaaggagcattgagatgtcattgaggaatatgcggatcggtctgcgcgccagtctgagttttggggttttggccagcatgctggtgatcgtcgggatgtttggcctcggccagatggccaagctgcgggaaagcgcgctggtcatcgaagaatcgtggatgccgagcatcgagaatatccacgacgccgcagcttacgtcgccagcattcggctggaagcgttgcgcctggcaaccaccgatgagtcacgcattcgcgacaacagcaaaagcctgatcacccgccagagcacagagctgcaaagcctgctgaaaaaccacgaaggcctgaccagtggcgatgacgaagccgagctgttgaaaaagcttaaaggcaacgtggcgacctacctgaccatcgtcggccagatggttgcgctggtggacaaggaccagcaacaagacgccatcgacctgctcaccagccgcctcgccccccagggcactgtgctgaaccagagcctggaagacatcatcaccttcaaccagaaaggcgtcgaggacgcggcagatgcggccgcacagatgtactccaacgcgcaatgggtggtcggcctgatcatcgtcagtgcactgatcgccacgctattgctggcctggttgctgacccgcagcatcaccacgccgattggccaggcgttggcggtggcgcgcagcattgccgctggcgacttgagccagccgattgtggtcagcgggcatgacgagccggcgcagttgctgaccgccctggccgccatgcaggaacagctgcaaaccaccattcgcggcatcagtgaatcgtcgcagcaactggcctcggccgccgaagagatgagctcggtgatggaacagagcacccgtggcctgcaggcgcagaacgatgaaatcgaacaagccgcgaccgccgtgaacgagatgagcgcggccgtggatgaagtggcaggcaatgcggtgtccagcgccgaagcctccaaggcctccgatgaagacagcaagcacggccactaccagatcagcgaaaccatcagctccatccagaacctggtggacgaagtgctcggtgcctcgaacaaggccgaaggcctggcggtgcaggcccaggacatcagcaaagtgctggaagtgatccgcggcatcgccgggcaaaccaacctgctggcactcaacgcggccatcgaagccgcccgcgcaggcgaagccgggcgtggctttgcggtggttgccgatgaggtgcgttcgctggcgcagcgcacccaggactctaccgaagaaatcgagcagatgatcaccgggatccagcaaggcacccaggacaccgtcgacgccctcaacagcagcgccgaacacgccggccagaccttgcaacgggccaacagcgccggcagcgcgctggaaaaaatcaccgcggctatttcgcagatcagcgagcgcaacctggtgatcgccagcgccgccgagcaacaggcgctggtcgcccgtgacgttgaccgcagcctggtgaacattcgcgacctgtcgacccaaaccgccgccggtgccacgcaaacctcggcggccagccaggagctgtcccgcctggcggtggacctcaacggcctggtgacgcggtttgtcctgtaattagcgattgtgtcgagcaggcccctaggcaacactcgccgccttattgatggaggcgtgttttgtgagacctgtcgacaccctgtacctgctggggctggctgccatctggggcgcgagcttcctgttcatgcgcattatcgcgccggaaatcggcacggtgccgaccgcgttttttcgcgtgtcgattgccgccgccggtttgctggtgattctcacgctgatgcgcgttaactggaatttccagggcaaattcaagaccgtcctgctgctgggcgtgatcaactccgggattcccgcgaccatgtattcagtggcggcccaagtgctgccggcgggttactcggcgatcttcaacgccaccacgccgttgatgggcgtgttgattggcgggttgtttttcaacgagcgcctgacgccgtcgaaaatcgccggggtcagcctcggcttgttcggcgtgggtgtactgacccgcgccgggccggtggcgtttgatctggaattgctgatgggcgccctggcctgcctgttggccaccacctgttatggcttcgccggctttctcgcgcggcgttggctggatcaacgcggcgggctggacagccggctcgctgcgctgggcagcatgcttggcgccacgctgtttctgttgccgttttttgcctacagcgcgatcagccatccgcctgcgagctggggtggctggcaggtctgggcgtcattgctcgggctggggctgctgtgcacggcgtttgcctacatcctgtacttccggctgctgtcgtccatcgggccggtcaagtcgatgacagtgacatttatgatcccgccgttcggcgtgttgtggggcgcgttgctactggatgagccattgtcgatggcgcatgtgtatggcggagtgttgattgcgggggcgttgtggctggtgctgcggccggggaaactggccaaggcgctgtaggcgataacgcccacacccagaccggtgtgggctcgctgtaatgcctgagaggccggtcaatcagtcgaaggtttcagcctgggcaaaacggacggcattggtatctttggccgacagcgtaggcggcccggaaatcggccactcgacggccacgtcagggtcattccaggcaaggctgcgctcatgctcaggcgcccagtaatcggtggttttgtacagaaactcagcgctgtcagacagcacgacgaagccgtgggcgaacccctcgggtatccaaagctgggcgcggttgctttcactgaggtacgtacccgcccactggccgtaggtgggcgagcttttacgcaggtccacagccacgtcaaagacttcgccctgtatcacgcgcaccagctttccctggggctgcttgatctgataatgcaggccgcgcagcacgcctttggccgatttggagtggttgtcctgtacgaaatggactgtccttccaacagactcctcgaaaaccctctgattgaaactttcgaagaaaaacccgcgctcgtccccgaaaactttcggttcaaacagaataacgtccgggataacgagggaagtggctctcatctttagggggtctccaacaggttatcgggccagcttggcggcgctacgggtcgcctgaaccttaaggcagcgacacggggcgccgcgttccacgcaggccttcaaaaaatcttgtcatgcagcaaacgcttgaggtattggccataaccatttttggaaagtggcaccgcaagcctctccaactgttcggcatcaatccacttctggcgaaacgcaatttcttcagggcacgccactttaagcccctgacgatgctcaagcgttgcaatgaagtggctggcctgcagcagcgagtcatgggtgccggtgtccagccatgcgtagccacgccccataatctcaaccgacagcttgccgcgctccatatacagacggttgagatcggtgatctccagttcgccacgcggtgaaggcttgatgctcttggccatttcaaccacgtcctggtcatagaaatacagaccggtgaccgcgtagttcgacttgggttgcagcggcttctcttccaggctgatcgccttgccctgggcatcgaattccaccacgccataacgctccggatcggtcacgtggtaggcgaagacactggcgccgtcctcacgctgcatggcgttcttgagcagctcattaaaatcatggccgtggtagatgttgtcgcccagcaccagggcagacaggtcattaccgatgaagtcctcgccgatgatgaacgcctgggccagaccatccggagacgcctgtaccgcgtaggaaatgttcaagccccagttgctgccatcgcccagaagttgctcgaagcgcggggtgtcctgtggcgtggaaatgatcagaatgtcgcgaatacccgccagcatcagcgtggtcagcgggtagtagatcatcggtttgtcgtaaaccggcagcaactgtttggaaatagccaaggttgcagggtgcaggcgcgtgcccgaaccaccggccaaaataattcctttgcgtttttgcatagtcatttctctagaatttctttaagcatccgtgccacaccgtcttgccagtcaggcaagcacagtgagaaggcattctgcagtttttgagtattgagcctggagttgccaggacgtttggccggtgtgggataagcggccgtggttatcgcgccgacggcggccgaagggactttgagcaccacgcctgccgcctgcgcctgctcgagtacgaagcgggcgtagcgatgccaggtggtttcgccggctgccgcgagatggtagatgccgtgcaattgagggttcaaacgcaccgcacggatgccatgggcggtgacgtccgccagcaggtccgcacccgtgggggcaccgaactggtcgtcgatcacattcaggctgtcacgttcggcggccaggcgcagcatggttttggcgaagttattaccgcgcgccgcgtacacccaactggtgcgcaggatcaggtgcgcgcaacccgcgtcctggatcgcctgctcaccttgcagcttggtcgcgccatacacgctcaacgggcccaccgggtcgctttcctgccagggtgcatcacctttgccgtcgaacacgtagtccgtggaatagtgcaccagcaaggcattcagcttgcgggcttcggttgccagcaccgccggggcctcagcgttaatacgcaacgcttgatcaggctcactttcggctttgtcgacggccgtgtaagccgctgcgttgacgatgacctcaggcgcaaaccgttgcacggtagccgccagcccttgcaggtcgttcaagtcaccacagtagtcgcggcctttggcgtccaacgccaggacttgccccaaaggcgccaggctgcgctggagttcccagccgacctggccatttttaccaagcagcaggattctcatacagagcgctcgacgtagagcgtcgctacccggcccaatgccacgtttgcaccgataaaacccgcactgccggttaccaaaatagtcattgagttaaatcttttcagtaatgtcgcaaggatgagccagaagtgtcccatcaacgtccgccgattcaaaccggccaatcgaaaccctagcactcgtctgataaaaccgctcgcacgattaacaggcacgcaccagcacgttgccactcgcgaaaaaccctcgactgaaaccggcggcttcgctaagcccgccgccacctgcaaaggcgcttattacttcttttaaaataataacttacacaataaacagcggaattattacagcattgccctacaggtacaacaggacccactgaacaccgagggggaatttcggcgtgtatccacggccccctcggcgctcacaaacgcgcttttagcgtttgctgaacacaaacaccaacccgatgatgatcaagaccatccccagcaggctcaataccgcgagccgattgccaaagatcagatagtccatcaccgccgtcactgccggcaccaggtagaacaagctggtgacattcaccagattgcctcgggcgatcaggcggtacagcaacagtgtcgccagcaatgacaccaccagccccatccacagcaccggcaggtaaaagccggcactgtgttcaaaggcaaaggattggaacggcacaaacaccgagcacagcagcaacccggcgaaatactgcaccggcaacgtacccagagggttgtcggtgatgcgcttttgcatgatggaaccgacggtcatgctcaccagcgccagcaacccgaacaccatccccgcaagcgacatacccgacaggccgatgccttggtagaccaccatgatcaacccggccaaccccagccccaggccgaacatccggccccaggaacgttggcgctccatcagcaccacagtgaggatcggctgcacgcccatgatggttgccatcacacccggcgtcactttgaggttcagcgccagcagatagaaaatctggtaagcccccaacaacaccagcccggtcgccgctgcatacaccatgggcttgcccggacgtggcagtttcagtctaaggatcggcaccaggatcaccaggcccgccagggcaatggcaaaacggatcaacagaaaagcaaagggcgaagcatgggcaaggcccaacttggagaaaatcgccccgctgctccacagcaggacaaacaggctcgtcgaggccgccgcggccacggattgtttcgaaaaaacagacatggataccacctgtcatcaggcaaaaagccgattcagcgaacgctaaagcccgaaggttttagctcagtaggtttttttcaggcgggcacaggggaacagcgtttcgctgatcagcccgaaatgccaacacccggcggtgatacgactgcgtacaccggcgtgctactgacaggtggggggtattgaccgatctgcgcaggctgctgattcccgcacggcacgaccacagcgttgaacgctgaatcgactaccgctatgcgttgggaagcaggcatgggctgatcttgtgtgaaaggtaaagaggcgatgactataaacactcgtcgacatactttgcaatgagcctcgccaagccccacccgcgtggaggagttttcactttgagggccaggcacggtcgctataatgccgaccagtttttatccaaggatttcatatgctcgctctgccctggctgtacctggcgcttctctcgattggctatgtactggccttgtcctacgggcaactcggcgtgctggcggcggtctcggtcgccctgctgctgattgccgggtacgccgtgcgccagcaacgcacaccgtgggcgcgctacctcggccatgggttgttcatcgtcttggccctgggcttggcgatgcactggctgcccggtttctacaacggccgtggcattgacccgcagcgttttacccctgacgccgtgccgttctcgatgtacctgaaccaggacaaaccgttgataggcttctggctgttgctggcctgcccctggatcgttgcgcggcgttcgctgcgcctgacgatttgcgtctcggcgctggccttggtcctgacggcgattgccgcgctgggtggcgcggtgttgttaggggtcaccagttgggcaccgaaatggccggaacaagcctggatctgggtgctgaataatttgttactggtgacgctggtggaagaagcgttgtttcgaggctacatacaaggtggcttgagccagcggttcaaacatctgccctacggagaaaacctggcgttattgttggcttcgctgttgtttggcctggtgcatttaggcgcggggtggcaatggacgctgctggcgggcattgcgggggttgggtatgggctggcgtatcggtttggtgggctgggggcggcggttgtcacgcatttcggggtgaatctggtgcatttcggcttgtttgtttatccgatgctggcgtgaacgcctacccgtttatgaaccgtcaaatacggctgctccgctcacccgccatgatgatcaccgcggcgcccaagcaagggattgcggccgccaggcccagcacgaataaacacgtcgacgtgagcgcggactttttaatgagcattgccgggagcgcaataaggcttccgatcaaaagttcgaatgcacgaaagggcagaaggtagaacgactgaagggggttggcgaacagtagtcgctgcgagaaaaacaacgaaataaccagcatggaaacaagcgcgacaggcaaaaaccgtcgtgaaacttttgaacaggccaaaataatcaggggaagaatatataaaactgttcttcgatacccaacgaccataaatgcaaaaattgcagaatcggcacaggcgcgccactttccagagcaggtcacgatgcacataaacggctgaagggacaccggcgcgatggccttaagccataagcgtcaatgggtgggcacgcgcactcgcggagcggccctgcgcctattgcgggtaacccattaaccgccagccgcggcccccgggacaactacccgatgacgtcgggtttgtgataatttcccgtgcacctgaacaatcagcccccagttatggtcaacgtgacgttgtcgatggttattttcgagccttgcatcctggatacatcgttggtgcatctgccttgtaaggaagcgtctgtgtgagtatcgcctcccccgccaccttgagtgctcctctgaatgatagagggtggcacttcgcatttaccgtatcggccggcctgccctgcccgacaacttccacccttcatcatttttctttcaatgaattgaatgagcgccaataaatggacttttttccctgcttcctttccgtcgtatttgttgttcgcaaccaatcaaacaatattgaaagctacctcgccgacgccgcagctatcatttccaccatcgtcagcgattacgaattaatcattgtcgataacgcctccgatgacgacagtattgcgacgctcaagcgcctcactgcggaaacggggctggccaacctgcaggtgtacgcactgaccaaggaagtggataccgacaccgcttcctgggtaggcctggaaaatgcgctcggtgatttcgtggctgtcattaatccattactggatgacatcagctttattccgcgcatcctcaaagaggccgccaacggtgcggatgtggtgtttgccaacaatgagcaaaagccgtcacaaagcctggcgtaccgcggtgcaaacgccatttttcacgggttatataacaaactcaacggcgtgaacctggccaaggaggcgccgcaatatcgcatgctcagcaaacgcgtcatcaactttatcctccagcacccgcaaccggccctgacttatcgccatctgccggcaaccggcgggttcgcgcgcgcctacctcgcttacagtgcagcgcccaaggcctcgccacccaagcgcctgggagagagtatcgatcgcggtatgcggctgctggtatcgacgacgcgtgcgccgatgcgcctggtgacgtatttgtccttgttcggcgcactcgccaacgttgtgtactccatctacgtgctggccgtggccgccctgaagcctgacgtcgctcccggctgggtgagtttttcgctacagcaatcggggatgtttttcctgatttcgctggtgctgctggtacttggcgaatacatcctgaatatggccagcctgtcgaacgaagggccgctttatcatgtaggccaagagttcaccagcgcgcggatgacgcgcctggagaaactcaatatcgaagaagtcagtgccacccccgccaagactgacgacctcgtttcctgatggaacatcttaatcatcagcagactgccgttgtgattggtgggggtttttacggcgccgccatcgccgtttatctcgccaagcaacgcggcctgaagcgtgttcttttgattgaacgtgagccggcattgctgaggcgcgcctcttacaataaccaggcgcgcgtgcacaacggctaccactaccctcgcagcttcaccacggcttatcgcagccgggtcaacctgccgaagtttgtaaaagactggccacaggcgatcaagcaggacttcacaaagctctacgccatcgcccggcgcaattcaaaggtcacggccaagcaattcgaacgcttttgccgggatattggttcagctatcgaaccggccgcgcccgagctgaaggcgttgtttgagccgcgtttgatcgaagatgtgttcctcgttcaagagtacgccttcgacacaacaaagcttgccgactgggctgaacgcgaacttaaagaacacggtgtgcaggtcctctacgaaacgcgagtggtggaaataaacagagcctctgacccttcagtacgggtcgtcatcgagggaaaaggtggtcaacaacaactgatcagttgcgactacctcttcaactgcacctatagcggtatcaatcatttcagcggcgatttcaccggcgttcaaaccggcctcaagcacgaaatcactgagatgccgctgatgcgcatgcccgcttcgctggagggtttaggcgtcacggttatggacggcccgtttttctcgatgatgccgtttcctgcacgcgggcttcataccttgtcccacgtccgctacacgcctcacttgcactgggacgatgaaaaaggcgtcaacccctatgaaaaactgggtacgtacgacaaggcaagccgagtcgatcgcatggtcagagatgtaggcaggtacatcccggccgtcttgaacgccagccacgtcgactcgttatttgaagtcaagacggtactgacaaaaagcgaaggggacgacgggcgacccatcctgttcgaaaagcacgcctcactgcctggctgctactccatcctgggcggtaagatcgacaacatctatgacgtcctggaaaaactggacctcgaagttttcagcgaaacagaaccggactcttgagcacataatgactaacactatcgaaatcactatcccgattctgaacgaagaagcgaccctcgcccagcaggtcaagacagcccattcctacatccaggaaaaccttaaagacctcggcatcattaccattaccctcgcggacaacggttcgacggacagcactcaagccatcggcgaagcactctcccaagagctgcccaacgtcaactacctgcgccttgaaaagcgtggtgtcggcctggccttgaagtcgtcatggaccgcgtccaccgccgacatcgtgggttacatggaccttgacctcgccaccgacctcagccacctgcggccagcactcagcagcctgctgtcgaataaagccgatgtggtgaccggctcgcgactggccaaaggcgcgaaggttatcgggcgcacgccgttgcgaaatttcaccagcgcgtgttttaaccgtatcgtgaaggtcatcttcagaacgtctttcagcgatggcatgtgcggtttcaagttcctgcaacgtagcaaacttgcgccgctgatggttgagggcgcgcaaagtgacggttggttttttgccaccgaaatcctggttactgccgaacacctgaactacagggtgttggacctccccgtcacatggaccgatgatcccaactccaaagttaaaatcatcaagctttcgcttgagtacctgaaggcaatgtttgcactgcgccaacgactccaaaatgccaagagcgcaccccactcatgatcaatttgtcagctgacaacaaaaccctggttctcggcacggcactgtggggctggggcattgacgaaagcagcgcacaccagctgattgacaccttcgtcgccaagggcggtcgcacgatcgacaccgcgtcgaactacccgataaacaagcggccagaagacttcggcctggcaatacgctggattgagcgctgggtgaaatccaaccccaatgcgggtgtgtccgtcatcgccaaaattggcgccactgataacaccggctctcccgacacggacttgtccgccgccaacatcctgtcgtccgccagcgaacttgctgatcggttgggagacgcactgtcctgcgtgtccgtgcactgggacaaccggggcgctgaacagcacgattttgtcgacatcgaaaaaacgctggaagccatggcgaccctgcatcgatccggcctggacattggcttgtcaggcataaagttccccgagttgtactacaacgccaagcccgacttgtctgaacattggctgatacaggtcaaggaaaacttctcgacgcgcagtgcacgcgaaagctatcacccgcactttcccaacgcgaagtacctcgcttacggtattaacctgggcggtataaaagccagcccggtggaaaagaacagctccgccgagttgagaaagatagtccactctaaaacccttatcgaaaagctgacgggtttcatcgcgtcaacgacttccatagtgccgcgccccagcagcttgaatgacctggccctggcgttcatctttgccaacccggcgctgagtggcgtgattatcggcccacgcaacaaagagcaattgctcaacacgctgacgtactgggacgcgttgaacagcactttcaaccatgccgatcacgcagcgcttctaacttcacttgcagactaaactcaccacgggtgaagcatgattcaacttataaaatatgcgctcacgggcgtcatcaacacactcgttggctatggtgttttctggatactgttcactcagttcaacgtgaaggccgaatacgcaaatgccatcggctatggtattgcgcttatcttcgccttcgggctcaacaaggtatttgtattcaaccagtcaacctttcatcacggcatgatcccaaggttcatcgtcgcttttctggccgcgttccttatcaaccaggtcgtgctgatcgggcttcacaggtttctggggattcgagctgaaattgctcaaatcgtggcgatggcgacctacacggtcctcttctacctattgaacaagcgttatgttttcaacgagcgtgccgctcatggaaacccctgacagaacaggcgcactcgataactacgagccgctctgtggcgggggcgaacactgggcagtcgtgagcgccgccctgccacgggtgacagcaaacgtttacgcgccgggcggctgagaggcttgatttagacgggtttttcgcacacgacgaacgtggcgcctatgtacaaaaattaattcaacgctccgattggcggagagggaaaaaatcctaccacgtggtagtatcgtccgtatgcatgccctgaagaagggcagtatagaggggcctggtcacttgaccgctcgtcgtcgaggcgctcctgggcgtcaaggttaaaatccatgaggcactgtttgtcagaaatttctgaacgaaggtgcaaccttttaaccgacgctacctcttaatacttcagcaggtacgcgagcccaggcatacggaccataagagaagcttgatagggcttgcgagccacaagaaagcattggctttcgaggactcatgaggtcgaccttcagctgaaattcatctccctatgcgggtgtattgtacttgggcaacacaggcgccacgttgattgcacgacctacagtaaaccgatcgctcaccctgaaacaggaagctcgttttggtactgcgcactgttaggttgagcacgacaaagggatatgaggtgaaggtgattttgcgaagctttctaaacaattaggatgataaaatgtctgcaacaaacgtcactgcaccgctacagggctctacctcacgcttcgctgggaaaaaagtttggatcacgggccacagaggcatgctcggttcagctgtagtgcgaaacttccaagatgaggatgcccagctgcttctgacgtcgcgggctgatctggaccttaccaaccaagcggctgtatacgattggatggaaacaaaccgccccgattatatcttccacgtcggcgccaaagtcggcggcattcacgctaatgcaacgttgcccgcgtcattcatttatgacaatttaatgattcaaacaaatgtcatttccggggcacataagttcggcaccaaaaagttgctcttcgtggcgacaaactgcacctatcccaaaaacgcagagcaaccgattcgcgagtccgcgctgctcaccggcccgttggacgacagcattcgtgcctatgccgtcagcaagatcgccgggatcgaaatgtgccgcgcgtaccgcaaacaatacggttgcgacttcgtgtcaattatcccaccgaacctctatggccccggcgacaattaccactcccaacacagccatgtagtggccggcatccttcgtcgcacgcatgaagccaaagtgcttgagaaaagcgagtttgtcgtatggggtgacggtactccgcggcgcgaacttctgcatgttgacgacctggctgatgccatgaagtgcatcatgctcgccccgaccaccgacgacctctacaacattggctgcaaccatgacatcgccattgccgacctggcggcgatgattgcggaagtcgtcggctatcaaggcaaaattgtctacgacactgacaagcctaatggcacgatgcgcaaactgctggacagcagcaaggtccgggcactcggctggaagcccaacatcactgaaaaagcagggctggaaagcgcctacaaagacttcttggggctccttgagtcgccgacacccgacgcgcgcatcgatctctgatcaaggcgaagacaagacgtcttcttttttcaccctacagttggatgctgtgtaatgagtaatgatttccctctgcccgagggcgtatttgggcgcttcggtgtagtcaagctttggccagatatcaaaaccgcagaagatgaatgtatcgcacgcctgaaactggcggccaaagccatcggcgttgaatgcgtagaagtgcatgccgatggaggtcttgtctccgcccccgacataaaagtgtccaagacaaccgtcgattttgtgatccatctgcattacgacacccccaagcgctacgacgcattttccttcgtggcactgtggaacccgttgaagttctaccatgaatggggctatcaacgctgctcgcgcaacctgaccactcacgatgacttcctcagctgcagctccgttgccgccgacgaccatgtcgcgcgtatggtgcgcggttctacaacgcacttgccggcgcatttcaagctgtaccactccacgcccaagatcgtccatgagccatccctgggcgacggcaaactgttttatgccggcatcaactgggaagccatcgtcagcagccgccagtcgcgccagcaagaagtactcaagcgcctggaccctaccggcctgttgaaaatttatggcccgaccattttccagggcgtgcgcgtctgggagggttatcagagttatgtccgggagattccattcgacggattctccatgatcgacgagatcgccaaggccggggctgcactggtgctgtcttcgcaggcccaccgcgactccgaaatgatgtccaaccgactgttcgagaccatcgcagccggtacgctcgtcatctgcgacgaaaacccgttcgcccgcaagttcttcggcgactcgctgctctatatcgacagccgctcgccaatggagcaaatctacggcgacattaccaagcacctgagctggatcaaggacaaccccgaagaggcactggccaagattcaaaaggcccaagccatcttcaatgagcattactcgctgattggcaacctgaaggacctgtacaccggccttaatgagcgaaagcgccaactgaccgcccgccacctgggcgcagacggtgagaaaacccacatcagcctcaatttgctgatgctggactactccaccgccgcgcttaaaaagcacgtggaaagtgtcgcccgtcaaaattacaccaacttcacggccacactggtgatcgacacagtcgccgccagcaatcttagatcagaaatttcgcgaatcctgagtacctgccctacgcctattcacatcaaggaagtagacggctacaaatacgggattcatcctgagatcaaggcaaaacgtcggttgggcgaaaccctcaatgaattggtcgccgatgcggcgcagtccgatgcgatcatctttgtcgcacccaatgagaaattgctcgccaaccatttgaccgtcctggccggcgcgctgcagagcaacccagagacgaactgcgcagccacggcagtcatcatggacgacgggcactccccggtgcataccgtgcatgaactggtcgactttggtcacgtggacgcagcaggcccgcccgggtacggccgcttcatcttccgtaccgccgcacttcctgccgacctggatattgcgctgccttatcttgatggaagaccgttggctgccatggtcagcggcaggatcaaacatcttctgccggcgacggtcactttggatctgcgccagtcgttcccggaaagaacgtgggacgaagctgctgaaaccgaactgatcaaggatttcaatcctgacgcgctcaaagtgtcagctggcttctacctctcgaatgcacccgcgcctgtcttcatcgagtcgccgaagcggtccattgccaagctgtttctcaacaagacctgggtcaaggcccagatcaatgcaatcaggacccaaggtctcagcgcgcgccttgccgtattgaagcgaaaactaggatgaacccacacgcacccgctcccatttcgttgctttcattgctcaagagcgtttgggcgaattggaatctgatccagcaaatgaccaaacgggatgttatcggacgctacaaaggttcgatgatgggcattctgtggtcgtttgcgaacccgatactgctattggtcatttatacgctggtgttttcagtcgtattcaaggctcgttggggaacggacgagccggggagcaaaagtgagttcgcgattctgctgttcaccgggatgatcgttcacagtttgtttgccgagaccctgacaagagcgccgacgctgatactgagcaatatcagctacgtgaaaaaagtggtgttcccgctggagattcttccgattatcgccatgggcacctctttctttcacgccctggtcagtatcggcgtgctgttggttgcgcaactgctggttaatggcgctatcccatggaccgtggtgtttttacccttggtcatcgcaccgctgattgttctgtctttggggctcgcctggatactcgcctccctcggggtgtatttacgcgacgttgcccacccaatcggcttgctgatgaccttactgctgtttgcctcgcccgtgttttatcccatatcggccctgccgatagagattcaaccgtggttaatgcttaaccccctgaccttcattatcgagcaggctcgcggggtactgatcagcggatcggtccccgactttacgggcctggcgatttatgcggcggttgcagtaagcgttgcatgggcgggatacagctggttccagaagactagaaaaggctttgcgaatgtcctctaatgaattcgcgattcgtgtggaagccgtttccaagcgattcgaaatattcgaacacccgcgtgaccagctcaagcaatttatttacccaagactgcgccgtttgttaggcaggcaacagcgcaattacttcaaggaattctgggctcttcgcgagatttttcttgaggtgcgcaaaggtgagtcttgcgccattgtcgggctcaacggcagcggcaaaagtaccctgctgcagatcatcaccggcaccctgacccccactaccggcaaagtcagcatcaatggtcgtgtggcagccctgctggagttgggttcggggttcaacccggagttcagtgggcgtgaaaacgtctacatgaacggcgcactgctggggttcaaccgcaaagaaatcgatgcaaagatcccagacattgaagcattcgccgacattggcgagcattttgatcaggcactttcatcctattcgagcggcatgcaaatgcgcgttgccttcgccgtttctacggcgttcgagcccgatatcctgatcatcgatgaagcgctggccgtaggcgacgcctacttccaacaaaagtgcttccagcgtctggaaagctttcgtgagcgcggcggcaccctgttgttcgtgtcccacgacgccaacacggtaaaacacatttgcaacaaagctctgctattaagtcatgggcaaacgttgagctttggcgcgcctcgcgacgtgatcgacctgtatcaaggcctggtggcgaaaaaaaccgatatgagtggcagccaggtatcggttgaccagagcatcgcgccttccactgaaagccttgaactgatcgagcatccgacggtgtggacaaaagccacgaccatcacgaccaatggtgatgcggaactgatcgacttttccttgctggatgcggagaaccgccccgttacgcacattgaaagcgaaacacagctgaccgtgcgctatgtcatcaagctgaacaaggacttcgagcgcccggcgtatgggctcattgtcagagatcgcctcgggcgctccttgtttgaaaccagcaccttcgcactgcaaatgcccgacgccccatgcccgcgaggcacccaggttctggtgcggttcaacctcaacttgaacttgaaagccggtcagtattcattttcagtcggcgtggccaacaaagggttttccagaagcgaatttgaagaatacagcttgctgatgcatgacgtagagcagctacaagtcaccgaatcaccactggcagctttttacggtggaattttcaacatgcacccagtcgtatcggtggatttactggaagaaaagtcaaatgtctgacctcacaacgctgtcccagcagttagaagaagccttgaaagaactgaaggccctgaccgagcgccagttgcactttgagactattttgctgaacaaaggcctgtcgacggtagatgtggccggtttcagcccgctgctgcgtcgaaacttcataagcaacggtgatgccgcacagcaaaagcacttgatgcatagctggaagcaccactctccagcggtgctggaaccggcggacctgacggacagtggctttcgcgctttttcgcaaaatgatgaagacggacttttacttcgcctgtttacccatatcggctgcaccaaccgttatgtcgtcgaaattggcagcaattgcagtgactccgacgtaggcattcctgaaaatctgtcgaccaacctgctggtcaatcacggctggcacggcaccatttttgaactcgatgaaaccgagtgcaacaagatgcgctacttcttcgcgcgcactgcgtccactcgtcactatcattggacccacgacggcttgaccgagtactactcgccggcaatcgttcaacaggccatcagcccagacaacattaacgagctgctgctggctgccaatccggagccggaacccgacctgtttatcattgatattgatggcggtgacttcgcggtcatggaaaacctgagcgcgatcaaaccccgcgtgattgtcgtcgaatttgaaaagcgttttcgcgaacgttacagcgttgtacagcgggaccgcgaacacttcagcctcaaatggcagcaatcgggggcggccagcctcactgcatggacgagtctgctggcgcccaaaggctacagactgtgtgcggtcggaacctgctgcttcaacgcctttttcgtacgtgacgacgttgccgaaggcaagttggcggccttgtcacccaagtcagcattcgattcgcacgcgatattttctgcgatcaatgatgatttctggctgacgcccgacgacagctggcaaacattttgaatgtgtactgagcaacaccaccgtgaacgaagaagcgcgccacctctgaatcagcattggcccgagcaacgctggaacgctcgccattcgcacaggggcggtggcgtacacatacggtgaaccgcgaagaacagtaaagctgcgccagaacgctgcagccttttatctttgccgacgacaccaccgaacggccgcgtggaaaatttcagcgcacacatgagtaaggattactgaggcatgacgtttaagaacccaacgcacaccgtgctgacagcattatgtttgagcattgtacctttagtcattgcctactatgcgatggggctggataagtcaggtctcgactcgccgtttatctatgaacacctcgatgacatttggcaattcactttaactaaagtactcaaagaaacggggtggattctttacaacccttacctcggtgctcctgaagttgccagttggcattatcactctgccgcccagaccagtgccctgcactcgattatcatgctggcaatgagtccgtttttcgacagcgccattaccttgcagcaaacgtacttcattttaaactttccactgatcgcgatcaccgcctattgggcctgtcgcctgctctcaatagctcgtttgccggcgatcagtgccgcgctgctgtttgctttttgcacctaccgctttaacattcttatttattcgttcctgcccaactatttctgcatcccgctggcgatggtcgcgatcatttggacctttcaaggcaagttcgatgcgattctgacatcggccaaactgcccgtcgcggtaaaatcgttactcaccaacaagtcgtttttactcggcctgttctttattattctgatcgccctgtccgacggctattacgcatttttctcattgttgttattcggctgcgccggtgcgattagactgattgtgggcgggtggaaagcaccgaggatccttattcccgccatcctgaacatcatcgtattggtcgtcgtttcactgctgattcagttgccactgtaccaatacaaaaaatcccatcacgatgagttctaccagaacaatgttgccgaccccgtgctgttaaagtaccccctcgagtcagaggtttacagcagcagccttaagttactgatcacgcccaaccaacaacatcaccttggcgtgatgcgccacgtgggcgatcgcttggttgagagcagcaatgccgctcggcgaattgctatacccgcctccattacactgggtgtgttcggaaccgcgctgctgttcctgagtttcatcttgctgatggtgccacagttacgccgtaccgtatttaccgacaacgctacaaccctggaacacgacaagcgttttattggcttgggagacagtcttctcgctattatcttttttgtcttcctggcgagcatctccggcggattaggtacgctcatcgctttcgtcttcccaactatccgggcctacaaccgctttccaatattcatggagtttgcgcttttactcctgggcgcgctgatcgccagccgcgccttgaatacgttgcgtcgccccgcactaataaccgccgcccttgtgatcatcaccgccctgggcatctacgaccagatccccgccaatgtggcgaacaggtcacccgacattcgtcctcgcgtggcggaagaaacagcattcgtcaaacagctggagtcggaactgccgaaggacgcgatggtttatcagtttccttattcgcagtacctgacaaacaacaaatactatggctggggttcgttcaaccatattcgcctgtacttgttctctgaccacattcactggagcaatggcgcctctaaaaacagccccgcggacaattggaatcgacgtatttcgaagttaccaatcgacgccttgatcaatgaaattcaagcggtcggcttcaaggcactggtgattgacaggaccgtggttaaagatgctgagttcgcaacactcaagtcggcattgcattcgttgaaccttgttgtgattgaagacccgtcggggcggtttgcgcatgtactgctgccacagccaaattacaaggtgtcctactctaaagactacacggccatcgacagcatcaccataaacgcagcaacaccctttgataagaacgcttatcccgaactgattgatgcgaacaaacttgaactttatctgaacgacaaccgtgcgccctaccctcttcgcatagagcgcgcccagcatccagaaattttcaaggacgtaagggtgctaactagaggcagcggtgattccgcgattttgcctgcaacagacctcaacgccacgctgacctgcactcagcttgataaacaacagcacgtggcgatagaccttaacaataatggaacttttaacctgagcctgggtcagggtgcattcccgattagcgtcggggtacacttaaaaggtccagatggctcgatgctactatgggactcgggctatcgcattgcggaaaacttggtagtgaagcctggcgagaaaaagcggctggtattcgatctgaaagactatactggtgccaatcaatacaaggccaacccgggtaattcattgcaatttgaactggtacaagatggaaatgcctggttcccgaacgccagctgttcctctgccccatgattgcgcacgatcaatgctcgagttcggtgccgataagtttgcgaagtcgcaggctaatcggcacacattgagaattcagcctcattgaggcagtataggaaattatcggcccgggtatggcctgggctgtgtagatcaatcgcgagaaattgcattcctcactttcgcgtcaaatatattttttaaaaaacacgttaagagaagcatatgaaaaaagttgcgcttattactggagtaacaggtcaagacggatcctacctggccgagttgcttctcgaaaaaggctacgaagtacacgggatcaagcgccgagcctcttcgttcaacaccgatcgaatcgatcacctgtaccaggacccgcacgactctgatcgtcgccttgtcctgcattatggcgacatgaccgattcgaccggcctgatccgcgtcatcaagcaagtgcagcccgacgaaatctacaacctggcggcacagtctcacgttgcggtgtcgttcgaggagcctgaatacacggccaactccgacgcactgggcgcgctgcgtatccttgaagcgatccggatcctgggcctggaaaagaaaacccgtttctatcaagcgtccacctccgagctgtacggcttggtgcaggaaaccccgcagaaagaaaccacaccgttctacccgcgctccccgtatgcagtggccaagctttacgcttactggatcaccgttaactaccgcgaagcgtatggcatctatgcctgcaacggcatcctcttcaaccacgaaagcccggtgcgtggtgagacgtttgtaacccgcaagattacccgtgcgctcgcgcgcatcaagctgggtctgcaggattgcctgtacctgggcaaccttgacgcactgcgcgactggggccatgcaaaagactacgtcgaaatgcagtggctgatgctccaacaggaacacccggaagacttcgttatcgccaccggcaagcaatatagcgtgcgcgacttcgtcaacgccgcagccaaacacgccgaaatcaacatcacctggaaaggtgaaggcgttgatgagaaaggctacgacgccgatggcaagtgcatcgtttcggttgacccacgctacttccgccctaccgaagtggaaacactgctgggcgacccaaccaaggccaagcagaaactgggctggacacctaaaatcagctttgaggaactggtcaccgagatgatgaccgaagacttgaagtcagcgactcgtgatgagttggtgaaaaaacacggttactccgtctacgactaccacgagtaatagctaggtggataaaagcgccaaaatatatatcgcggggcacgccggcatggcgggttctgcgatccagcggcggctatccgccgctggattcagcaatttcgttactcgctcgcacgctgaactcgatctgacccaacaggctgcggtggatgcttttttcgccgcagaaaaacctgagatcgttttcctggctgcgggcagggttggcgggatcaaagccaacaataatttcagagctgagtttatatatcaaaacctgatgatcgaggcgaatgtgatccacagcgcctggaagcatggggtccagcgcctcctgtttttaggttcaagttgcatttatccgcgagattgcgctcagccgattcacgaagattacctgctgacagggccgttggaacaaaccaacgaaccttatgcagtcgccaagattcttggcgtcaaactgtgcgaaaactaccatcgtcaatacggtgcccagttcattgccgtcatgccgtccaatctctatgggcctaatgacagctatgaccttgagaactgccacgtactgcccgctctgatcagcaaagcccatgcggcaaaaatgagcggcgcttcagagttggtggtctggggttcgggcaagccgagacgcgagtttcttttcgttgaagacatggccgatgcttgcgtgcacctgatggagtccgacattgaaagcgggcttttcaacgtaggcatgggcagcgacctgcccatcagcgaactcgccgagttggttatggaagttgtcgggtacaacggtcagatcgtttatgaccgcaaccaacccgatggcaccccccgcaaactgctcgacatcaatcgcctgaaaggccttggatggactgccaaaacgcaattgcgtgaaggcatagctctcacctacaaagattttctcagccgcgcggatcacctctgaatgtctcaacccttggtcacgatcgcagtaccttcattcaaccaaggccgttatctcgacgatgctttgaggtccatattcgaacaggacgttcctgtagaggtattcgtcctggacggcggttccaccgataactcggtggacgttattcgcaaatgggaacacaagttagccggatggcgcagccaccgggatgagggtcaggcagcggctatcaatgaaggcatccttcgaggcacagccccatttgtgtgctggcttaacagcgacgactggttcgaagccgacgggttgaaacgcttgatcgaagcgattaacgccgcgccgcaggcctcagcggtctacggtaagtgctggaactttattcaaaacacttccacgcgtaagccggtctgggttgagcccttcagcgaacgccggctctctctgcgctgcatcatttcacaacccgctaccttgattcgtcgatccgcctgggaaaccgtaaagggcgtagacgccacgttacacatggcgatggactatgatctttggtggcgactttttaaagaagtaggtcccctcacctacattgatgcattcgtggccgttaatcgggaacatgaagagaccaaaacaaaaaccctacgccgtcgccattactcggaagctatagcggtagtgcgcagacatcacggtagcgttcccttgaaatggtggctttttcagccctacgccgtctggctaaaatccatcttcccctaaccggaactcgccatgcgtattttgcatttctataagaccgcgttcccggacaccatgggtggtgtagagcaagtcatacatcaaatatgccaacagtcgcatcgttttggtgcgacctgcgaagtccttgcactgtcccctcacccgagcccaacagtgatagagttggacggttacaagactcaccaagttaaagaaaatattaaaatcgcttcaaccgggttttcgatccaggcgttttcgaagttcaaagagctcgcgcaacaggccgacattatccactatcatttcccgtggccgttcatggatgtcatccatttcgccagccgtatcaagaagcctagcgttgtctcctaccactcagacatcgttgatcaaaagaacctgttaaagctctatcgcccacttcagaacaaatttttgagcagcgtcgatcggattgttattgcctcgcccaactatttggaatcgagcaaggtactgcccgcgtttcgtgaaaagatcagcatcattccgattggtctaaacaaggaaagctaccccgttccttctccctcgctgaaagctcgctgggcgacgcaactgcctgagcggttcttcctgtttgtcggtgtgctgcgttactacaaaggcctgcacacactgctcgaggctgtccagggcacaggttacccgctggttattgttggcgatgggccaaagaaacaagaactcatggcgcaagcagagcaacttgggcttcagaatgtgcactttttgggaaaagtgagcgacgaagacaaggtagcgttgattcaactttcaacggcaatcgcgttcccttcgcatcttcgctccgaagcgtttggagtggcattgctggaaggggcaatgtatggcaagccaatgatttcatgtgaaatcggcacaggcaccacttacatcaacattgccaatgaaacaggcttggcggttccgcccgaggacccaacggccttccgcgaagccatgcgttacctgtgggacaacccgcaggaagccgcagtcatgggcgaaaaggcagagacgcgatacaccgagttattcaccggtgatcaaatgttgcggggatatatgaaggtttatcaggacctgatgaacaagcaaggatgacatctgcccgaatactcattcgggcaggtcattaataccttacttgccgttttcggcgcgaccgtaaatgtcctcaaaccgaacgatgtcgtcttcgcccaagtaatcgccactctgcacttcaatcaacaccagatcgataacccctgggttttccagccgatgagtgtggccggcgggaataaacgtcgactcgtttgtgttgagcaggaattcacggtcgttgttaaacacgcgcgccatgccgctcaccacaatccagtgttcgcttcggtgatggtgcatctgcagtgagagtgaaccctgcggtttgaccacaatgcgcttgatcttgaaacgctgaccttcttccagggtggtgtaggcaccccagggacggcgaaccgtggtgtgatcaaggtgcgaacagtgaccgctcttcttcagctgcgccgtgattgccttaatgtcttgtgcatggtctttgtgggcgaccagcagggcgtccggcgtatcgacgatgatgagatcctcgaccccgaccaaagcagtcagacgtcgcgggctgcgcacgtagttgttgttggcaccatgaaaaatggcttccccttcgacacggttgccctgctcgtctgaaggcgacagctcgctcatggcattccacgagccgatatcactccaaccgatatcacaaggcactgttgccaccttgcttgagcgctccatcagcgcgaagtcgatggaaatatcagggaccttggcaaagctttccggctccagatgcaggctgcgatggctattgccagtcatcgtgccggaacctgccaggcactggtccacagcaccggaaacatccggtgcgcagagtgccatttcttcaattaacgtaccggcgcggaaacagaacatgccggaattccagaaatattcacctgacgccaagtagccttgagcggtttcaaggtcgggcttctcgacgaagcgcttaaccttgaagccattaccgagtggggtgtcattgtctttctggatatagccgtaaccggtttccggatactcaggcttaacgccaaaagttaccagccagccctctttggccaactcggatgccgccgaaacagcctcggcaaatgccgcatgattatcgatcaggtgatcagctgggagcaccagcatgatggcatcttgcccatgagtgcgcgcaacttcttgagccgccagcgcgacagcggctgcagtattacgcccaaagggctcaagcacgaaactcaggttagtgaattgaggcgcttgtgcgctgtattcatctaaggttttgaaatagagatcacgattagtgattgtcaacacttcgctgactgcgtccagagccaatgcgcgaccataggttttgcgaatcagattaccgccaccaggcagttcgataaacggcttgggatgtgctgaacgagagacaggccacagacgactgcctgcaccgccgcagataatgactggaacaagtgtcacattgtaactcctttacgtactgccacttgatttcggctgcagcgttcgccccctcgatgcggcagacccgaaaacaaagtgacgtagagtctttcagctaaataaagtcaaatcgccgaagcgtccagggggaaaaacatagtgagttttcttacaaactagcgccaacattcttatttaaatgactatttatgtctaggaaaatacggaatattcctatcgccaaatctgtttttcatctctggcaaactggcatctggataaaacatgtcacttttcagtggaaaggtctgagcatccgctcagcaggcgtctaaaccgctacctgccacggtctagagccctggcgggggctgtcgctttttagtgtgaagcgccggtgacgaaaggcatgggcaagtgggtgtattgtgccgaacttggccctacatccggatgcaggcgagcggtgcagtggacgacgatcaattcggcgcttggaaagaggcgcaaggttcgcgattaacacgccaagctgcacttgatcagcttgcgcgtcggcacgcccacatagaccccaggctccgctaaatcacggtgcgcgcacgcacctgcgcccaacgtcacgccatccgcgatcttcacaccgtcaataacggtcgaccccgcgccaataaaacacaactgtccaacatggcaccttcccgcgactgcagcattgatggaaatatgcgtaaaatcaccgatcgtgcactcatgttcaacgatcgccccggtattgaccacacaccccattcccacggaggccaaagggccgacatgcgcgtgatgccctacaaacgtacccgcgcctaatgtcgaaccgaagccgattgtcgccgtcggggacacgagcgtggctaaaggccaaccacgcttctcaacccaatcgcactgcgcttgtcggcgggcgccgtctcccgaggcaggcatgacagaccatccctgcgataggtcttcatcccaactgcgacgcacaggaaacgccccacaggtttcatcaggccgcgcctggtggtctacgaaacacaggtgtttcacgcccaacgccaatgcgacatccgcaacagcgcgagcatgaccaccacaaccgaggatcaacaaaccctctaatgggtgcacagggcgcgctcctgtgcggcggaatcggttctggagatagcctccaatatatcgatgtgctcgtttacaacatccgcccaactgcgcctggcgagcgatgcgtaggcacgcagttgaatacccagcaactcatcccggttctgcacgccccactcaatgcggtaggcgatatccctccaatcatagggatcaaaaaacgtcaccttttgcagttcggcatccaccaggatctcttccgtgaccggtatgcgcgccatgaccacgggggttgcgacggataaggcttcagtaaacgtaaacggacacccgccttcactcaggctcggattcaccgctaaatctgccagcgcgtaacacgcagccaattcgcccactgacaacccatgcatacacagcacttcattttccaggtgatggtcgcggataaacgccttcaccggcgcaaacccttctgcgttccccgtgagtatcaacttgtgccgaataaagtggttatgaaggaggtgcttataggctttcagcagagaaattaaattcttgttcgggcgaaactgacttgcataaaaaatgaactttacatcgccattggcaaacgtggacgcatacgccgggtttgaggtttttctcagtgcccttttaaagagcatcacacaatagtttttggacgctgcctctgcgtctacgtctacgcaacctttaacggcgatatgctcgctgagatcattgggtgcatgatgaaccacagaaacagctgacgatttcagcgcgtatcgctcaataagcgtttgccatttcacctgctgactgtaggtgacgaagtgttgtccgccctgaatggcagcctctacgcgttcgtatacctgcagaaatcgttccccgcccacttgcgagaaaccaaccggaaaatccgctagcacgacatccggcacacacatcagacggggcgcttgaatcttattgaacgccggccaaaaagccgtagggccgtaccacgccttcacctctgtcagggtgttgatcagttgtaacatacgctctgactcaacctgctccattcgacggtacaggcgcaggacaaacgtatcctcctttggagcctctgcagaagccagcaaggggttgatcaaccgtttcaccggccgaaaacacttctgcacaacaacgttgagcttcaattgaagcctatacagcggtacaaggatcagtaaggggcttatcaacaggagcaataaacacaagagcgttgcttcgacgcccaggcggaccacgccccgataggagtcaaccgcaatcaagcgttcttcaatatgactcaggaacatcgccttccaggaagacagcgttttcacgatacgttgcttcagcgagggttttttaagccttttctttccagcgatatagtgttcatagccgcgcaagatcaacggaatattcggcggacacacaatctcgaacacgccgtcctgaacaccttcgctctgaaacaagtcatgcagtgctttttttgtccagctcgggcagaccaacgtaaactttacatcatcacgcccggctgcccctttaaggaacgcggccaggtagcggcccaacccttcatgtcgcaggtccacacctggcgcgtaggccaagtaaatcccgaagtgtttcataagcaccccctggcaacctgccaatacgcacctgctaacttttctactcgttgctctcgcaatacctcacacgacggtagggtcttgcgacgatccaaataggtaagttccatatctttaagctggctggccatgtgcgctgggtcgtccgaccgcatccaactcaacgccagggaaaactgttgatcaatctccctcatcgccgggtaatcactgcttaatgaaggcacacccagagtggccgcttcgatgacactgaaggttccattgtctattgaaccggcgtgccacaaaaaggcggcacgggaaagcacagcctgataatcgcgctccggcaactcacccaaaattttgatacgcgcacgtacctgtgaatgcttaacgagcctgttcgctacctgcttgagatggggcaatgtgcttttaaataaccccttcgtgtctacgccggtcatcctgcactcgagtgtaccgcccagtgtttcgtaataaatctttaaggcttccaccgcattcaaatggttcttgtgcaatgccgaattcgtcgtccatacaaaatagtccgagtggtcgatggcacacgcctgcgtgctggaaaaatcgggcgcgagcatcggcaacttgaagactttatcggcgggcacaccggcgtagttcaacgcatcctgttgggtaaattcagtggtcacccacacttgtgacgcggctcttgcggcttccagaaatggctgatcagcgccaaagggaagtatcggcgtataccgttgaagatagtcatacaccatcagcaccgacggccgcaggggtaagagcggtgcactcaaacgatcggatatgaccagccaggcatcacactcctgaagatggtttatcccatcatcaacaatcaggtagcgcgggcttttcggctcccagccctcatgcccggcatagcgcatcgcccgacgagccggcatggcgtctagaacgctccattgataggcgcgaatcgtaatgcccttttcaaggtctgtgaacgcgtcaggcggatagctctgcgagttgtccagatgcaggaatacgatatcggccgcttcgcccgcttgacggctgccctggtacaaggcgttggcgacaagtttggcgccccgcaggctgccacctctgtactccaccggcacgatcaccgcaatgcgcttgcggcgaacagggcggtccaggctgtcctttcttgaggactcaagcccgttgattatttgcctgaatccacgctgccaagcctgctcacagttcctggctttcatcggctcaagcaacaccctttgggtgtcgcggatacgctgaataaaaccttggtcatcacgcatcagtcttttggctttagccttggcctctgccacggttttgcagcgccctggtaacgcagccccgcccattttgtcgagcattccaccggccatgaataataaaggcatgcccgcacgaatggcttcaaagggatgataatgaatatgattgggctcacgggagtgatagaacatcaccttgtgctgccgcatgttgtattcatgctgttcacgggacacaaagcctatgacgtgcttatcctggaccgcgataggctgcgcaccgccaatggtgtattcgatatcagaaaaatcgtgaataaagtttttatagatattttcaaaatagggagatgacccaatccttgggcaaacgaacatcaccttgttcaaatgcccctcccattgttcgggcgtggcgtcgcctttcaaaccgacgggtagaaaacagtccctgctcgccaaaaaatgctgctccacctccttcaaatgttcatagccagtgcccaaccagaaacgtgagcctatggctttgatatcccgaacgagcgcctcacccgcttcttcatacaataattgcgaatagctgaaccccttggacaacccaaatacccgcaatacgatagcgccgcgaaaatggcgaacagcacttgcgatctgcggcacgaagaacccgaccacggcgatatcaaagtaagcattggcaattcgccaggcttcttcgctggggttcgcataccaatcctgcgaattaaggatatccacgtctgacggagggattgttaaggacgcgtcaaagctgaaatcgacatcggcggacaaattcccctcgtcatagggaaagcgtttgggcatgaacacttcattcacgcccaaggcgctcagctgttcaacttcgaacgttcgcaatgtcgtgtgattgagcagccaaaggactctgagtgttttcaagattgggccagcccattgataactttatattcagccaccgcctcgtcacagccaccgtcaaacaccagttcaccgtgatgaaagaccaggccccgattgcatatcgaacgtaatgcactgaaatcatgggtggccaggaccagaatttctgcttgctcgataagcccggtaatccgctccctggccttggccatgaagttcgcatcgcctgccccgatcacttcgtcaagcagcaatatatcgccgcccactgtcgtggaaatggcaaatgccagcctgacttgcatgccggccgaataggtctttatcgggtagtcgataaactccccaagcccggcaaactcgactatttcgtcggctttctcacgcatgaacttaggcgacaggcccagcaacagtcctcggtatagaacattttcgcggccggtcgcatcaggctcgaaacccaggctcaaatcaaagagggagcgaacttgcccttcaaccttcagcaggccacttgaaacggggtagagcccggcgaccgttttcaaaaaggtacttttgcctgccccgttgtgcccaagcaaaccaacacgttccccgctgtttatttcgacactgatatttttcagcgcatggatgtcagccacgtttgagcgggcgtgattattaccaaacgcaccggccatcagggatttcaacgaacgttctttataagccaccgaggcataatgaagattaacgccctgaagcagaatccgattatttttcataggtaaaagatcactttgcgctcaaccctgctaccaacgacaattgccaatacgccaaaaaaaaccgcaaccccgatgctgaatgcgtagttttgccacgtcggccattcgccctgaagcaagggcgcacgtatcaattgcagcaggtggtaaatggggttgtaatcgaccagtgcatgaagcccgccgttcttgaacatcttggcttcgaaatacaccggagaaataaaccacaacgactgcatgatcagcccaagagcgtggggaacgtctctaaaacgcgtacttacgtaggacaacagggtagaaacaggccaggcgatcaacgccagtaccggaaacagcgtcaatgaggccaaccagctccagccaatattctgtggaagtaccacgaccacccagccatagagcgagatactggccagcagtaaaacgatgttactgctcaacaccgtgcgcaaggtatatatcgccaggggatgattgcattgcttgatgtaggcgtctgcctgaacaaatgacaatgaacccgccacggtgttcgctgatatacactcccacacgatgatcccggaaagaatataaggcgcgtacgtgacaatgtccgcattaaacagtttgctgaacactaacgtcagtaacagcgtcaggcctaacggctggataactgaccatacaatgccaaaaaaagaacgccgccatcgggatcgaagatcagccagcgaaaggtgaacccaaaagtaacgggcatcccacacacgggaaaagtacaaaaacatcgcgtcacctgagcaaatagagtgagtccaaacattcatcggccattggccgcttgaagtttgaagatggcccaagtcaacttatcaacctgcccctgcgtatcagtcggcaaagaaacggcgaatcgcatcagccacgtgcacgacttgctcacggctcagcgtcggataactgggaaggttcattccgcgcgcactgaggtcttgtgcgatcggaaactcttcattggtcttgcaatgcggcatggtgtgagcaggcgcaaacagcgggcgcgtctctatgccttggcttttgaggtgatcacgtaacgcctgacgccggctcggatcgtccaatagcacggagcacatccaataggagtggcgagtgccttgctgctccgcgtgcatgcgcaacggcaggccttcaagcgtttgatgataccaaccggcaatttggcgcttaagcgcgagaatctcgtccgcacgttccaactgagcaaggccaatggccgcacagatgttggtcattcggtagttgaacgccaactcatcgtgccaatactcacgcgtcttggaaacgccctggcttttaaggtggcaggccctttcgtgcacagagcggcttttgcacaccaccatcccgccttctccggtggtgatggtcttgttgccaaaaaagctgaaggtggcgacatcaccgaaggtgccgatatgccggcctttatacaaggagccgaaggcttcggcacagtcttcgatcaacagcagattatgcgcccgacagagcgcaaccagcccatccatgtcacaggccagaccatacaaatgcacaatcatgatggctttggtgtgtggcgtaattcgacggcggacgtcctcgacactgatattccaggtatcggcgtgggactcggcgtagaccaccttggccccggtctgcatgatcgtgttgaccgatgccacgtacgtcagtgtaggaacaatgacttcatcaccaggcccaagccccagggcagccattgccaggtgcaaggcaaccgtgccgttactcacggtggtggcgtgcgcagcgccaatatagcgggcgaactcgttttcaaagcggggaatgaattctcctcgagaagatatccatgtcgagtcgaggcactggttgacgtattccttttcgcgcccacccagaaagggctgatagaccggaatcatccgcgcccctccgcgccgggcacaatgttattacgcgcacagatgtggcaacgataaacaagcgaagtgtctttcattaagatgaagtctctgacgcgccttttgactattaatcaagtgcgcttattgactgttagttaagtgcacccaatctttaaaaggccgcacacctacaactcaaaggtattcttcatcttcaaaaaaacaacacgacacacgaaatacatccacgtcttacttcaactaagctcgcacccttcagatatttcctacacataccgaattcatgctctaagctgccccgtaatactgccgacactgcgggatagatcgctgaagcaaataaccttcagaaatttcctcaacaattgcccacacctgccgataccccctgaaagccttgcggattgaacaaccatgcgtaataaccaacccgttacccagcgcgaacgtaccttccccgctcagcaacggttgatctccaccacagacgccaaaggcgtgatcacctactgcaacgacgcctttgtcgaaatcagtgggttcacccgcgacgaactcatccgcgctccgcacaacctggtgcgtcacccggatgtgccgtcggccgtgttcgcgcacatgtggtccacgctcaaacaaggcttgccatggatgggcatcgttaagaaccgctgcaagaccggcgatcactattgggttaacgcctacgtgacaccggtcttcgatggcaaccaggtgatcggctacgaatcggtgcgcatcaagcccaccgccgagcagatccgccgggccgaagcgctctatcaacggatcaaccagggcaagtcggccgttcctcagcgggacaagtggctgccggtgttgcaggactggctgccgtttatcctggtcagccagttgagtttcatgatcggcgcgtcgctcaactcccactggggctttgccatggcggcggggttgtcggtgccgctgggcctgttgggcctgagctggcaacagcgtggcctcaagcgtttgctgcgcctggctgagcagaccacgtccgacccgttgatcgcacagatgtacaccgacagccgtggcgcacaagcgcggctggagatgtcgattctcagccaggaagcgcgtctgaagacctgccttacgcgcttgcaggatacggccgagcacctcaacgaccaggccgcacagtccaacaccctggcgcacaacagctccagcggcctggaacgccagcgcgtggaaaccgaacaagtggccaccgcagtcaaccaaatggcagcgaccacccaggaagtcgccagccacgtgcagcgcacggctgacgccacccaggaagccaatcgcctgaccggtcgcggtcgcgatatcgccggggaaactcgcgaggcgatccagcgcctgtcggtcgccgtgggtgaaaccggtgtgaccgtcacccagttggccaaggacagcgatgaaatcggcggcgtggttgacgtgatcaagggcattgccgaccagaccaacctgctggccttgaacgccgccatcgaagcggcccgcgccggtgagatgggccgtggttttgcggtggtcgccgacgaggtccgtcaactggcgcagcgcaccgccgagtccaccgggcagatccatgccctgatcgccaagctgcagcacaccgctgccgccgccgtgcaaaccatggacgccgggcatcgccaggccgaagaaggtgtagcgcgggtgatggaggcggaccaggcattggtgggcatcagtgaagcggtggccaatatcaccgacatgaccacgcagatcgccgccgccaccgaagagcaaagcgctgtggccgaagagatcagccgcaacatcagcacgattgcgctgttggcggatcagacgtcggaacaggcgatgaactcggcgcagttgagtgaagagctgacgcataccgcgaatactcagtactcgctggtagagcgctttaaccgctgatacagatcgttcccacgctctgcgtgggaacgcctcctgtgacgctctgcgtcactgcttcaagagcggacgcagagcgtccagggctgcattcccacgcggagcgtgggaatgatcagtggagaaactcagccactttcaccgccgcagcctccaaatgctgctcatgactaaaccccgaagccttcaacggcttcaaatcatgatcccccgccaccagccacatcacctcgatgctcggcgacaactcatacccttccaccgccgcccgattgcctagcgcatcgcgctcaccctgcacaatcaacgtcggcgtcttcagcccggccaaatgttcggtgcgaggtttttccggcttgcccaccgcatagaacggatagcccaggcacaccagcgcatcggcacccacttcatccgccacaatacttgccatccgcccgcccatggacttgccgccaacggccagtttcccagcgacatgacgtcgcacctcggcgtacacctcacgccaggtttccagcagtttgggcgccgggttcggcgggcgtttaccgccatccacacggcgctgggccatgtagggaaactcgaagcgcaacacgttgacgccatgcccggcaaggcgtgcagccatgtcgttcataaaccccgagtccatgggcgcgccggcgccgtgggccaggatcaacgtcttaggcgtacgcgcgatagacccttgcgccgcatcccacaaccagccgcgctcacgcacacactgcgcccattgatccccgtcaatactggccttgtgctctttgcccatgcttgcctcgctttttagtctgcctataactccagcccaagtgccgcatttgcttgggttgaaccgtggatggggaaccatgaacactactttaagtaccgcctataactacaaggtggtccgccaattcgccattatgacggtggtgtggggcatcgtcggcatggggctcggggtttttctcgccgcccaattggtttggcctgcactcaacttcgatttgccgtggaccagctttggccgcttgcgcccactgcacaccaacgcggtgatttttgctttcggtggctgcgcgctgttcgccagctccttctactcggtgcagcgcacctgccagacgcagctgttcgcgccgaaaatcgccgcgttctgcttctggggctggcagttggtcattctgctggcggcgatcagcttgccgctgggctacaccagttccaaggaatacgccgagctggaatggccgatcgacatcctcatcaccatcgtctgggtggcctacgccatcgtgttcttcggcacggtgatgaagcgcaacaccaagcacatctacgtcggcaactggttcttcggtgcgttcatcatcaccgtggccatcctgcatatcgtcaacaacctggaaatcccggtcagcctgaccaagtcctactccctctacggcggtgcgacagatgccatggtgcagtggtggtatgggcataacgcggtaggctttttcctcaccgccggcttcctcgggatgatgtactacttcgtgccgaaacaggccgaacgcccggtgtattcctatcgcctgtccatcgtgcacttctgggcactgatcaccctgtacatctgggccggcccccaccacttgcactacaccgcgttgccggactgggcgcagtcgctgggcatggtgatgtcactggtgctgctggcccccagctggggcggcatgatcaacggcatgatgacgctgtcgggcgcctggcataagttgcgcagtgacccgattctgcgcttcctggtggtgtcgctggcgttctacggcatgtcgaccttcgaaggcccgatgatggcgatcaagaccgtcaacgccctctcccactacaccgactggaccatcggccacgtacacgccggggcgctgggctgggtggcgatgatctccatcggcgcgctgtaccacatgatcccgaaaatcttcggccgcgagcagatgtacagccttggcctgatcaacgcgcacttctggctggccaccatcggcaccgtgctctacatcgcctcgatgtgggtcaacggcatcgcccagggcctgatgtggcgtgcggtcaacgaagacggcaccttgacctactccttcgtcgaaaccctggtggccagccacccaggcttcatcgtgcggctggtgggcggtgcggtgttcctcagcggcatgttcctgatggcttacaacacctggcgcaccgtgcgctcggcgccatcgctgcaagccgccgaacccgccaccgccgcgcagatggcctgaggagtctgtgatgaaacacgaaacgattgaaaagaacgtcggcctgctgatgctgctgatggtgctcgccgtgagcatcggcggcctgacccagatcgtcccgctgttcttccaggacgtgaccaacaagccggtcgaaggcatgaagccctacaccgcgctgcaactggaaggccgcgacatttacatccgcgaaggctgtgtgcagtgccactcgcagatgatccgcccgttccgcgccgaaaccgaacgctacggccactactcggtggcgggcgaaagcgtgtgggaccacccgttcctgtggggctccaaacgcaccggcccggacctggcccgcgtcggcgcacgctactcggacgactggcaccgcgcgcacttgtacaacccacgcaacgtagtgccggagtcgaaaatgccggcctacccgtggctggtcacggcgccggtcgacagcagccacaccgagaccaagttgaaagtgatgcgcaccctcggcgtgccgtacaccgacgacgacatcagtggcgcggtcgccagcctcaagggcaagaccgagatggacgcgctggtttcgtacctgcaagtgctcggcactgccatcaagagcaagaggtgagccatgggatttgaattcgatgcgggcaccatccgcggccttggcacgctggtggtcgccattgcgtttatcggcctgtcgctgtgggtgttcaacaaccggcgcaatgcggaattcgagcaggcccgcctgctgcctttcgccgatgaacctcttccatccgacgctcaagaagagcctgcaacaaggagcacacgcccatgacgacgttctggagtacatggatctgcgtattgaccctcggtagcctgatcggcctgacctggctgttggtcggcacccgcaagggcgagaccaaaggcagcgtcgaccagaccatgggccacgccttcgacggtatcgaggaatacgacaacccgctgccccagtggtggttcatgctgttcgccggcaccttggtgtttgccgtcggctacctgattctctacccgggcctgggcaactggaaaggcgtgttgccgggctatgaagacggctggacccagaccaaggaatgggacaaggaaatggccaaggccgacgccaggttcgggccgatcttcgccaaattcgcagccatgccggtagaagaagtcgccaaggacccgcaagcgctgaagatgggcggtcgcctgttcgcctccaactgcgcggtgtgccacggctcggatgccaagggcgcgtatggcttcccgaacctggcggacaacctgtggcgctggggcggttcggctgaagcgatcaaggccaccatcctgaatgggcgccacgcggcgatgccggcctggggtgaagtgctgggcgaggacggtgtaaaaaacgtcgccgcctatgtgcgtcacgacctggccaagctgccgttaccggccaacagcaccgccgaccttgccgccgggcaagccgcgttcagcaccacctgcgtggcctgccatggcccacaaggccacggcgtggaagccatgggcgcgccgaacctgaccgagcctgccgggttcatttacggcaccagcctggcgcagttgcagcagaccatccgccacggccgccaaggccagatgccggcgcaggaagtgctgcaaggcaacgacaaggtgcacctgctcgccgcctatgtttacagcctgtcccacaacgctgacggcgcaacgccagaaagccaaacggagtaaccgctgacctgtggcgagggagcttgctcccgctgggctgcgaagcggccccaaaatcctgggagcgctgcgcactggaacgccagcccggtccagcgggagcaagctccctcgccacaggttcagtgttcgctgttgaaatgacgcgaccaagtgtcgcacccttcccgagaccaactttcccctcctgctaatcgggtctacgcttgcttgcacagtggaccgattccggcgtacgcagcaacagctgttgccccctaaaaaattcttgtccacttgatcagctttcgatttttgattttgtccttacaccaaacatggaaagggcgcagaatctggcgtggaacgcattgatacaggtcagtcattgcgttgcaatggcccctcggtttctacatacttgcggccgattttacctataaaaaaacctaaaccgtggaaccttagaatgagcacagcaatcagtccgactgcttataactataaggtagtccgccagttcgccatcatgacggtggtctgggggatccttggcatggggctcggggtgttcatcgcctcgcaattggtttggccggaattgaatttcggtttgccatggacaacctttggccgcctgcgcccgctgcacaccaacctggtgattttcgccttcggtggctgtgcattgtttgccacttcctactatgtcgtgcagcgaacctgccagacgcgactgatctccgacggcctcgccgcgttcaccttctggggctggcaagccgtgatcctcggcgccatcatcaccctgccgctgggctacaccaccaccaaggaatacgccgagctggaatggccgatcgctattttgctggccatcgtctgggtgacctacgccgtggtgttcttcggcactatcgtcaagcgcaagaccaagcacatctatgtgggcaactggttctacggtgccttcatcctggtgacggcgatgctgcacatcgtcaaccacgcgtccctgccggtcagcctgttcaagtcctattcggcctacgccggggcaacggacgcgatgatccagtggtggtacggccacaacgccgtgggcttcttcctcaccacgggcttcctggggatgatgtattacttcgtgcccaaacaggccgaacgccccatctactcctatcgcctgtccatcgtgcacttctgggcgctgatcaccctgtacatctgggcaggcccacaccacttgcactacaccgcactgcccgattgggcacagtcgctgggcatggcgatgtcgatcatcctgctggcgccaagctggggcggcatgatcaacggcatgatgaccttgtcgggcgcctggcataaattgcgcaccgacccgatcctgcgcttcctcgtggtatcgctggcgttctacggcatgtcgaccttcgaaggcccgatgatggcgatcaagacggtcaactcgctgtcccactacaccgactggaccatcggccacgtgcacgccggggcgctgggttgggtggcgatgatctccatcggcgcgctgtaccacatgatccccaaactgttcggccgtgcacagatgcacagcgtcgggctgatcaatgcgcacttctggctggccaccatcggcaccgtgctctacatcgcctcgatgtgggtcaacggcatcacccaaggcctgatgtggcgtgcgatcaacgatgacggcaccctcacctactccttcgtcgaagcgctgcaagccagccatccgggctacatcgtccgcgccctgggcggtgcgttctttgccagcggcatgctgttgatggcctacaacgtctggcgcaccgtgagtgcctccgacccggtagaagccgaagccgccgccaagatcgccgttgtgggagctcactgatgaagcatgaagtagtcgagaagaatatcggcctgctggccttcttcatggtcatcgccgtgagtatcggcggcctgacccagatcgttccgctgtttttccaggacgtgaccaacaagccggtcgaaggcatgaagccgcgcaccgcgcttgagctggaaggccgcgacgtctacatcgccaacggttgcgtgggctgccactcgcagatgatccgcccgttccgcgccgaaaccgaacgctacggccactactcggtggccggcgaaagcgtgtgggaccacccgttcctgtggggttccaagcgtaccggcccggacctggcccgcgtcggcgcacgttactccgacgactggcaccgcgcgcacttgtacaacccgcgcaacgtagtgcctgagtcaaaaatgccggcgtacccgttcctcgtggaaaacaaactcgacggcaaggacaccgcgaagaagatggaagtcttgcgcaccctgggcgtgccctacaccgatgaagacatcgccggtgccgccgcagccgttaagggcaagaccgaaatggacgcactggtggcctacctgcagggccttggcaccctcatcaaaagcaaacggtgacctgcatggatatcgggatgattcgtggcctgggcaccgttgtggtgatggtggcctttatcggcctggcactgtgggtgttcagccccaaacgcaagtcggagtttgacgacgcaaccatgttgcccttcgcggatgaccccgaagccatcaagcacgtcgagcaagcgtctaggagtaacaaagaatgactacgttctggagtctgtacgtcacagtcctcagtctgggtaccatcttcgccctgacctggctgctgctgtcgacccgcaagggccagcgcaccgagcagacggacgagaccgtcggccactcgttcgatggcatcgaggaatacgacaacccgctgccgaagtggtggttcatgctgttcgtcggcaccatcattttcgccctcggttacctggcgctgtacccaggcctgggcaactggaaaggcctgctgccgggctacaactacctcgacaacgacaagcaaacccccttcgccaacggccagaccggctggaccggcgtgcacgaatgggaaaaggagatggccaagtcggaggccaagtttgggccgattttcgccaaattcgccgccatgccgattgaagaagtcgccaaggacccgcaggccttgaagatgggcggccgtttgttcgcgtccaactgctcggtgtgccacggctccgatgccaagggtgcctacggtttccccaacctgaccgacgccgactggcgctggggcggcgagccggcgaccatcaaggaaaccatcatgaaaggccgccacgcggtaatgccggcctgggctgaagtgatcggcgaacaaggcgtggccgacgtggcgggtttcgtggtgaccaacctcgacggccgcaaactgcccgaaggcgccaaggccgacgtggccaacggcgcaaaactcttcgccgccaactgcgtggcctgccacggcccggccggtaaaggcaccccggcaatgggcgcgcccgacctgacacatccgggtgcattcatctacggctcgagcttcgcgcaactgcaacagaccattcgttatggccgtcagggccagatgccggcgcaggagttgctgcaaggcaacgacaaagtgcacttgctggcagcctatgtgtacagcttgtcccatggggataaaccggctgaggagcagtaagcctcaggcatgacaaagccccgaattacggggctttgtcgtttctggcgcctgccatttcaacgactggcccctcaaccgctcgtaacatcaaacttgtcgaccgcggcggcaaagtagtaacgtaactacatcaagtctgccgaagggggatgccccatgaccatcaccaccatttccagccgtgaattcaatcaagacacaagtggtgccaaaaaagccgcccgtcaggggccggtttttatcactgatcgcggcaagcccgcccatgtactgctaagcattgaggactaccagaaactgacaggtctgaatgtcgacatcgtcgacctgttggtgatgccggaagcggccgaaatcgactttgaaaccgaacgtgccgtgatcactcaccgccccgtggacctctcttgaatgtacctgctcgataccaacgtaatctctgaacttcgtaaacctcaggccgacgcccgcgtggtggcctgggcaaaaagcgttatcgctccgcgcatgttcatctcagccattacgctgaaagaattggaaaccggcgtactgcggatggagcgccgagacccggctcagggaaaagtgctccgtacgtggctcaaacgtcacgtaatgccagcgttcgatgccaggatattgccggttgatgccgccgttgcgctgcgttgtgcccatttgcatgtgccggaccaggcgaacgaaagtgacgcactgatcgccgcgaccgctctggttcacgggcttaccgtggtgactcgcaacgtcagcgactttcaatcgagcggtgtcccactgataaatccctggagtgaatgaacttgcgcctcccgggcgcgtaaaacgctccaccgattactatcggcgaaacgttttatgagtacgcaccagcgaactattgacgaggttgaccgcccactcgaataggcccaacgggttgtggagtgaaatcacgaacgtaggggcgcgccccgtctacatcccttggcagatagtgggctaccaccccgacgaaacgttcaaatggatagctctgcgtattgctaccgacaaagcccctcaacgcttcgttattcagcaactcaagtgccaactgcttgatggctgggtcaccgttgccattggctatcttcttgagcgagtccagggtgatatacccttttttgtgagggtcttctaacctggaaaagttttccactgcctgctgcgccagtttggcatcctggccactcggcctatatcgtgcacctgtcggccttgcgtacacggccggttcagttgcgggcttctgggcgacgaatgttccaatttccatctttaagcactcctcaaagttgcaccggttcagagtgaacggtgtacccatgagtagcgaataaaccaacggccgttccagaagtacatatagcgtcacacacatgcattcttacagtatcgttctaatagttaataccacactgaacaatcatcgcagagcagtgaggcttcagaggccaaaaagccccgcgcagcaaacgccgacggggctttgttacttacgagggtagactgtacagacagtctcgggcttctatagggtgatcatgacgaccgcgtccagaaatcagcataatcccccttgtaataactcgctacctcctgccctctttcatcatactcagtcttctgaggatatcgggaaccataagtttctacacttgagtacccgactatttcttttagagtatctataccaatcttgtcatcaagggagccgttcggcgccgcatccatcctcttgaacaggtccagccggcgcaacagttcacttgcaaacgatgagtcttctgctgtaaacccatcctcgccctttgagtgcgccgcccgctcaagagaacttcgagtgacaacgttaggatcattcggatcagtaaattttttgaagttcatgacaaggtacttactcatggctttatcactccagccatcgaagtttttttcatcgatgctgggtgcgattgcgttgaatatattctgccgatcaatcttactgtctaacagacccttgccatctttgtccaacgcatacatgaagtcgtgccgcttcgaaatctctgcagcgaaggccctatctattggagcatgcgaacccgaaatagcgacttttctgagcgactcgggcgtgatatacccgcttttcgggtcggcgaatgtttcgaaattataaaacaagtaaagacctaacgaaaagttgctcgcagactgagcgaattgtgcgggtgtgagcttgggggcttccacaggcaaagtgctattagttgaatttacaaccggagcgtttacattcatagatcacctttagtttaaaaaatacagcatgaacgacttaacgtcattagagaaaatctgttttccaagaggccccaccaaaatcaccatgtttaacataacgattcctcatcagaagtgcgccatctcagttctttcggaccactgggcgacggggtgcctgccactgatgcatcgctggaaacatcctgctttgctgcctcttttctggcctcagaattcggctatttgtctgtccaggtaatgggttagtacaagacgggggtaatcaatgggctcgcctgatttaagcgcattagcaagctgacccactggaaaattgggtacaaacgaatttcgtccgacgtccatatattttgttccttcaaatgtcctgtacttggaattaagcaaggttccattaagtggataattaaaaagaacggttccttcgtataaattcgagtctgttaacaggcatttccgacctatcgaaacgtagggctcctacggcttggaaattaattgcgcacaaaccgactgcgtggctgacttggctcaccaaggcgcatcgtggcgcccacctgccccttcccgtactgactttgacgctgggacgaatgccctctgcggctgaaaaccgtccatacttcacaagtcaattgatccagatcacgtacaccatcaattgatttcccccaacgcgaccaaaggtcgcacccgttcagccgtaccaggggcgtatcattacgccactgcaagagcctatttttgaccccggttggcacgtactggccgaggcaaatctccaccgccgtgggatgcaatgatgagcaaccaaataccggtacatgacgttaccccgcctgccaaaaacgccagtcaatccgtcgacctttatgcgtcgcgcgagaaaatctacacccgcgccttcaccggcctgttccgcaatttgcgcatgctcggcggcgccggtttgttcctgctgtacttcggtacggtgtggctgaactggggtggtcaccaggcggtgtggtggaacttgccggagcgtaaattcttcatttttggcgcgaccttctggccgcaggatttcatcctgctctcgggcattctcattgttgcggcctttggcctgttctttatcaccgtgtacgccgggcgtgtgtggtgtggctatacctgcccgcaaagcgtgtggacgtggattttcatgtggtgtgaaaaggtcactgaaggcgaccgcaaccaacgcatcaagctcgacaaagcgcccatgggcgcccacaaattcctgcgcaaattcagcaagcacacgctgtggctgctgatcggttttgtcacgggcatgaccttcgtcggctacttctcgccgatccgcgaactggtgttcgacttcttcaccggccaggccgatggctggtcgtatttctgggtcgggttcttcaccctcgccacctatggcaatgccggctggctgcgtgaacaggtgtgcatctacatgtgcccgtatgcgcgcttccaaagcgtgatgttcgacaaggacaccttgatcgtctcctacgacccacgccgcggcgaagtgcgtggcccgcgcaaaaaaggtgtcgactacaaggcccagggcctgggcgattgcatcgattgcacgatgtgcgtgcaggtgtgccccaccggtatcgacatccgcgacggtctgcaaatcgagtgcatcggctgcgcggcgtgcatcgacgcctgcgacaacatcatggacaaaatggagtacccgcgcggcctgatcagctacaccaccgaacataacctgtcggggcagaagacccacaagctgcgcccgcgcctgataggttacgcgctggtgttactggcgatgatcagcctgttggtcggcgcatttttcatgcgttcgctggtcggtttcgacgtcagcaaagaccgtgtgctgttccgcgaaaacgccgaaggccgcatcgaaaacgtctacagcctgaagatcatgaacaaggaccagcgcgaccacacctacgtgctcgacgcctcgggcctgccggacctcaagctgcaaggccggcgcgagatcaaagtcgctgcgggggatatcgtcagcatgccggtggagctgtccagcgcccccgagcaactgccgtcgagcaccaacgaagtgaaattcatcctccgggatgccgatgacgacagtgtccacattgaagccaagagccgattcatcggcccacaagtccgttaataatcagagagcaaaacaatgcccgtagccactgccgcaagcccttggtacaagcacctctggccctggatcatcatcgggatcctggcctgctcggtgaccttgaccttgtccatggtgaccattgcggtgaagaacccggacaacctggtcaacgacaactactacgaagccggcaaaggcatcaaccgctccctcgaccgcgaactgctggcccagaccctgcaactgcgcgccactgtgcacctggacgaactgaccggtgaagtcgacgtgcacctgaccggcaacagcaacccgaccactctggaactgaacctgatttcgccgacccagccggagaaggatcgcaagatcaacctggcccgcagcgacagtgaaccgggccgctacctcggccaggtcaccgacaaggtcgaaggccggcgcttcgtggaattgctcggcgtggagggcgacaggacctggcgcctgttcgaagaagaacaggtcagccacgacaaagacttgctgctgggcgatgagccgttgcagggtgctgaagacctgaagaagtaaaaaacttgcgcttcgcgcatcgcgggcaagcccagctcccacaggaaaatacatgcctggtgtgggagccgggcttgcccgcgatgaggccctcccagccagctaagatctaaacccatgaccaccccaaccccctgctaccactgcgccctgcccgtcccgcccggcaaccggttcaccgccgtgatcctcggcgagcgccgcgagctgtgctgcccgggctgccaggcggtggccgaagccatcgtggccggcgggctggaaagctattaccagcaccgcagcgaagcctcggccaaccccgaggcgctgccggtgcaactggtcgacgaactggcgctgtacgaccgcgccgacgtgcaaaaaccctttgtgcgccatgacggcgaactcgccgaaaccactctattgatggaaggcatcagctgcgccgcctgtggctggctgatcgaaaaacacctgcgcagcctgcccgccgtggccgaggcgcggctgaacctgtccaaccaccgcctgcaggtgcgctgggccgacgggcaattgccgttgagccaactgctcagcgagctgcgccacatcggctacgccgcccacccctaccaggcggaccgcgccgccgagcaactggccggcgaaaaccgcctggccctgcgccaactcggtgtggcggggttgctgtggttccaggcgatgatggcaacgatggccacctggccggaattcaatatcgacctgagcccggagctgcatgtgatcctgcgctgggtggcgatgtttctgaccacaccaattgtgttctacagctgcgcgccctttttcaaaggggccttgcgcgatttgcgcacgcgccacttgaccatggacgtgtcggtgtccctggcgattggcggggcatatttggccggcatctggacggccatcaccggcgtcggcgagttgtatttcgacgcggtaggcatgttcgcgctgttcctgctggccgggcgctatctggagcgacgtgcgcgggaacgcacagccgccgccaccgcgcagttggtcaacctgctacctgcctcgtgcctgcgcctcaaagaggatggccagagcgaacgcatcctgctcagtgaactggccgtgggtgaccgcgtatccgtgcaccccggcgcggtgctgccggccgacggggtgattctcgacgggcaatccagcatcgatgaatccctgctcaccggcgaatacctgccacagcctcgccacgtgggcgatacagtcaccgccggcacgctcaatgtcgaaggtgcgctgaccgtcgaggtccgcgcgctgggccatgacacacgcctgtccgccatcgtgcgcctgctggagcgcgcccaggcggaaaaaccgcgcctggcgcagatcgccgaccgcgcggcgcaatggttcctgttgtgttcgctgatcgcggcggcattgatcggcttgctgtggtgggagctggacccgtcgcgggcgttctggattgtgctggccatgctggtcgcaacctgcccgtgcgcgttgtccctggccacgccgacagccctcaccgccgccaccggcacgctgcacaaactcgggctattactgacacgtggccatgtgctggaaggcttgaaccagatcgacacggtgattttcgacaagaccggcaccttgaccgaaggccgcctggcactgcgtgcgatccgccccttgggcaggctgaacagcgatgaatgcctgagcctcgccgccgccctggaaaaccgttccgaacaccccattgcgcgggcctttgggcgtgcaccgttggccgccgatgaagtcctgagtttccccggcctgggtcttgaaggccgtgtgggcgagcatcaattgcgcatcggccagccggggtttgcctgtgagctgagtggctgcccgatccccgcctcgccggacgaagccgggcaatggctgctgctcggcgaccgcgacggcgcactcgcctggttcgtgctggatgaccgcctgcgcagcgacgcacccgccttgctggcggcgtgcaaggcgcggggctggcgcacattgctgctgtccggcgacagctcgccgatggtggccagtgtcgccctcgagctgggcatcgacgaagcccacggcggcctgcgccccgacgacaaactgcaagtgctgcaacaattgcacaaggaaggccgcaaggtgctgatgctcggcgacggcgtcaacgatgtgccggtgctcgccgcagccgatatcagcgtggcgatgggctcggccacggacctggcgaaaaccagcgccgacgccgtgctgctgtccaaccgcctcgacgcgctggtgcaggcgtttacgctggcgcggcgcacgcggcgggtgatcatcgaaaacctgctatgggccgggctgtacaatggccttatgctgccgtttgccgccctcggttggatcacgcccatctgggcggcgatcggcatgtccctcagttcgttgaccgtggtgctcaacgccttgcgcctgactcgccaaccgagcgcgccggctgacagcgccactttagtaacccgcccgttgccggcttgagccgcgcgggcatggagtacagatgccagctctctacgtgatgattccggcggcgctgctgttagtcggcgtggccatttacatcttcttctgggcggtggacagcggccagtacgacgacctcgacggcccggcccacagcgtgctgttcgacgatcaggacccgaaccacctggccgccgtcgacgaagccaacggccccgagcaaccgcccaaagacccgccccatgcttgaactggcgcccctgctggtctcggcgctgatcctcggcctgctgggcggcggccattgcctgggcatgtgcggcgggctgatgggcgcactgaccctggcgatccccaaagagcaacgcagccgccgctttcgcctgctggtggcgtacaacctggggcgcattctcagctatgccagcgcaggcttactgatcggcctggccggctgggcggtggccaacagcccggcggcgatgttcatgcgcgtgctcgccggtttgctgctgatcagcatgggcctgtacctcgccggttggtggagcggcctcacccgtatcgaaagcctcgggcgcggcctgtggcgctatatacagccggtcgccaaccgtttgttgccggtgtccagcctgccgcgtgcgttgctgctgggtgcgctgtggggctggctgccgtgcgggttggtttacagcacgttgttgtgggcggcgagccagggcaatgcggcagacagcgcattgctgatgctggcgttcgggctcggaacctggccggtgttgctggcgacgggcctggcggctgaacgggtgacggcgatattgcgcaaacgcagcgtgcgcgtggccggcgggcttctggtgattctgttcggcatatggacattgccaggcccgcaccagcactggttgatgggccattaaaaggccatgtggcatagcgccgctccccgttgatgcaaatcaagatgccatcgcagccctgcccctagactcggcccactagccaatccgggggaccgcccgcatgctcgacgccattcgttgggacacagatctgattcaccgctacgacttggcggggccgcgctacacgtcctaccccaccgccgtacaattcgacagccaggtcggtaccttcgacctgctccacgccctgcgcgacagccgcaaggccgcgcggccactgtcgctgtatgtgcatgtgccgttctgcgcgaacatttgctactactgcgcctgcaacaaagtcatcaccaaagaccgtggccgcgcccaggcttatttgcaacgcctggaacaggaaatccaactggtggcctgccacctcgaccccaaacagccggtggagcagttgcacttgggcggcggtacgccgacctttctcagccacgacgagttgcgccaggtgatgacgcgcctgcgccagcacttcaatttgctggatgatgattccggcgactacggcatcgagatcgacccacgcgaagctgactgggcgaccatgggcctgctgcgtgagctgggcttcaaccgtgtgagtatcggcgtgcaagacctcgaccccgaggtgcaacgcgcggtcaaccgcctgcaaagcctggaagaaacccgcgcggtgatcgacgcggcgcgcaccctgcaatttcgctcgatcaatatcgacctgatctacggcctgcccaagcagacgccgatcaacttcgcgcgcaccgtggaggaagtgatcagcctgcaaccggatcgcctgtcggtgttcaattacgcgcacctgccggaacgcttcatgccgcagcggcgaatcaacaccgacgagctgccctcgccggcggaaaaactgctgatgctgcaaaccaccatcgagcaattgacccgcgcgggctatcgctacatcggcatggaccactttgccctgccggatgatgaactggccatcgcccaggaagaaggcacgttgcaacgcaatttccagggctacaccacccatgggcattgcgatttgattgggttgggggtgtcggcgatcagccagatcggcgacctgtattgccagaacagcagcgacctcaatcactaccagaacgccctggccggcgcccaactggccaccagccgtggcttggtgtgcaccacggatgaccggttacggcgcgaagtgattcagcagttgatctgcaccttcagcctgggcttcgagcagatcgaacaggccttcaatatcgattttcgcggctatttcgacgagctatggccacagctggagacgatggccgcagacggtttgatcgagctgaatgcgcaaggcatccacgtgctgcccgccgggcgcctgctggtgcgctcggtgtgcatggtgttcgatgcctacctggagcaccagaacaggcaacgattctcgcgggtgatctaagcctgaattatttcgacagcagcgtcatggcttccatttgagcctcaggcggctcgtctttgagcgacttggccagttgtgcctgggccgtcatcaaaccggcctgaatgttagcgatatcgccctgcaatccagcgaccttggcttggcgcgcttccgggctcatggtggtgtcgttcatggccgccgacagctgagccattttctcggcaagctgctttctcagttcgcggatcattttcagcaactgcttgatgttgtctttcagattgctgtcgtcgatgtctttgttggggttgctaccggtctgggaggctttgagcccggcaccggatatcgtcaccaccacgccttcaccgggggtgggtggcggcgcgggtttgtcatcgacttttttgcccgcgagcgcctctgcggccgtcagcacctggggtgccttggtagtaatgactgggttattgactgggattaccgacatgacctgagctccagctcatagggattcacctttgtatcggcatcgatacatgaacctttatccatgtgcggcttttttgtacacgctggcctcatccaccctcggtgcgttacccttacgtcttatgtgtgttttcccacaaggatttaagaaatgtccgagccagttaaactgcgcgctcacagccaggctcactgcaaggattgcagcctggctcccctctgcctgccactttcgttgaatttggaagacatggaagcgctggacgaaatcgttaaacgcggtcgcccgctgaaaaaaggcgagtttttgtttcgccagggcgacaaattcgattccgtttatgcagtacgttcaggcgcgttgaagacgttcagcctgagcgacagcggcgaagagcagatcaccggtttccacctgcccagcgagctggtcgggttgtccggcatggacaccgagattcacccggtgtcggcccaggccctggagacgacgtcggtgtgcgaaatccccttcgaacgcctggatgaactggccctgcaattgccgcaactgcgtcgccaattgatgcgggtcatgagtcgcgaaattcgtgacgaccaacagatgatgctgctgctgtcgaagaaaaccgccgacgagcgcatcgccacgttcctggtcaacctgtcggcgcgcttccgtgcccgtgggttctcggccaaccagttccgcctgagcatgtcgcgcaatgaaatcggcaactacttgggcctggcagtggaaaccgtgtcccgcgtgttcacgcgtttccagcagaacgagttgattgccgccgaaggcaaggaagtgcatatcctcgacccgatccagctgtgcgcactggccggaggttcgctggaaggctgattcagccgctgcggccgcgccaatcggtgaggccgcaggtatacttcgagtccgttttcaaccctcaggactcttcgacgatgaccttcgattcgttcgacatcaaatccctgatccgccccgtcatcgacttccccaagcctggggtgatctttcgtgacatcacgccgctgttccaatcgccccgcgcccttcgcctggttgccgacagctttgcccagcgctatgtcgaagccgacttcagccacatcggcgcgatggatgcgcggggctttttgatcggctcgatcatcgcctatcaactgaacaaaccgctgatcctgttccgcaaacagggcaagctgccggctgacgtgctggccgagggttaccagactgaatacggcgaagccttcctcgaagtgcacgccgacagcctgtgtgaaggcgactcggtattgatgttcgatgacctgatcgccacgggcggcaccttgatcgcagcggcgaatttggtgcgacgcatgggcgcgaagattttcgaagcggcggcgattatcgacctgccggaactggggggttcgcagcgcctggaagacatgggcattccgacgttttgcctgacgcagtttgcgttgactgagcgttaagaggcgcctgtcagggcctcatcgcgggcaagcccggctcccacaggtgatgtgggagctggcttgcctgcgatagcgcccgaaaggacaatgcagatcacaagcccatctgcttactgatgatttcattcatcacctcgcgcgtgccgccgccaatcgacaggatgcggttatcgcgatacagccgctccaccagattgccacgcatgtaaccttggccgccaaggatctgcaccgcgtcataagtcacacggtccgccgtgtcggtggcgaggttcttggccatggaaatctccttgatcacactcttgccggccgccatcttcgccgcctggcgataggtgaattcgcgcgagacttctaccgccgtggccatttccgccagccgatgcttgagtacctggaatttgccgatgggtttgccgaaagcctcgcgttggccggcccatttcaggctttcctcgagtgcaagctgcgcggtcatgttggccatcaaggccaaggccagccgctcgctctggaaattgcccatgatgcaggcaaagcccatgttctcgacgccgatcaggttgcccaccggcacgcggcaatcgtcgaagaacaactcagccgtgtccgacgcccaccagcccattttcttcagcggctgaccgacggtgaaaccgggcgtgtgtttttcgataagcaataaactgataccgccaaatcccggcccacccgtgcgcacggcgacggtatagaagtcggcacggatgccactggtgataaaggttttgctgccgctcacgcggtaatggtcgccgtcacgaatcgcgcgggtttgcaggttggccacatcagagccaccgccgggttcggtgaccgccagcgcgatgatcttctcgccggccaatacctgaggcgcaacgcgctcacgcacctcgggccgcgcccatttaacgaccggcggcaagccgatatccagcgaacccaagcccgccaccaccccaccggaaccgcagcgcatcaactcttcgctggcagcaaccttggcgaacacatcgccttcatggctgccgcccaaggcttcgggataaccgatgccgaggatccccgccgcgccggccttgaggtacagctcgcggggaaagccctgcgcttcctcccattgctcgatgcccggcagcatctcgcgctcgacaaaacggcgcacgctgtcgcggaccaattggtggctggggtcgaagtagtcctgataggcagacatcggcaagctccacggtgaggtggagcgaacttaccaagcgcttgcttggttttcaagacactggggtcacacaaaacactgtgggagctggcttgcctgcgatagcggtggatcagtgacagtgatgtcgactgaaacgccgccatcgcaggcaagccagctcccacattttttagatagcggtgtggcttagagtgcgatcggcttacggcccgcaaacgaatgcgccaacgtcccaccgtccaccagctccagctcgccacccagcggcacgccatgggcgatgcgcgaggtgatcaagcctttgttggtcagcaactgggcgatgtagtgcgcggttgcttccccttccacagtcgggttggtcgccagaatcacttcggtaaaagtaccctgctcttcaatgcgcgccaccaactgcggaatgccgatggcttccggtcccaggccatcgagcggcgacaggtgccccttgagcacaaagtagcgcccgcgatagccggtttgctccaccgcgtacacgtccatcggcccttccacaacacacagcagcgtgtcgtcgcgacgcgggtcggcgcattgcgggcacaggtcttcttcggtgagggtgcggcactgtcggcaatggcccacgccggtcatggcctggctcaaggcctgggccaaccgggtgccgccgctgcgatcacgctccagcagttgcagcgccatacgctgggcggttttctgacccacgcccggcaaggtgcgcagtgcgtcgatcagttggcgaatcagggggctgaagctcatgagcgaatggtccgacaaaacaacgagacgcggtttatacccgcgcctcggattagcgtcaaatggtcaatcctgcgcgacccgcaccaccaacttgccgaagttgcgcccctcaagcaaaccgataaaggcttcgggcgcctgttccaggccctcgaccacgtcttcgcggaacttgatcttgccgtcacgcacccagggcgccatggcgctgaggaactcgggctggcgatcaccatagtcgtcgaacacgataaagccctggatgcgcacgcgcttggtcagcaaggtgcgttgcaacgccggcaggcggtcaggcccgctgggggcttcatgggcgttgtagccggcgatcaacccgcacagcggaatgcgggccttggggttgagcaagggcaccacggcgtcgaagaccttgccgccgacgttctcgaaatagatgtccacgcccttgtcgcacgcctgcgccaattcgttggcaaagtccgcgctcttatggtcgatgcaggcatcaaagcccaattcgtccaccacgtagcggcacttgtccgccccccctgcgatcccgatgacgcgcaagcccttgagcttggccacctgccccaccaccgaaccgaccgcgccggacgccgctgccacgaccagggtttccccctccttcggctggccgatgtccatcagccccatgtaggcggtcatgcccggcatgcccagcacacccagggccatcgacgggctggccagcccttttggcacggggatcaggttgcgaccatcggaaatgctgtggctctgccagccggtggaaccgacgaccaaatcgcccacttcgaatttcggattacgcgactgctcgatgcggctgacagcgccgccggtcatgacctcgtcgatttccaccggcgccgcgtaggacggcgcgtcgctcatacggccacgcatataggggtcgagggacaggtacagcgttttcagcagcacttggccgtctgccagctccggcaagttcacgcgttccaggcggaagttttccggggtcggcgcgccctgtgggcgggaaaccaggacgatacgctggttcagaatgggttcttgaggcatcaggaggctcctttatcgaattcatcggtatagggtgcagaccatgacaaagcgcttggggttcgatgtttcgtctgtggcaccgattcgtctgcagcgcaggcaagccagcttccaccctgactccatcacgccaaaaaaaatgccaggcacaaggcctggcatttgagtctagccaaggctagcggatcagaacggcagcttcatgcccggtggcagttgcatgccggcggttacaccgcccatcttttcctggctgttggcttcgatcttgcgcacggcgtcgttgacggccgcggcgaacaaggcttcgagcatttccaggtcatcttcgccaacacctggcaagacgcttgggtcgatgctcacgcgcttgatgtcgtgacgaccggtcatcaccacgctgaccatatcgccaccggctttaccggtgacttcggcgttggccagttcttcctgcatcttggccattttttcctgcatctgctgcgcctgcttcatcaggccggccatgccacctttcatcatgggaatcacctcaaagtacgtggatcaattagtagcccggtgttatgacgcttggggcaccggggcgtcgacaggttcaatagtatcgtggcgcacgacggcgccgaactgttgcatcatttgctggatgagcggatctgcgtggatcgagctttctgcgtcacgctggcggttcaggcgccgacgggtggcggcctgggccggggtttcctgctcgggcttgatcaactcgatggcgatggtcagcgtgcgctcatggtactggttcagcgcatcgttgagccggcgttgctgagtcgcgttgaacaaggcgctgtgggccgggtccaggtgcaacagccagtggtcgccctcgatagaaatcagcgtgcagttggcggcgatgctgccggtcatgccggagatcggcaatttcggaaacaattccaaccattgcaatgccaacccggtggccggggccgcagcgggttccgcttcgggctcgggtgccggctcggcggtgtgttcgctggccagctcatcgaggtagctgtaggccgaatccatgtccggctcgatatagtcttcgtccaacggcggttcgtcgtcgaggtcaatgcccggcgtggcggcttcgacctgggcaacggtcggttccggcaccggcgctgacacccactcgggcgcgtccggcaccgcgctgtcgggcgtcggcgtaggcatcggcgtcagttcaggctgctcgccactggtttccaatacgggctcaacggcgggctgcagctcaacctcaggctcggcgtccaccgggtcgttccagggcaggtcgaccaccggcgcgggcgcaggcgcaggctcgatcaccggctcagcttcaaccaccggcgcagcgaccaccggcgcgggggccggggcaaccggcgcaggcgcagccaccactggcgcgaccacggccgcgccagccactggtttggcggaatcaactgtggcctggctgatccccactggctttagcggctgtctcggcgcgtctgccgagtcggcgggccggaaggccagcatccgcagcaggaccatttcaaagccgccgcgcgggtccggtgcgaggggcaagtcccggcgcccgatcaggcccatctggtagtagaactgcacatcttcggccggcaatgcctgggccagcgccaacacgcggtcgcggtcgccatggccgttgtcgacgccttcaggcaaggcctgggcgatggcaacgcggtgcaatacgttaagaatttccgagagcacgccgttccagtccgggccttgctccgacaagtggcgcacggcttcgagcaacgccttggcatcgccttcgatcagcgcgtgcagcacatcaaacacctggccgtggtcgagggtgccgagcatggcgcgcacgtcggcggccatgaccttgccttcaccaaaggcgatggcctggtcggtgaggctcatggcatcgcgcatcgaaccatcggcagcgcggccaagcagccacagggcgtcgtcttcgaacggcacgttctcgacacccagcacatgggtcaaatgctcgaccacgcgctcaggggtcatgttcttcagggaaaactgcaggcaccgcgacaaaatcgttgcaggaagtttctgcggatcggtggtggccaggatgaatttgacgtagggcggcggctcttccagggttttcaacaaggcgttgaaggaatggctggacagcatgtgcacttcgtcgatcaggtagaccttgaagcgcccacggctcggtgcgtactgcacgttatcgagcagttcgcgggtgtcttcgaccttggtgcggctcgcggcgtcgatctcgatcaggtcgacgaaacgcccttcgtcgatttccttgcacaccgagcaggtgccgcacggcgtcgaggtgatacctgtttcacagttcaggcatttggcgataatgcgcgcaatggtggtcttgcccaccccgcgtgtaccggtgaacaggtaggcgtggtgcagccgttggctgtccaaggcattgatcagagccttgagcacatgggtctggccgaccatttcgcggaacgagcgcggacgccatttacgtgcaagaacctgataactcatcgaaaaccgtcgcaactgggaagcggaagccggtaatgctagcggagcaagggggaaattgcatccggcacgctcgtctaatctgactaagctctgtgcaatggccccgcaaaggcctgaacccggagagtgtatgcgcgtagtcctgggcgccttatggatgatttcgcttgccagcctcgcggcacccgcgccgttgcgcttctcggtttccgacagctggggcatgcccatggcccagctggagggcaaccggcccacccagggccttttgtatgacttgatgctgagcctggccacccaggtcgggcgccctgccgagttccacgtgctggcacgggcgcgcatcgccaatgccatggcgcaaggcgacattgatgtgcgttgctatgtggcccaggcctgggtcgacaacctgtccggcgactacagctggagcgtgccgctgatggtgcagcgtaacgtgctggccagcacccacaccgcgccgcacacggtgcaagtggccactttgccggcccagtcgatcggcaccgtactcaattaccgctatgcggcccttgagccactgttcgccagcggccaactgacccgcgacgactcacgcagcgaagagttggtgctgctcaagctggtggccgggcgctttgaatatgcggtcatcaacgaatggatactggaccgcttcaacctgaacctgccacccaaccagcgcttgcagaaggtcgcgatcatcgatgagcaaagcctgggctgcatcgtgcgcaacgacccgaacgtgccggtgcagcagatcttgcgcacgctgctgcggatgaagatgtcgggggagatcaacgacatcatcaagctgtacaccggcgaagaggcgcaaaccctgcacactcctgacaagaactgacaggactgccttatagactgggcccacttaaccgcccgctctcaaggagccaccatgcacaccgtcgcccattatttcctgctctacgtcgacagcccggccaccagcgccaacttctatagccgcctgctgggcacgccaccggtggagttgaacccgacctttgcgctgttcattctcgacaacggcgtgaaactgggcttgtggtcgcggcacaccgtggaaccggcggcgcgcctcaccggcggcggtggcgaggttgggttttcgttgcccgaccaggcggcggtcgatgccctgcatgatcagtgggtcgcacgcggcgccacgatcatccagtcaccgaccaccctcgacttcggctacacctttgtcgccgaggacctcgatggccaccggctgcgcgccttcagcctgagcgactgaccgccagcgcccctccaggctgatcgccgcaacgctggccagcacgatcacaccgcccagcatcacctgcacggcaatgtgctcgcccagcagcgtcgccgccagcaacatggccaccggcggaatcaggtacatcgccaccgacgcgcggctgacctcgacatgtttcaacacataggcccaggcgaggtacgccaaggcactggggaagatgccgaggataagcaccgcgaggttttccgccagcggtgcctgcccgacggcatcggccaggcctggcaagttcacgcacagcatcaaggtgcccgcccacaccatgtagcacgccatggtcagcgggctgtaacgatgggcgtaatgtttctggatcgcgaaataaatgctccacgacaccgccgccaccaggatcagcaaaccgcgcgggtcgatgtcccccacgccatgatcgccccagatcaccaccagcacgccgagcaaccccagtaacacgcaactccagcgccaggcactgacgcgctccttcaggcagaaaaacgcgatcaacacactgaacagcggcgccgactgcgccagcacactcgacgccgccgccgtcacccattgctgcccgtaattgaggctggtgtggtgcaggaacacgccgaaaaaacccagcaccagcaaccacggcaggtcgcgccaacgcggccggccaatgcccaccatcagcgccacgccgcccatgaataccgacgcaatcagaaaccgcagcagcgccagctggccggggctgtagctgtgcagcccgatgtgcacgccaatcggcgaataggcccaacagaggatgacgccggcgatgactagcgtaatctttacgggtgacggggtattcatcgacggcgtccggcaactgagtaggaatgccgtcagtcttggcccaggcaaggcgcaggacaattaagcgtttctgacttctgaaatcactggaactgagcaatggaactggcccaactgaaaatggtgcgagccgtggcgcaaaccggcagcgtggcccaggccgccctgcaattgcactgcgtgccgtccaacatcaccacgcgtatcaaacagttggaaagcgagttgggcacgccgctgtttattcgtgccgggcgcgggctggcgatcagcgccgccggtgagattttcctggattactgcgagcgcatcctggcgctggtcgacgaatccaaacgcgcagtggatgccaacgcgattccccgcggcaccttgcgcatcggcgccgtggaatccagcgccagcggccgtctgccgccgctgctggcggaatatcaccggcgctatcccgatgtaagcctggaactggtcaccggtgcatgggccgagctgcttgatgatgtgcaacaccatcgtctcgacgtggcactggtggcggccggaggcaaacgcgccaagctcgaacacagcgtggtctacagcgaacgcctggtgctgatcgccagcgcctccagcgccccgatcaacagcgccgaagacctggccgggcgcaccttgctggtgtggccacccggctgcccgtatcgcgccgcgctggaaaactgggtcaagccccacgacttcaagccaagcatcgccagctatgccagctggggcacgatcatcggctgtgtcagcgcgggcattggcgtggcgttggcgccggaaggcattctggcccgctatgagcaggccaatcagctggcgtcttaccggtttgaggaactgcaggcggtggacaacctgctgttctggcacaaggacacccaacggcacctggcgcgggatgcgtttgccgggctgctgcgggagacttttagctaactcgttgggcaaatttcagatattctcccgcgaaattaattcaaaatgtaagggactaccatgaattacatccgcgcgttgatggcggcggccgccctgagcctgtctgccgcacccgcttttgctgcacccgcacctgctcctgctcctgctgaagccagcgcccccgctgaaacggccgaacacttcctcgcctcactcaagcagaagaccggcacagtcaccctgccgagcggcatcgccacgctcaagctcaacgatgagttctactacctcgacccgtcggacaccgagcgcttgctgaccgatggctggggcaaccctcccggcttcaagaccttgggcatgatcgtgccgaaggcggtcagcccgttgtcggaaagcggctggggtgtgattgtcagctacaaggctgacgggcatgtttccgacgaggatgcggcgaaaatcgactatgccgaactgctcaagcagatgcaggaagaagacgaagaagacaacaaacagcgccagaaacaaggctacgccggccttcacctgctgggctgggccgagccgccgcactacgacgacaccacccacaagatgtattgggcacgcgaactcaaagccgacgacgcccagcaaaccaccctcaactacagcatccgtgtgctgggccgtgaaggcgtgctggaactcaacgccgtcgccgccatggccgacctcgccaccatcaagcaggaaatgcccaaggtcctagcctttaccaactttaccgacggcaacctgtacacggacttcaacccaaagaccgacaaactggccacttacggcctggcagccctggttgccggcgggatagccgccaaggccgggttatttgccaagatcggcatattcctgctggcggcgaagaagtttctggtggtcggtgtggtggcgctgttcgccctgatccgcaagttgttcaatcgcgataaagcctgaacccaggcataaaaaacgccgcagcgtgcatgacacgttgcggcgtagcgaatgggctcagatctgcgcagtgatcagggccaatatgcagctgtagcggctcagtttttcggcgcagacagccggctgtattcgtcctggctgatccagccggtgtacgtatggtccttggcgttggtgaactcaacgtgggcccaaccctccttgaatgccagtacgcccaccacatcatccttgacgatatacgggcgcttggctgcatcggcgccgggctcttcgagcaagtaagccttgtcggccgacaccgtcaccaggccgatccactgcgtgttggccgtctgggtcagctccaggcccgtggcaatttccggcatcagcacgctcatgcagccaggatgctggcggcccttttctacggtcagcgtcacgccgtcggacgaagccgccacgctgccggggtaggcctcgtcaagccaggtggtaagggcttcgggtttgccttgcaggtagaacgcacagctgcgcgtcacgccctcgccaagttcttccgcgtaataaccttcgacctgatgctcaggcgtgaccgccagcatcagcccttcgtatttgcctgaatgcaaggctgtttcgcccgcaaatgccggcgcgatagcgcacaacgacaaaacacctgctgctagaaaacgcgtcatcttattttttcccttccaatgcttcgtaggccttcttgatacggcggtcatagtcgccgtaatcctcgccgttatagttgcgcgccatggcgacataatctttatttttcatggctttgatcaacgccgggctctggctgcagaagccgataaaggcctttagttggttgccggcattaatctttaatgccgccgcgaattcaaacacggtcttgtaaccacacgaggtgaagttgaaccccatgatctgaaacataccccaggacgccgacatcaacgccgcttcctggtccagagcaaacgcggtggccatggtttcccaggccttggtctggtccttgttgttgacctgccactgcggcccggcttttcgcacataggggtaggacagcagaggatgcgcctggtcataaatgtgcttggtgtatttgcgaaacaggtgcccttcaaaggcgatcactggcaacttggccggcccgaaaccggaacgcccgccggactcgacagtggcgaaggccttgatgatattcaccgaaataccgctgcccaactgggtggcggcgttctggaagtcggtgtcggtgagcgtcatgccgccgtcgcacgtggcctggagcatcaattgccggttacgccgctcggcctcgaccatcgcacgcatgcggtccaggtacacattgaccgtggcctgcaccgcgtcgccgttgttattgccaaagacattcagaaaactgggaatgcgcatcgtcgggaaggcctttacgggcaccttcaccgcttcttcgatcaggctattgaaggtccgaccagttgggtcgatcacgccatcggggtgcgcatacttgagatggcgaaactgatactggctgatgcactgcaccaactggccgtcacacttgccgttttcggccagcgcaacccccatcttgggaatgatcaaattgaaaagatactggatgcactgaacatcggcaggcaagttgcgcgctttacctggcgcgccgaccgaagcactgataagacggggcaaccctggcaggcttttcatcacagacatccttgttagttaaagaagtgatagcacttcagtatcaagccgacacacttgtcataaattgaaacaagtggccggcggaaactaacaatatggttttgggttgtccagagggcgtttggaatgttgtgaaatagccgtcatgcgcggctattttttcttttccagcgcctcgaaggctttctggatgcgcttgtcgtaatcaccatagtcgctgccgttatagatgctggccatgcccacataatcctttttcttcatggcattgagcaggctcgggttcttgcggcaaaagccgacgaacgccatcaattgctggccggcattgagcttcatcgcggcaacgaactcgtacacggtcttgtagccgcagttggcgaaattgaaacccatgatttgaaacatgccgtaggacgccgacagcaacgccgcctccgggttgaggttaaacgcggcgaccagcgtctgccacgccttcgcctggtccttgttattggcccgccactgcgggccggccttttctttgtaggggtaagacaataagggataggccgcgtcgtactttcgttgagtgtgcttgcggaaaatgtgcccttcgtaagcaatcaccggcatttttgccggcccgaacccggaacgcccaccggactcgacgatggcgaaagccttgatgatattcatcgcaacagcgccgcccaattgggtggcggcattctgaaagtccgcttcggtcaacgtgacgttaccgtcgcaagtggcctgggtgaccaacttttgtttgtccactgctgcctggatcggtgccggagcgcgctctggggtctgctcgacttttacaccggtcgcgttattgacttgagcaacggccttgcgcgcgtcctcaagcaagctgttgaacgtccgccctcccgggtcaatcaccccgtccggcttggccaccttcagacggttcaactgatagtcgaggatgcgctggaccaacaacgggccgcacttgccgtccaccaccaagggtgaaacagatttgggcgcaatcagattaaacagacgttgaatgtgttgaacatcggcaggcacattgcgggccttgtctgtggtgccgacagaggcactgataacactgggtaatgcttggaggctggtcatggcaatcatccttgttgatcaacggagtgccatcacttcttcactactccagcaccggttcacatgtatcaatgaagctagcagcccgcctcgttttgtccagccacgagacgaggcgtggtgaaacgctcaagggcgctcacaacccagtcgctttgcaggaggcgtgctgccaacactttgtgagtattcagccgccaattgcactattgtggctgcgcaaggagcctctaaaacactcaaggattgaaatgaaagcctctctacttattttgtcggtcgtggccttgttgtccggctgcgcatcgtcctcgactgctgtcgccccagacctttcactcgcctccatcgccgaaaccaagtcggtggtgtttaacggcaagacatttgtcctgaaataccagaaaaatggcttgtgggaatatttcccggaacaggaaagcgttgatgcatggactgagatgctggacttcactgtcgtccctttgggcgataaacgcatcgaaccgctggacttgggtcaacgcactgtccagttgcaccagcagcaaaacccggacatgccggcggtcctgacgacggacaacaagaccgggatcctgtatctgatgctgttcttcccctcgtcgctgcgcaaagacgggcatttctctgagtacagcttcttcaagtattaccgcgacagcggcacgggccagatcattatttttcacttcgccagaaacgtagcggccaagtcacagacaccggaggagcgctgggaaagcaccacggaaataggccatgaaatcgtgccggtgataaaggcatttcccaagtaccgcccgtaatgcggttgagcgcgcagcagaaatcgcttcgcagacattgattgtcggcaaaaacgtaaaaaaattgggatttgagggttgtttcgcgaagagcgttatggaggcaaccccaccagccacaccccggcacacaatgttcccgctgtggctgctgccttccggctctgaccaggttcacgggtaatcgttgcggggggaccgatggggtcaccataacgacgctggcctctcggcaagcggggccattgtaccgatctcatcggaagttacaaccgttggtgccggattaaaaagccaaggggttcaagtacttgccatagtgtcagattcaccctcttgcaaatgtgggagctggcttgcctgcgattgcgtcaccctggcgtacctttcacaccgaagcgcctgcatcgcgggcaagcccggctcccacattttgatcactgggcctgtaatacctcatcagccctgccgccctcttcctgaatcaccaggtgaatgaagtgcagcttggcaatcaccgccggcggcaacacgaagggatagaaatccggctggcccatgctgcgcgacagctcgttgagcatgccggccagttcgatccaggcgttgacgaatgacaggaatgccgcaccgccagggtgttcggggtcgtagagcgtcgtgagcggaaacggctgataatccaggtccatctcgcgggcgctcatgccaaagcccagggcggtgtcgacggcgtccatcatgtgcaggtagtgagcccaggtttcggcccagtcttcccaagggtgcatggtcgcgtaggcgctgacgcaggtttgctgccagtcgggtcgcgggccgttctggtaatgctgctcgagcgcatcggcatagctggcgcgttcgtcgccgaacagggtgcgaaagggttcgagccaatggctgttggcgatcaaccggtcccaatagtagtggccgacttcatggcgaaagtggccgagcaaggtgcgataaggctcgcgcatctgtacgcggatcttttcgcgatgggcgtcgtcggcctccttgatgtccagggtgatcagtccattggcgtggccggtggtgggcgcgttgccctccaggtcgatgccgacgaaatcaaaggccaggccggtgtcttcatcgacgcttttgggcaccacttgcaagcccaggctgatcagttgcgccaccaggcgacgcttggcggtttccactttgcgccagcgctcggggttttccggcacggacaggtcgggaatggtgcggttgaggctgcaagccacgcacaacggtgcggtgctatgggcaggaatcagccagttgcaggctgccggggtgtcgaggttggcacagcgacggaaggcgccggcggcgaggttgtcgtccgccagccaggtatcggcgacaggcccaggctgaagggaggacaggcggctttgctgcggctgatagcccagcagcgcctggcacgccaggcactggctattgcgaaagaacagcgactggccgcaacggcattgccacaccttgctgttacgcgaggtttcggccatgaacggtgcggcgatgcgcgaactcagttgctcgaagtagcgaaacatggcgatctctccctggatgaccaagactagatcatctcccactgaagatcgttcccacgctctgcgtgggaatgcaccctgtgacgctccgcgtcacgacgttcaagagcggacgcagagcgtccagtgcggcattcccacgcagagcgtgggaacgatcagtcagacggtgatgttgtgcttggccaggaacgcaacgaaggcttcttcgtccagcaccttcaaaccaagctcggtcgccttggccaatttcgaaccagcgcccggccccgccaccacgcagtgggtttttgccgacaccgaacccgccaccttggcgcccaggctttcgagcttgtccttggccacatcgcggctcatcagctccagggagcccgtcagcacccaggtatgcccggcctccggcaagccttcgaccaccttcttctcgctctgccagtgcatgccgaagtccttgagctgctgctcaatggccagggcgtggctggcgttgtcggggttatcaaaaaagtcgcgcacggccttggcctgcttctccggcagcgcctggcgcatgtccagccagtcggccttgatcacgccttccagggtgccgaacttgtccgccagtttctgcgcggcacccgggccaacactcggcacgtgcagcttgtcgagcaaaccgcccagcgtggtgctggcggcgaactcggcgctcaggtcgccctgatcctgcaattgcagggcgcattcgtccggcgatagcagcgcgccaatcacttcctggttatggctgtcctcaaagaagctgtgaatctcgtgcgccacttccaggccgacatccggcaagtacgtcagcacttccggcaaggctttctgcacacgctccagggacgccagcgagcgcgccaacaccttggcggtctcctcgcccacgtcgggaatacccagtgcgtagatgaagcgcgccagggtcggtgtcttgctgttttcgatggcggtgatcagcttcttgctggaaatatcggcaaagccttccaggtcgatgacttgctcgtacttgagcttgtagaggtcggccggcgagccgatgagtttttcatccaccagttgctcgatggtcttgtcgcccaggccgtcgatgtccatggcgcggcgcgagacgaagtgaataatcgcctgcttgagctgcgcgccgcacgccaggcgcccgacgcagcggtacaccgcgccttcgctgacggtttccttgcccttgctgcgcttgaccagttgcgtgcgctcaacatgcgagccgcacaccgggcagctttcagggatttgcacggcgcgggcatgttccgggcgccgctcggtgaccaccgacacgacttgcgggatcacatcaccggcgcggcggatgatcacggtatcgccgatcatcaagcccaggcgcgcgacttcatccatgttatgcagcgtggcgttggacacggtaacgcccgccaccttgaccggtttcaaacgcgccaccggtgtgacggcgccggtgcggccgacctggaattccacgtcaagcagttcggtcagctcttccatggccgggaatttatgcgcaatggcccagcgcggctcacgggcgcgaaagcccagttcacgctgcgaggcaatgctgttgaccttgaacaccacgccgtcgatttcatacggcaggctgttacgccgttcgccgatatcgcggtagtaatccaggcaatcctgaatgcccttggccagtttcagctcatggctgatgggcatgccccatttcttcagttgttgcaggttgccgatatgagtgtcgctgatatccgtggtcacgccgtagcagcaaaattccagcgggcggctggcggtaatcttcgagtccaactgacgcaagctgccggccgcggcgttgcgcgggttggcgaaggtcttgccgccgacttccagttgcgaggcatttaaacgttcgaaaccggccttggacataaacacttcgccgcgcacttccaggctcgccggccagccgctgccgtgcaacttcagcggaatattgcgcacggtgcgcacattgacgctgatgtcttcgccggtggtgccatcgcctcgggtggcgccgcgcaccagttcgccgtcctgatacagcaggctgaccgccaggccatccagcttgggctcgcagctgtattccaccgccgcgccaccgccaaacagatcgcccaccggcaggtcgaggccttcggtaacccggcgatcaaactcgagcatggtggtttcatcaaaggcgttgccgaggctgagcatcggaatggcatgcttcacctgagtgaacgccgacaacgccgcactgccgacccgctgcgtcggtgaatcacgcgtcaccagctccgggtgctcggcttccagggccttgagctcgtggaacagccggtcgtactcggcgtccggaatgctcggctcgtcgaggacgtggtaacggtaattgtgctgatccagttcagcgcgcaattcgaggatgcgggtgtgggcggcggtcatgggtgttctctcagaaagcaaaagagcagccgaagctgctcaatatgttagtgcgcttattctactgacaacgctgaagaccaatcctcagcgtttctgtgtcagggcgcgacgctcgaactcgacgatgcgctgacggtagtgttcgatggtctgggcagtcaggacgctgcgttggtcgtccttgagctcgccgttgagttcctgcgacagcttgcgggctgcggccaccatcacgtcgaacgcttgtttcgggtgacgcgggcctggcaggccgaggaagaagctcaccgccggggtgctgaacaggtcgatatcgtccagatcaaaggtgcctggcttgaccgcgttggccatcgagaacagcacttcgccgttacccgccatgctttcgtgacggtggaaaatatccatctcgccaaagcgcaggccgctttcgaggatgttctgcagcagcgccgggcctttgaagccggcagcgtcacggcagatcacgctgatcaccaggacttcttcggcggccggctgatcgttgaccgattggcgtggcgcgcttttggtcggggtctcgtcagggaagtcatcatcacggctgctgaagctcgggccatcatcgacgtcgaggttcaggtcgccctggtgcggctcggccacggcagcgttgccgcgtttgccgcgcttggaagagggttcacgggcttcacgcaccggcgcgctcatcgacggcaagtcgtgttcgtccagttgcggctctttatgggtgtccagcacacgaggcggccccagcagctcggcgctgccgtcgtcgtcgggcaagttggacaggttgcggtccagacggaatttaagcttgcccttgccaccgcgcatgcggcgccagccatcaaaaagaataccggcaatgacaataatgccgatgacgatcagccactcgcgcagaccgatttccatgtaatcccgtgcctctaataaaaaatgctgaaaaataaggggtttagcaccgtgcaaaccgctttaaaacgtggcgccaactctatgttctgactgacgttttgcccacgcatacgaaaaattgacattaaactagcacgaccaaagataactttacaccgtctgtcaaaatggcttgaacaaatatgtccatttgccactttcgccagaccggtaaacccgcctacagcgtgctaaaaaaattctctaatggcgcgactcaagattccaccatcgccatcgcttcttcgacatccaccgccaccaaacgcgaacagcccggttcgtgcatcgtcacccccatcagttgatcggccatttccatggcgatcttgttgtgggtgatatagatgaactgcacggtctgggacatctctttaaccaaccgagcgtagcgtccaacgttagcgtcatccagcggggcgtcaacttcgtcgagcatgcaaaacggcgccgggttcaacttgaagatcgcaaataccagggccaatgccgtcagtgccttctcgccaccggacaacaaatggatggtgctgttcttcttgcccggaggccgcgccatgatcgtcacccctgtatcgagtagatcttcgcccgtcagttccaagtaggcgctgccgccaccgaaaactttcgggaataacgcctgtaaaccgccattaatctgatcaaaggtatctttgaagcgattacgggtttccttgtcgatcttgcggatcacgttttccagcgtgtccagggcttccaccaagtcggcgtcctgggcgtccagataacgtttgcgctcggactgttgctggtactcgtcgatggccgcgaggttgatcgcgccgaggcgttgaatgcgggcagcaatgcgctcaagttcttcttcggcgtctttctcgttggcctgggcggtcagcgtattaagcacgccgtgcaggtcgtagccgtcttccagcagctggtcttgcagggtcttgcggcgcacggtcagggcttgccattccatgcgttgttgttcgagctggccgcgaatcagctgggattgctgctcggcctgggtgcggcgtttttccgcgtcgcgcagttcgcggtcggcgtcttccagggcgatttgcgcggtcttgagttcctcatcgacggtcatgcgcttgtcgagcaactcttcgagcttgaggcgcagctcttccagcggcgcttcgccctcctccagattgaggctcaattgctcgcgtttttcggtcaggcgttcggactgcatttccaggcgctcaagcgcctggcgcgtggacgtgtgctgagcctgcagcgacccgaggcgcaccgccaattggtgggcgtggtccttgtgctggcgggcttcctggcgcacacggtcgaggcgttcgcgcaggctgtcacgctgggccagcagcagctcgcgctgctcggtgtcgagcgccatgctgtcgagggcttcctgcaactgcaggcgcgcttcgccgatctgttcgtgttcgagggcgcgttgctcgcccatctcggccacttcctcgtcgaggcgagtacggcgcaaggtcagttgctcgaccttggccttgctcgccgacagctgggccttgagttcgccttgctggcgcgcttcgtcctgcaacaggcggcgcaagtgttcgcggccggtctcttgctggcgctgggtggcgcgcagggtttgcagttcggtttccaggctttccagggtggcttcgcgctcttcgcgttcggcgctcaggttgacgatttcctggccacgggccaatacgccgctttccgcttcgctggcacggcgtacgcgcaggaagtgccgacccacccaatagccatcacggctgatcaggctttcgccggccgccaactgaccgcgttgggccagggcttgctccagcgactccaccggtttgacttggcccagccatggcgacagatcaattgccgcttcaactttatccagcaaactgcccggcactcgcgtgccgtcagccgcagggctaagcaaacgcagatcgccctgggtgaaaccggccaggtcgaaaccgccaaaatcatccaccagcacggcctgcaggtcggcgcctaaaacagtctcgaccgccagctcccagcccgcttcaacttttaacccttccgccaggcgcgggcgctcggccaaatgctggtcacgcagccactcggcggtgccggtgccggggtcgagtgcggcttgctgcaaagcttccagggaggccaatcggccgttcagccgctgcaaatcgccctgggcctgctgctgcgcctgggtcgcctgttgcagttgctgacgcaattgctccaggcgctccacttgttgttcttcgctggcttccagctcttccagcgtcatctcgctttcggccagctgctcgctcagctccatgatcgccgcgtcttccgggtcggcggcgagcagcgcccgctcctcctgcatgcggcgctggcgctcggccaggcgttccatgctggtttccagctgctggatgcgcgactgctgcacctcagcctggcggcgcggctcggcggactgcaggttgaaggcgtcccactgctcctgccagccgtgcatggtggtttcggcttcttccagggcggcggcggcttcttcggcggcagcgctggtgatttcctgctcgggggtgagcatgtccagctcttcgcccaacgtcagcagcaaggtgcggtcatggcccaggtgcgattcggtttccaggcgcgcgcgttcggcttccttcaaatcgtcctgcaactggcgcaggcgctgctggccgtgctggatgctctgctcgacgcgggcaatatcgccgcccaccgaatagaagcgcccctgcaccaagttgaagcgttcggacaggtcatggtggccgtcacgcaggcgctcgatgctggcatcggcgttacgctgctcggccaccagcgcttcaaaactgatttcctgggtgccgatgatcgcttcgcgctggccgacctggtcattcagcgcctgccagcgcaaggccgagagttgcgccttgagctggcgctcttcgcctttgtactcctgatacttctcggccgcctgggcctggcggtgcaggcgctccaactggcgctccagctcttcgcgcaggtcagtgaggcgggcgaggttttcgtgggtgcggcggatacggttttcggtctcgcggcggcgctccttgtacttggagatgcccgccgcttcctcgataaagttacgcaggtcttcgggcttggcttcgatcagcttggagatcatgccctgttcgatgatcgaatagctgcgcgggcccaggccggtgccgaggaagatatcggtaatgtcccgacgccggcacttggtgccgttgaggaagtaactgttctggctgtcgcgggtcactttgcggcgaatggaaatttccgcgtaggccgcgtattcgccgaccagggtgccgtcggagttgtcgaacaccagttcgatgctggcctggctcacgggcttacggctggtggagccgttgaagatgacgtcggtcatcgactcgccgcgcaggttttttgccgagctctcgcccatcacccagcgtacggcgtcgatgatgttcgacttgccgcagccattgggccccaccactgccgccatgttactggggaagttcaccgtggttgggtcgacgaaggatttgaaccccgccagtttgatgcacttgagccgcacgcttaggcgtccgccaacgctgcgatgaccagcgagcaactgcgctggccgtaagccgagagcacctggcgaatctgtaccaggtcacgcgccagcacggcggcgagcagttgttcgaacagcgccaggtactcgctcatggacgccttgcgttgatccagcgccaggtaataggcgcggttcatcgccggctgcaggttctcgacggtttcctgcaaatacgggttgttggcgaacgggtacgcggcgcgcatcacattgaagctttcttcgacgaaggcgcggatgtcctggcgctcgaaactgttgatcaagcgctgctggatctgcaggaacggcgccatgtcagcctgcacctgccagccttcagccacggcattgccgagcaggatgtacaactcgcccatcagcgtgcacaggctctgcaccttgtgcgcggtgagttcggtcacgtgggcgccacggcgcggcaggatcgcgatcaggtggcggcgttcgaggatcaataaggcttcacgcacggaaccacggctgacattgagcgccagcgtgaccttctgttcctggatccgttccccaggcttgagatccccgcgaatgatacgttcggcgaggtggtgagcgatttgctcggcgagactgtccggcgccttgaacgtcatgttttcccttcaaaatcttctatcggtacaagcgcggcagtgtagcgcattggctggctgatggcgctacgcccacaagcgcgaatttggcatgaaataagcaacgatgaaaagccagaagccccgaaaaacaccggtctcagaagactggaccataattgaaagtgttgtaatcgcaatttcttgaccttctggtcagaaaatcgttgaccgaaaagtcagacatgactagattcggcgcaaagcggttaacaacaataatgagtctgcgaggccttccgtgatccagtttttactaaaccaggaactccgtagtgagcacgccctggaccccaacctgaccgtgctcaactatttgcgtgagcacctgggcaaatccggcaccaaggaaggctgcgccagcggcgactgcggcgcgtgcaccgtggtagtcggcgagttgcacaccgacgatcaaggcgcgcagcagattcggtatcgcagcctcaattcgtgcctgacctttgtgtcgtcgctgcacggcaagcaactgatcagcgtcgaagacctcaagcaccaaggccaactgcacagcgtgcagcaggccatggtcgagtgccacggctcgcaatgcggcttttgcacaccgggttttgtcatgtcgctgttcgccctgcaaaagaacagcgatgcccccgacagccaaaaggcccatgaagccctggccggcaacctgtgccgttgcaccggctaccgcccgatcctcgccgctgccgaacaggcttgctgcaacaaacccgtggaccagttcgacagccgccaggccgagaccatcgcccgcctcaacgccatcgcgccaacgcaaaccggcgagctcaacagcggcgacaaacgctgcctggtgccgctgaccgtcgccgacctcgccgacctctacgacgcctacccgcaagcccgcctgctggccggcggcaccgacctggcgctggaagtcacgcagttccatcgcacgctgccggtgatgatctacgtcggcaacattgaagaaatgaaacgcatcgacgatttcgacgaccgcctggaaatcggcgccgccactgccttgtccgactgctacggcgcgctgcaccacgagtacccggacttcggcgatttgctgcaccgcttcgcctcgctgcaaatccgcaaccaaggcaccttgggcggcaacatcggcaacgcctcgccgattggtgattcaccgccactattgatcgccctcggcgcgcagatcgtgctgtgcaaaggcaacacccgccgcaccttggcgctggaagattacttcatcgactaccgcgtcaccgcgcgccaggacagcgagttcatcgagaaaatcatcgtgcccaagggccacacgctgttccgcgcctacaaggtgtccaagcgcctggacgatgacatttccgcggtgtgcgccgccttcaacctgaagatcgagaacggcgtaatcagcgacgcccgcgtcgccttcggcggcatggccgccacgcccaaacgcgcaaaaagctgcgaagccgtattggtcggcgccacctggaatgccgccacggtggagaaagcctgcgccgccctggccgaggatttcaccccgctttcggacttccgcgctagcaaggaataccgcctgctcagcgcacagaacctgctgcgcaaatacttcatcgaactgcaaacgccgcacatcgagactcgggtgaccgcttatgtctaaccatcacgccgtcgttaaaacccaggccgagctggccgagctgttcgcccaggacctgacttgcggagtcgggcgcagcgtcaagcatgacagcgccgccaagcacgtcagcggcgaggcgcagtacatcgatgaccgcctggaattccccaatcagttgcacctgtatgcgcgcatgtccgaccgcgcccacgccaaaatcctcagcatcgacaccgcgccctgctacgcctttgacggcgtgcgtatcgtcatcactcacgaagatgtgccgggcctgaaagacatcggcccgctgatgccaggcgacccgctgctggccatcgacaccgtgcagttcgtcggccaggtggtgctggccgtggccgcgcgcgatctggaaaccgcgcgcaaggccgccatggcggcggtgatcgaatacgaagacctcgaaccggtgctggacgtggtcgaagcgtttcgtaaaaaacacttcgtactcgacagccacacccaccaacgcggtgattcggcaggcgcgctggcgacggcgaaaaaccgtatccagggcacgctgcacatcggcggccaggaacacttctacctggaaacccagatttcctcggtaatgcccaccgaagacggcggcatgatcgtctactgctccacgcaaaaccccaccgaggtgcagaagctggtggccgaagtgctcgacgtgtcgatgaacaaaatcgtcgtcgacatgcgccgcatgggcggtggtttcggcggcaaggaaacccaggccgccagccccgcgtgcctgtgtgcggtggtggcgcgcctgaccggccagccgaccaaaatgcgcctgccgcgtgtcgaagacatgctgatgaccggcaagcgccaccccttctatatcgaatacgacgtgggcttcgacgacagcggccgcctggacgggatcaacctggaactggcgggtaactgcggctgctcgccggacctgtccaactcgattgtcgaccgcgccatgttccacgccgacaactcgtattacctgggcgacgccacggtcaacggccatcgctgcaagaccaacaccgcgtccaacaccgcctatcgcggctttggcggcccgcaaggcatggtcgccatcgaagaagtgatggacgccatcgcccgccatctggccctcgacccgctggccgtgcgcaaggccaactactacggcaagaccgagcgcaacgtcacccactactaccagaccgtcgagcacaacatgctcgaagagatgaccgccgagcttgaggccagcagccaatacgccgagcgccgcgaagcgattcgcctgtacaacgcccacagcccgatcctgaaaaaaggcctggcgctgacaccggtgaagttcggcatttcgttcaccgccagctttcttaaccaggccggtgcgctgatccacatctacaccgacggcagcatccacctgaaccacggcggcaccgagatgggccagggcttgaacaccaaggtcgcgcaggtggtggccgaagtgttccaggtcgaaatcgaccgcgtgcaaatcaccgccaccaacaccgacaaggtgcccaacacctcaccgaccgccgcttccagcggtgccgacctgaacggcaaagccgcgcagaacgctgccgaaaccatcaagcaacgcctggtggaatttgccgcgcgcaagtacgacgtgagcgaagcggatgtggaattccacaacggccatgtgcgcgtgcgtgaccagatcctgacctttgaagcgttgatccagcaggcgtatttcgcccaggtctcgctgtcgagcaccggcttctacaagaccccgaaaatcttctacgaccgcagccaggcgcgcggtcggccgttctattacttcgcgttcggtgcggcctgctgcgaagtgatcgtcgacaccttgaccggtgaatacaagatgctgcgcaccgacatccttcacgacgtgggcgcctcgctgaacccggccatcgacatcggccaggtggaaggcggtttcatccagggcatgggctggctgaccatggaagagctggtgtggaacaacaaaggcaagctgatgaccaacggcccggccagctacaagatcccggccgtggccgacatgccgctggatttgcgcgtgaagctggtggaaaaccgcaagaacccggaagacacggtattccattccaaggccgtgggtgagccgccgttcatgctcgggattgcctcgtggtgcgcgatcaaggatgcggtggcgagtttgggtgactatcgccatcagccgaagattgatgcaccggcgacgccggagcgggtgttgtggggctgtgagcagatgcggcaggtgcaggcggcgaaggctgttgaggctgaaaccgagatggcttcgctttaggaccgaggtgctgccatcgcaggcaagccagctcccacattttgctctgtgaatacattcaaatgtgggagctggcttgcctgcgaaggcggcctgactgacaacagcaatgttgaggtagacatgaacaactggatcagcgccctcgccgacctgcaaaatcagggtgaaccctgcgtgctggtgaccatcatcgaagagctcggctccacgccgcgcaatgccggttcgaagatggtcatcagcgccgcgcagaccttcgacaccatcggtggcgggcacctggaatacaaggcgatgcagatcgcccgcgacatgctcgtgcgcggccagcagaacacccatctggaacgcttcagcctcggcgccagcctgggccaatgctgcggcggcgtgactgtgttgctgttcgaaccgatgggccaggtgcaggcacagattgccgtgttcggcgccggccacgtcggccgtgcgctggtgccgttgctggccagcctgccgtgccgggtgcgctggatcgactcgcgcgaccaggagtttccgcagcagatcccacagcgcgtgcgtaaaatcgtcagcgaagagcctgtcgacgaaattgccgacctgccggtgggcagttactgcatcgtcatgacccacaatcatgcactcgacctggaactcaccgccgcgctgctcaagcgcaatgactttgcctacttcggcctgattggctcgaaaaccaaacgggtcaagttcgaacaccgcctgcgtgatcgcggcttcgacaccgcgcaattgcaacgcatgcgctgccccatgggcctcaccgaggtgaagggcaaactaccggtggagatcgccatctccatcgccggcgaaatcatcgccacctataacgcgaatttcggccagcacaccgccagcgccgaacccattgccaaactgctgccggcctcgcgtcgcagccaagcactctaaattgagataatcatgcctttgactcgcaaagcctaccgtgccgccatcctgcacagcatcgccgaccctgctgaagtggggatcgaagcctcctatgagtatttcgaagacggcctgctggtgatcgataacggccaaatcagcgccttgggccacgccagcgatttgctgccgacactgcccgccgatattgacgtcacccattatcaggatgcgctgatcacaccgggcctgatcgacacccacatccacttgccgcaaaccggcatggtcggcgcctatggcgagcagttgctggattggctcaacacctacaccttcccgtgtgaaagccagttcgccgacaaggcccatgccgaagaagtcgcagacatcttcatcaaggaactgctgcgcaacggcaccaccaccgcgctggtgttcggcagtgtgcacccgcagtcagtcaatgcgttttttgaagcggccgaaaaactcgacctgcgcatgatcgccggcaaggtgatgatggaccgcaacgcgccggactatctcaccgacaccgccgaaaccggctaccaggaaagcaaggcgctgatcgagcgctggcacggcaaaggccgtttgcactatgcggtgacgccacgttttgccccgaccagcactccggaacaattggccttggccgggcaactgctgggtgaatacccggacctgtacatgcagactcacatcagtgagaacaagcaggaagtcgagtgggtgaaggagctgttccccgagcgcaaaggctatctggacgtgtacgaccactacaaattgctgggtgagcgctcggtgtttgcccacggcgtacacctgtgtgatgacgagtgcgcgcgactggcggagacgggttcggcggtggcgttctgcccgacctcgaacttcttcctcggcagtggcttgttcaacttgccgatggccgagaagcacaagctgaatgtgggcctgggcacggacgtgggcggcggcaccagcttctcgctgctgcaaaccctgaacgaagcctacaaggtcatgcagttgcagggcgcgcggttgagcccgttcaagtcgctgtacctggccaccttgggcggtgcgcaggcgctgcgtctggaagacaagatcggcaccttgcagccgggcactgacgcggactttttggtattggattacaacgccacgccgctgctgagctatcgcttgaagcaggcgaataacattgccgagacgttgtttgtgttgatgacgctgggggatgatcggacgattctgcagacctacgcagccggcaatctcgtgcatcaacgctgatctaaagcacaccgagaaacaaatgtgggagcgggcttgtgtgggagccgggcttgcccgcgatgcaggcaccgcggtgtatcaggtaaaccgcggtgatgccatcgcaggcaagccagctcccacacaagccagctcccacatttttgctcgggtttacagttttactgtggaacgcccaggcttcttggtctgcagcaaatgcgaaaacaccgcatgcaaatcatccgacgcgctttcctcatcgaggttgagcttgctgtcgatgtgatccatgtggtgcatcatcaaattcaccgccagcgccgcgtcgcgtgcttcgatcgcgtcgatcagctgcgtgtgttcatcgtaggaacagtgcgagcggttgccgctttcgtactgggcgatgatcaacgaggtctgcgacaccaggctgcgctggaagctgatcagcggtgcgttcttcgccgcctcggccagcttgaggtggaattcgccggagaggcgaataccggcaccgcgatcgccgcgtgagaagctgtcgcgctcgtcgttgaccatctggcgcagctcggccaactgttcggccgtggcgtgctgcacggccaattcagtgatcgcccgctcgaccagacgccgggccaggaatacctgacgcgcttcttctacacttgggctcgccaccaccgcaccgcgattgggccgcagcagtaccacgccttcatgggccaggcgcgagagcgcgcggcgaatgatggtgcggctgacgccaaagatttcgcccagtgcctcttcactcaatttggttccgggcgccaggcgttgttcgaggatcgcctcgaagatatgcgcgtagacgatatcgtcctgggttccgctgcgaccggccttgccggctcgcggttgtttcttgagaggttgcaactgttcgttcatgggcactcgggtttggagaacggcggcgaattaacggtaatacggcaagcgcgtgttgctggcaagtatcacctaaaaacacggcacattgtacacaacccaatgcgccaacacactgtacggctgtttgcggctgcggctgtattgcaatgagtggttacgtttgagtttaggcttgaatccgcgccttcacaggcaaaacccaggtaaaaggaacacctccccatgaccgacgccacccaagcgcctttgcgcccgttggccgacacttctgcgtcggccgtcgtcgccggcttcatcgccatgatgaccggctacaccagctccctggtcctgatgttccaggccggccaggccgccggtttgaccactgcgcagatttcttcgtggatctgggccatctccatcggcatggcggtgtgcagcattggcctgtcgttgcgttatcgcacgccaatcaccattgcctggtccacacccggcgcggcgctgttgattaccagcctgggcggcgtgagttacggcgaggccatcggcgcctacatcacctgcgcggtgctggtgacgctgtgcgggttgaccggcagttttgaaaaactggtcaagcgcatcccgtcgtcgttggcggcggccttgctggcggggattctgttcaagatcggcagcgagattttcgtcgccgcgcagcatcgcaccggcctcgtgctggggatgtttttcacctacttgatcatcaagcgcctgtcgccacgctatgcggtgctggctgcactggtgctcggcacactgctgtcgggctttatgggcttgctggatttcagtacttttcacctcgaagtggcgacaccggtgtggaccacgccgcacttctcgctggccgcgaccatcagtatcggcatcccgctgttcgtggtggcgatgacctcgcagaacatgcccggcgtcgccgtgctgcgggccgacggctacaacgtgcccgcctcgcccttgatcaccgccaccggcctggcttcgttggtactggcgccgttcggctcccacggcatcaacctggcggcaatcagcgcagccatctgcaccgggccgcatgcccatgaagaccgcaacaagcgctacaccgccgcggtgtggtgcggggtgttctacggcattgccggggtgtttggcgcaacattggcggcgttgttcgcagcgttgccaaaggagctggtgctgtcgattgcggcgttggcgctgtttggctcgatcatcaatggcttgagtatcgccatgaatgagccgaaggaacgggaagcggcgctgatcacctttatggtcaccgcgtcaggcttgacgctgttttccatcggttcggcgttctgggggattgtggcgggggtgttgacgctgctgattctgaacgggcgcaaagcataaaaaaacggcgaccctcaggtcgccgtttttttcagtatcacttagccgcgttgatcggcttttccggataccacacgtccagcaacgggctgacttcagccttggtcagctcggaacgggttttcagccaggcttcgacagcagcgcgctgctcttcggagaccgagccacgcttctgcaggcaaaccagaccgaagtcatcgccgccgacatagcccaggccgttggcttccatggcttctttgatgaatgcttcgaggaaagcgtcgatagcttcttcactcaggccttctttgaagtccaggttcagttcgaaacccagctcttgaaattcatcaacgcacagttttttgcgcagacgctgggaacggttagtcgccattggaacaatcctcataagtaataacgggcggcactttagcagtttaagacggcaattgcccgactctctgggacaggcggctatctgtctgcaaaaaaacgcgcaataccagctatcgttcagctacaactggaaccaccttggggcataatgccgacactttcgtgaccaatgagggattttcttccatacccctcgcctttttcaccctcctcagcagcagggttttattctttatgatcaaatctttccgttcccattctttacgttcaatgttttttgccggtcttcttctaccgctggccttttctgccactgccgccccaatcaacaacaccctgccacccaacgttgcgcaggccctgcaaaaagccaaactgcaaaataccgcgctgtccttggtgatgctgcccctcaccggcccaggcacgccgacggtgttcaacgccgacgtttcggtgaacccggcctcgaccatgaagctggtcaccacctacgcggccctggaaatgctcggccccaaccaccagtggaaaaccgagttctacaccgacggcaccctcagcggtggcgtgttgcacggcaacctgtacctcaagggcggcggcgaccccaagctgaacatggaaaaactctggctgctgatgcgcgacctgcgcgccaatggcgtgcagcaagtcaccggcgacctggtgctcgaccgcagcttcttcaaccagccgcaattgcccgagttcaatgacgacggcaacgatgagaacaagccgttcctggtcaagcccgacgccctgctggtcaacctcaaggcgctgcgcttcgtcacccgcaatgactcgggccgcgtgatcgtgtcggtcgagccgccgattgcgagcattcgcatcgacaaccaggtcaaagtctccaacgccaagcagtgcaccggcgacgtgcgctacaacccggtcacggccgccgatggcagcgtcaccgtaaccgtcagcggtcagttgggcgatggctgcagctcgcagacttacctgtcgctgctcgaccacgccacctacaccgccggcgccgtgcgcgcgatctggcaggaattgggcggcaccatccagggccgcgatatccaggcgcctgtgcccaaggacgccaaagtcctcgcccgcgccttctcgccggacctggcggaaatcatccgcgacatcaacaaatacagtaacaacaccatggcccagcagttgttcctgagcctgggcgctcagtttcgcaacgatgccgacggcgacgatgccaaggcggcgcaacgcgtagtgcgccagtggctggcgaagaaaggcatcaccgcgccgcacctggtgatggaaaacggctccggcctgtcgcgcgccgaacgcgtcagcgctcgcgagatggcagccatgctgcaagccgcctggaaaggcccgtacgccgctgaatacatcagctcgctgccgattgccggcaccgacggcaccatgcgtaaacgcctgaaaaccacggccatgcgtggcgaagcccacgtcaagaccggcaccctgaacactgtgcgcgccatcgccggcttcagccgcgacaacaacggcaatacctgggtggtggtggcgatcctcaacgactcgaaaccgtggggcgcgtcgtcggtgctggatcaggtgctgctggacctgtatcgccagccgaagctgacggcggcagcccccgtactttaaaaaggcaacactgattaaatgtgggagccggcttgccggcgatgcaaataggtatctacacaacaatcctccgtggcgagcgggcttgccccgcgttgggctgcgtagcagccccattattacaggcgcagagttcatccaaatagaactcggtcgtcaggttttggggccgcttcgcagcccaacgcggggcaagcccgctcgccacaaaagatcgactgcaacaggattccgtgcatcggcagttgtgtagacacctatgctgcgatgcaggcgccgaggtgtatccgtcacactgcggtgatgcgatcgcaggcaagccagctcccacattgtgttctgcatcgacattcaggcatgtaatctttcggcttccacccgatccctgcccgcctgcttggccacatacaccgccgaatccgcgcgcagcagcagcccatcgatgccttcatcgatgcgccagctcgccacaccaaaactggcggtcacgatgcccaccgcttccatcggcgcactgcgcagcgcctgccacaattccatcgccaggctgtacgcctgatcgcgatcggtgtgcgggcacagcaccacaaactcttcaccgcccaggcgacagaacacatcggtgcgccgcaggcgctggctgatgcgcgtgcacacctcctgcaacacgccatcgcctaccgcgtgcccgtactggtcgttgatgcgtttgaagtggtcgatgtcgagcatgatcaacgacagcgcccccgaggtacggttaagcctgagcatttcggccttgaggcgatcgtggaaatagcggcggttatgaatacccgtcagcgagtcggtgatcgacagcgcgcgcagctcttcctccacgcgcttgagatcagagatatccgacacgtagccgtgccacagcgtgccgccgcccggtaattcttctggcgtagcttcgccgcgaatccagcgcaggccgcgttgtggcagcagcacgcggtactcttcgcgccagtggctcaattgcagcgccgacaagcgaatcgacacgcgtacccgctcgacatcctgcggatggatgcgctcgaagaccttgcccgcgtcctgctgcagcacgccgggctcgatttcatagatatcgcgcatgccatcgctggcgtagatgaaccgtccgttgtcctggtgttccaggacgaattggaagatcccgccgggtacatgggcactgagttttttcaacaaccggtcccgcgccgccagcgcctcgtaggcgcgtttctgttcggtgacatccaggtaaatcgctaaatgcccaacccataaaccatggtcatccagcagcacggtgccgagcatgttcacagtcaacgggctgccattttcacgcaacagcgtccactcccgggcctcgtgcaggttgtccgggctctccaccagcatcgcctggctcggcgggatgcgcttgcccatggccacactcaaggcggccgaacgcgcttcgagttcagcggccaggtgcaggctttccagggtcatgcgccccagcacgtgctcggacttatagcccagcatctgctcggcaccggcattaaacgtattgattacaccgcgcaggtcggtggcgatgatcgccacttgagtcgcggcattgagcacgctgcgcaattgcccgtgcgccccgcgcaactcttgctcacgcaggcgcaattgcacggtgcgctgctccaccagtttgagtgcgcgctggcgttggctgaccagtacgtacagcaaagcgctgagcaataggctgagcagcccgcccatggtcaggatcgtactcattgaggaatggttagcctggtcgaagacctggctcgcgcgcaatgtcagggcatacacgtggtcgccgagggtcagacgccgcgcggcgctgaggtcactgatgccgaccgcattgctggaggcatacagcacgcgctgctgggcatcggaggtatcgacgatttgcatcaccaggttgtcgcggttcggctggggcagaccatcggccaccaactgacgcatgctgatcaccgccatcacaaaaccgctgggttcagcgttgggcagcttgctcacgggcgccaccaacaaaaccccggcggcataggccggctccacacccaccagttgcatcggctgggacaccgccggcttaccgctttgttgcgcacgctcaagggccgagcgccgcagcggctgggccagcagatcaaaacccagcggtgagcccagcaggctttgggtctggctgtacagcaccggcacgtattcatcgcgctggggggccggcgccaactcacccgacgaattcaattcacggatgctgaaggctgcgccgagctgaagcgagatctcgtgttcaaacgcgctgcgttgatcgcggaatatccgcggcgcccacgcatacgcacgggcacgcagcagcaagggttgggcgaagccatcaaactcggcacgggacacgtcagtggaattgacgaaaaaacgctgcaggctggccaggcgttgctcctggtcttcaaagcgttcctgcaggcgcgtgtagcgctcgttgaccagcaactgaaagcgctggcgaacctgttgctgataaagatcggcggcggcccaggcaacgatcaccgtcagcgcgcaacctgccagtaacaccaccaatgccaccagccaagccgacgcctgctcactgataaagcctaggatcttggggcggacggcatgcatcggcataggcaacactcacaacgccagcgtgcagggctgtcactttggctagggcttaagttatagccatgaggccactgtttgaccagcgcaaaaaagccgcaagcccataaaatgctgggcttgcggctttttggtgcaacgcggtgccgcgatcagcgcgcggtgattttccaggcccggtgaatcttcgcattgcgcgcgaaatccggatcgagggtcttgtcgctgatttcttctaccgcataacgttcgctgaggttgtcctccagtacgaacttgcggaagttgttcgagaagtacagcacgccgcccggtgccaggcgcgccatggccaggtcgagcaattgcacgtggtcacgctgcacgtcgaagatgccttccatgcgcttggagttggagaaggttggcgggtcgatgaagatcaggtcgaattcatcgcgactggcttccagccacgccatcacatcaccctgctccaggcggttcttgtcggagaaaccgttaagcgagaagttgcggcgcgcccagtccaggtacgtcttggacaagtcgacgctggtggtgctgcgcgccccgcccttggccgcgtgcacactggcggtggcggtgtagcaatacaggttgaggaaacgcttgccggctgcctctttctgaatgcgcatgcgcatcggacggtggtcgaggaacaggccggtgtccaggtagtcggtgaggttgaccagcagcttcacgccgccttcgctgacctcggtgaatttgccctgggcactctggcgctcgtattgcttggtgccgctctgacgctcgcgacgcttgaccaccacgcggctcttgtcgacgttcagcgcctggggaatcgcggccaaggcatcgaacatgcgtgcagaggctttttccgggtcgatggatttcggcgcagcgtattcctgcacatggacccaatcgtggtacaggtcgatggccatggaatattccggcatgtcggcgtcgtacacgcggtagcagtccacgccttcgcgcttggcccacttgcccagttgcttgaggtttttctgcagacggttggcgaacatctgcccgccttcgctcaggcgtgcctgctcaaccaccggcgccggggccggcttgatcgggttaccgttcttgttgtactggcgctcaaccggctcggtcggggcttgatcgtaagcggcttgctcacgttcggcctggcgctgttccggcgtgcggcgctcgcccgtcacgaactggtccgggttgaccttgatcagcagcagtttgcacggcaacgcgccgttccagaacgaatactgtttgtggctgcgaatgcccatgcgtttgcccaggtccggcgcgccggtgaacaccgccgcttcccaacccatgcacgcctgacgcaggcgctcgccaaggttctggtagaggtacaacaggctggcttcgtcacccagacgctcgccgtacggtgggttgcagatcaccagacctttctgattctggtccgggcgcggctcgaaggtgccgacttcgccctggtacaccttgatccagtggctcaggcctgcacgttcgatgttgttgcgcgcgggctggatcaaacgcggatcggcttcgtagccacgcacccacaacggcggcttgttcatgccaatggccgcacgctcggtggcttcggtgtgcagctttttccacagcgccgggacgtggccgagccaggtggtaaagccccacagttcgcggttgaggttgggggccatgtcggcggcaatcattgcgccttcgaccaggaaggtgccgacaccgcacatcgggtcagtcagcgcgccgccttcggcagcaatgcgcggccagccggcgcgaatcaaaatcgccgccgccaggttttccttcaacggcgccgcgccctgctgcaagcggtaaccgcgctggtgcaggctgtggccggacaggtcgagggacaggatcgcttcgccacggtccaggcgcaggtggatacgcaggtccgggttgattttgtcgatggacgggcgttcgccggtcggggtgcgcagcttgtcgacaatcgcatccttgaccttcagcgcgccgaagtgggtgttgtcgatgcccgagccgtggccgctgaattccaccgccaaggtgccatccgggaccatgtggtcagcccattcgatgtccagcacgccgtggtagaggtcttcggcgtctttcatcgggaagcgcttgagcaccagcagcacgcggttggccaggcgcgaccagaggcacaggcggtaggcggtttccatgtcggccatgccgcgcacggccgaggtgtgctcgcgggcttcctcaaggccaagcccgacggcttcctcgatcagcaggccttcgaggcccttggggcaagtgaggaagagttcaaaacggtccgacatggggcattccaggcttttcagcaataaatgaacgggcgacgcatcgccggctcggttttcaatcaagcacttttcttgaagagcgctcgcgtggcacgaatgtgccgttccaccccggctgccaggcctttcggccaaaatttccggggcagataaataaatgatcgcaacaaaaagaaatattccgacccttcgtcgaataataaccgactgcaacgggcgggcattctcactaaaggattaaacccatcctctttgcagggcacatcatagctgggtttgcccaacaaatggggcgaaaagccagcccagcttatggctatagcatcgttatcgttacgtgcttatgacaaaacgatcattgaatccatgtgacctattggttagaactcaacacaggttgacgccgtaacgacgtcgacacatcggctcgccacgccggcagcgagcccaccaacggcagaaaaactctgcccggcctcggaagaggccgaaggatatcaagacagtcaacaagtgagggaaacaccctatgagaagacttaagcgtgatccgttggaaagagcgtttttacgcggatatcaatatggcgttcatggcaaatcccgtgagctttgcccatttactctaccgtcggtacgccaagcctggatcaacggctggcgagaaggacgcggcgacaactgggacggtatgactggcactgcgggaatccacagactcaacgaacttcacgccgtcggctaacacagggcacttaatccgacacaccaccttgaagattatgtaacgacttaaccacgcacgccccatcagggcggcgggcttcggcccaggggctcctttagggagccctttttattgcctcaagctttgggcaacgctgcaatcgcatccaccgactcgcgaatcaacgccggccctttatagataaagccggagtacaactgcaccaggctggcgccggcggcaattttttcggccgcatgcctgccttcggtgatgccgcccacggcgatgattggcaagcgccccgccaactcagccgccagcaccttgacgatgtgagtgctcttgtcccgcaccggtgcacccgacaggccgcccgcttcatcaccatgggccagcccttcaacgccgacacggctgagggtggtgttggtcgcgatcaccgcgtccatgcccgattccaccaaggcttgggcgaccagcacggtttcttcatcactcatgtccggggcgatcttgatggccagcggcacgcgcttgccatggcgcacggccaggtcttcctggcgctggcgcaaggcttcgagcagttgcttgagggaatcgccaaattgcaggctgcgcaggcccggcgtattgggcgaactgacgttgacggtgacgtagctggcgtgggcgtagaccttgtccaggcagatcaggtaatcatccaccgcattctcgaccggcgtatcgaagttcttgccgatattgatgccgaggatgcccttgtatttcgccgcttgaacccgcgccaacaagtgatcaacgccctggttgttgaagcccatgcggttgatgatcgcctcggcttccggcaagcgaaagatccgtggtttcgggttgcccggctggggccgtggcgtcacggtgccaatttcgacaaagccgaagcccagttgtgcaaaaccgtcgatggccgcgccgttcttgtccaggcctgccgccagcccgaccgggttagggaaatcgagccccatcaccgataccggcatttttgccggcgctttgcataccaggccattgagccccaggcggccaccggcgccgatcaggtccagggacagatcgtgggaagtttccggggagagtttgaacaacaactggcgggccagggtatacatgggcgggctagactcggatggcggcgaaaggtggcgccgattatagccggggtggcacgccaggtgcgaggtacgccgctcaatcgtcaattccgttgcgcaaccaacgcctcgtactgcgcccagattttttcggcataacgcaggcgcaacgcctctcgctccggtgccaccccggcattgtaggagcccacggcggtccagttatagccgaaacgctggataaactcggcaaggatcgaagcgcccacttccaccgacaaacacggctcagtcagcaacctttcctcggtaatcccctgcttggccaggcgaggcaggtgcatgctgttgatctgcatcaagccgatatcccgggagccatcgctgttgttagggttcagcgcctgcacacggtaacccgactcaactgcagcaatcgcctgcaacagctccggctcgatatcgtagcggcgggcaacatcgtcccagcaactggcccaggcgtgatggctactcatcagtacgctcaacagcaggccttggcccaatcgcttaatcatgtgccacctggccacacgccgaacagatgtactgcgcacgtacccgaccagcctgacgcgatgcgtgcagcttgacttttaccgcacaggtaaagcgatagcctctgccatagatcgtcttgataaagtctttgtcttttttcaggtgtttgcgcaatgcatagatgcagcgcgtgagtgactcctcggccacctcgccacgcggccagaccaacgcgagcaaccggtccttggtcagcaactcgccaccggaggccaacagcagccgcagtacatgccactccttgggtggcaactggatatccacgccttcgcccgtcaactggccatcgccatacaaggtccatccagcaaacacccgtgaggtggtagtcacatcattcgcgatggtcatacgcacctctgcatccgactaatgacatttaattacttgcttccagaaacggccaacacggcaaccccacgactataaaaacctgaccggcaaacaacgttaagaaaaagcgcctgtagtcgaggatttaggcacgcacctcgtaggacttttctccggcgcgcgcaacgcacgttcgggcaatcgttcagaagcctgcttaaagggctatttcattccggcactacaaggtgttcacgtacaaacgcacgttgcacttgctcatattggcgctgcgtcaatggcggcggtccgacggcaccggcgagcagcttgagttcgcttccaacggctcgcgcctggatcacaaacagccgcacctcggagcgtcgagcacggccggtcatgtcactgtcgcgtcgaaaaccacccagccaaaggcgcctgcccggcggcacacgcaccacggtgctgatccccactcgccccacctcccccgccgagccaggtttgagcttgctgtccagttgacggtcatccttgatgttcagctgcatttcgatctggttcgcttcggcaaaacgcgcaagcacactggcctcggtgccatactgcacgggctgccattcatggctgtcgctgtcgctgccgggactggacaggtagaacgtatggttgtcctggaaaaccgccggaacattttcttgggtaaggatcaccggaaaagtaacgatccgcgctttgcgccggcgctccagcacaccgagctgcgccatcaaacggttatcgtccaaaggctccaatacgcgtgtcactgaggccccggtgcctgtttcctcggcccaggccgcgcccatcttctcgaattcgctgcgttccacatcgacctgccaaagcgacacttcaatcggccgcttgggtttgtcgagctgcaccaccagttcctcgatcgccttcacttgctcaggcttacccttgatcagcaggctgttggagtcggggtaagcaatcactaccaggcccttgtcggcgagcaaactcgcggggcgctgcgtgtcatttttttgctcgctggccagcacggtttcgatcatcgaggccatgcccgatacattcactttctcgccgcccatgacgtactgacggtctgccacgtgggtattgaacacctgcaccacgccgaacgtctgggcgcccacgcgcacctcggtgcgtggcctgtccatcagctgggccaggtgcagcacctggtctacatagttgggcggcccggacacatagaaggtgcgccctgcgctctgcctgagcgggtaacgtgattcatcaaggccagaacggcgcatgaagccgcgcaacctgtcgaccgaaatatgccgcaacgccaccgccgagctttttgcctcccccgcgtcatagaggtaaatcacctgcccgtcgctgtaccagatcaggccctgctgctcggcgaccgcctccaaagtgtgctgcgccgcccccaggtcgaaggctccggaaagggttctgcgcgccacctcgcggctgaccaccaccggcaagcccaaaggcaccgacagggcggtaaaaaatgtatgcaggctttcatcccgcgcttgataggtttcgcccatggcaggtgcgatggccagcaacagtgccaggcacagcagccagcgatgcaacccgaagcggttcatcatggctggcgaatcgatagtcaccgtaggtgttcctgacagtctggcgcaaagaggtggccatactggaagaccggcgcgtttgaatcttgatggaaagttgacgggccttgcgcatccccatccgtggcatgtgccttgctatggacattgcatcagagcgcgcgccaacgtcggaacgcgcttacggacaaaggcgtcgtgaccctgcattggcctgcatcgccatctgtgggcacgatgctttttttttgagagaaaagggtaggtgttgatgaacgattcggtcggtaaaaacccgatgaatactgcgctggcctgggtaaacggcagtgacgccccggaaaagagcagcctcgacctgggtttcatggcactgaccgactgcgcctcgctggtggtcgccgccacccagggtttcgcgcaaccttacggcctcacgctgaacctcaaacgccaaacgtcctgggccaacctgcgcgacaaactggtcagcggtgaactggacgccgcccatagcctgtatgggttgatctacgccgtgcacctgggcatcggcggcgtcgcgcccaccgacatggccgtgttgatggggctcaaccagaacggccagagcatcaacctgtcccatggcctgcaacagctgggcgtgaccactcctgaggcattggatcgccacgtgcaccaaagccgaacaaaactgaccttcgcccagacctttcccaccggcacccacgccatgtggctgtattactggctggcgagccaaggtattcatccgttgcaggatgtcgacagtgtggtggtgccaccgccgcaaatggtcgcgcacctgcaagccgggcgcatcgatgggttttgtgtcggcgagccctggtgtgccagcgcggtcaagcagaaccaggggttcacgctggcgaccacccaggcgatctggccaaaccatccggaaaaggttctaggctgcacccaggccttcgtcgatcaatacccgaacaccgcccgcgtgctggtcatggcgattctcgaagccagccgctttatcgaagccagccaggagaaccgccgctccaccgcgcaattgctcagcgcccgtgactacctggatgcaccgctggactgcatcgagccgcgcctgctcggcgcctatgacgacggcctcggcaaccagtggcaagacccgcatgccctgcggtttttcggcaatggcgaggtgaacctgccttacctctgcgacggcatgtggttcatgacccagtttcggcgctggggcttgctgcgcgaagacccggactacctcggcatcgcgcgccaggtgcagcaactggagatgtatcgccaggccgccgctgccgtcggcgtgccggcaaccgcccaggacatgcgcagcagccaattgatcgacggcaaaatctgggacggctccgaccccgccgcttacgcccgcagcttccgcttgcacgccatggcggacgctaccagccgccaggcgttgcgctgacaggaccacgactatgttgcgaatcctgttgatcaacgacaccccgcgcaaggtcgggcgcctcaaagctgcattgatcgaggccggattcgaggtcatcgatgagtccggcctgaccatcgacctgcccgcgcgcgtcgaaacggtgcgcccggacgtgatcctgatcgataccgagtcacccggccgcgacgtgatggagcaagtggtgctggtcagccgtgaccaaccgcggccgattgtgatgtttaccgacgagcacgaccccaatgtgatgcgtcaggcgatcaagtccggggtcagcgcctacatcgtcgaaggcatccaggcccagcgcctgcagccgatcctcgacgtggccatggcccgttttgaaagcgaccaggccctgcgcgcccagctccaggcgcgcgaccagcagttggccgagcgtaaacgcatcgaactggccaagggcatgctgatgaaaatgaagcactgcaatgaagaagaggcctacaccctgatgcgccgccaggccatgagccgccagcagaagctgatccaggtggcagagcagatcatcgccatgagcgagttgctcggctgatccggcgcacgttttgcgtaggcgacgcggagcgtcacaggatgcattcccacgcgcagcgtaggaacgatcagcatcaacgcgttttggcgcagctcttgctaagcattcatcacaggtaaccaacggcggttgccccttctacgacaaagacgtcgcccatccggtttgccctcgcgaacccggtggcggcgttttttcgttttggccccagagcctggggccggtggggtggccttcaaccggcggccccatcacttggccttcttacaagaccccaaccgttgaggtgcgtgatgaaatcaagcttctggaaatccgggcacaccccgaccctgtttgccgcgttcctgtatttcgacctgagtttcatggtctggtacttgttgggcccactggcggtgcaaatcgccgccgacctgcacctgaccactcaacagcgcggcctggtggtggccacgccgatcctggccggcgccgtgttgcgctttctgatgggtatgctggccgacaaactgtcgcccaagaccgccgggctgattggccaggtgattgtgattgctgcgctgttcggcgcgtggaaacttggcatccacagctacgagcaagccttgcttctgggcatgttcctgggcatggccggcgcgtcgtttgcggtcgccctgcccctcgcgtcccagtggtatccggctgaacaccaaggcaaggccatgggcatcgccggtgccggcaactccgggacagtgtttgcggccttgctcgcaccggtgctggcggccgcgtttggctggagcaatgtgttcggcttcgcgctgattcccttggtgatcaccctggtcgtcttcgcttggctggcgcgcaatgcccctgaacgccctaaagccaaatccatgaccgactacttcaaggcgctgggcgaccgcgacagctggtggttcatgttcttctacagcgtgacgttcggcggctttatcggcctggccagcgccctgcccggctacttcaacgaccagtacggcctgagcccggtgacggccggctactacaccgccgcctgtgtgtttggcggcagtttgatgcgccccttgggtggcgccctggcggaccgtttcggcgggattcgcaccctgctcggcatgtacagcgtggcggccatctgcatcgcggcggtgggtttcaatctgccaagttcttacgcggccctggcacttttcgtctgcaccatgctcggcctcggcgcaggaaatggcgccgtattccaactggtgccccagcgttttcgccgtgagatcggcgtgatgaccggcctgatcggcatggccggcggtatcggcggcttcgccctcgccgccggcatgggtgcgatcaaacaaagcaccggcagttatcagatggcgctgtggttgttcgccagcctgggcgtgctggcctggtttggcctgcacggcgtcaaacgtcgctggagaaccacctggggttcggccgccgtgaccgccgcgcgcgtctgatgggcctgcaactaagcatcgcccacgccagcgccatcggccctcgggcggaaaatcaagatgcgctgcgggtggtcacacccgtggccgaactggcggcgagcaagggttacttgtgcgccatcgccgatggcgtcagccaatgcgcggatggcggcctggccgcgcgctcgaccttgcaggcgctggcgctggactactacgccacgccgcaaacctggggcgtggcgcaggcgcttgaacgtttgttgctggcgcagaaccgctggttgcaagccaacggcggtggccagccgttgctgaccaccttgagcgccctggtgtttcgcggccaacgttttaccctcgcgcatgtcggtgattgccgggtgtatcgctggctcgacggcgagttgcagcgcatcactgaagaccacgtgtgggagcagccgggcatgcagcatgtactcaagcgcgccctcggcctggaccaacacctggtgctggattttctcgacggcgaactgcgtgccggcgagtgtttcctgatgctcagcgatggcgtgtgggcgaccctgggtgatcacagcatcagcgcgatcctgcgcgagcaaaccgatctcgatgtggcggtgaccaccttggtcaacgccgcgcacctggctgccagccaggacaatgccagcgcgctgctggtgcgcatcgaccagctcggcgccgccaccctcggcgatgcattggtgcagctgcagcaatggccgctgccaccgccgctgaagcccgggcagcgttttgaaggctggcaggttgaaagcgttgtggcgcagagccggcagtccttgctgtatcgggtacgcgatgcccagcagcagccgtggctgctgaaaaccttgccgctcagccgcgacgatgacagcgatgccggccaagccttgttgtcggaggaatggtttctgcgccgggtggccgggcgcgcgtttccggaagtccacgccgccagtgggcgtcagcatttgtactacgtgatgcgtgaatatccggggcaaaccctcgcgcaactgtttcaacagcaagggccattgcccctggcgcaatggcagtccatcgccgagcggttgctgcgggcggtgggcctgctgcatcgacggcagatcctgcaccgtgacatcaagccggaaaacctgctgctgggcgacgatggcgaactgcgggtgctggatttcggcctggcctactgcccggggctttccgaagaccgcgctcacctgctgcccggcacaccgagttttatcgctccggaagcattcggcggtgagccgcctacgccgcaacaggatttgtacagtgtcggcgtcacgctctattacctgctgaccgggcattatccctacggtgaaatcgaagccttccaacgcccgagtttcgcccagccggtcagcgccagtcgctaccgccccgacttgccggacgggttgccgctgagtctggagcgcgccgtggcggcgcaaccggcgcaacgttatgaaaccgccgaagagtggctgctggcgctggagcaggccgaccgccgggaattaagcgtgcggccacggccactgctggagcgcgagccactcaaggtctggcaaaccctggccacggtttcgctgctgatcaatctggtgctggtgtattggttgctgcaccactaaagggcgatttcccacacgatttcgatggcaatcccactaaaccgggcgcctggcaacttggcacaacggctgcattactttcatcaacaacacacatatagccgccccttcaacgtcgaagggtcgagcttcccgagagaacgggaccggacaaaggtgtcctcgccaggtaactggcggggacgcctttttttgtttgcacgcgatttgtcgagccattgcggagaacgacatgaaaaaactcaaattggtgatgatcggcaacggcatggccggggttcgcacccttgaagaattgctcaagctgagcagcgacctgtacgacatcaccgtgttcggcgccgagccccacaccaactacaaccgcatcctgctgtcgccggtgctggccggtgagcagaccttcgaagagatcgtgctcaacgacctgagttggtacctggataaccacatcaaattgttgctcaaccgcaaagtggtgcagatcgaccgggtcaaacgtgttgtgattgccgaagacggcaccgaagccgaatacgaccgcctgctgattgccaccggttcgaccccgtttattctgccgatccccggcaatacgctgcagggcgtaatcggctaccgcgacatcgccgacacccaagccatgatcgacaccgccaagacccacaagcacgccgtggtcattggcggcggtctgctcggcctggaggccgccaacggcttgatgctgcgcggcatgcacgtgaccgtggtgcatatcggcgagtggctgctggagcggcaactggacaagaccagcggccagttgctgcaaaccgaactggaaagccgtggcctggtgttccgcctgtgcgaacagacccaggcactgcatgacgccggcaatggccgcgtcggatctgtgcaattcaagaacggcgacatcatccccgccgacctggtggtgatggcggccggcatccgccctaacaccgagctcgcggaaaaatccggcatcccgtgcaaccgtgggattctggtcaacgacaccctgcaaacctacgacccgcgcatctatgcgattggcgagtgcgccagccaccgtggcatcgcttatggcttggtcgcgccgctgttcgaacaggccaaggtctgcgccaaccacttggcacagttgggctttgccacttacaaaggctcggtgacttcgaccaagttgaaggtgaccggtatcgacctgttctccgccggcgactttatgggcggcgaaggcaccgagaccatcaccctctccgacccgattggcggcgtgtataaaaaactggtgatcaaggacgacatcctggtcggcgcctgcttgtacggcgatacggcggatggcggttggtacttccgccagatccgtgagaaccacgcgattggtgagatccgcgatcacttgatgttcggtgaaaatgcgcttggcgatgtaggccatcaaggtcaggacaaagccatgagcatggccgacaacgccgaagtctgcggctgcaacggcgtgtgcaaaggcaccatcgtcaaggcgatccaggaacacgggctgttcagcgtcgacgaggtcaagaaacacaccaaggccgccagctcctgcggttcctgtgccgggctggtggaacagatcctgatcaacaccgtgggcggtgccgccgacgtcaaaccgaaaagcgaaaaggccatttgcggttgcagcgacctcaaccatgggcaaatccgccaggccatccgcgaccagcatttgctgaccatcgccggcaccatgagctacctgaactggcgcacgcccaacggctgcgccacctgccgcccggctctcaactattacttgatctccacctggccgggtgaagccaaggacgacccgcaatcacgcctgatcaacgaacgcgcccacgccaatattcagaaagacggcacctactccgtcgtcccacggatgtggggcggtgtgaccaatccctcagagttgcggcgcatcgccgacgtggctgacaagtacaacgtgccgatggtcaaggtcaccggcggccagcgcatcgacttgctgggcatcaagaagcaggacttgcccggcgtgtggaaagacctcgacatgccgtccggtcatgcctatggcaaatccatccgcaccgtgaagacctgcgtcggcagcgagttctgccgcttcggcacacaaaactcaacgcagttgggcattgagctggagcatgacctgttcaatatgtggtcgccgcacaaggtcaagctggcggtgtccggctgcccacgcaattgctcggaagccggcatcaaggacgtgggcattatcggcgtcgactccggctgggagatgtacatcggcggcaacggcgggatcaaaacggaagtcgcagagttcttcgtcaaactcaaaaccgccgaagaagtgcgcgaatacaacggcgccttcctgcagctctatcgcgaagaagccttctacctcgagcgcaccgtgcactacctgcaacgggtgggcatggagcacatcaagaaagccgtgctggaagacccggcccggcgccaggcactcaacgagcgcctgcaattctcgctgtcgttcgagcaggacccgtggaaagagcgcctggagcagccgctgctgaaaaaggaatttgaagtcatccccgtcaaacagctggaggtgccggcatgaactggctggatatctgcgccctggaagaaatcaacgcactgggctcgcgcatcatcaatgggccaaagggtgacatcgcgatttttcgcaccagtgacgacgaagtgttcgccctcgacgaccgctgcccgcacaagggcggcccactgtcccaaggcttgatctacggcaagcgcgtggcctgcccgctgcacaattggcaaattgatctggcctccggcgaagctcaggccccggatatcggctgcgcccaccatcaccctgcccgcgtggaaaacggccgggtcatgttggccctgcgggacgcaggttgatggaccgccagaccaccgcgtccacctgctgttattgcggggtgggatgcggcgtgctgatcgagcatgacggcgcgcagatccttggtgtgcagggcgacccagaccacccggcgaattttggcaagttgtgcagcaaaggctcaagcctgcacctgacaggcgacttggccgcccgcgcgttgtacccggaactgcgcctgggcaaaggcttggcgcgcgcgcgcaccgattgggagaccgccctggagcacgcagccaacgtgttcgccgagaccctcagcgaacacgggccggacagcgtagcgttctacatctccgggcagttgctgaccgaggactattacagcttcaacaaactggcgcgcgcgctggtcggcaccaacaacatcgatagcaactcgcggctgtgcatgtcctcggcggtggtgggctacaagcgcagcctgggcgccgatgcgccgccgtgcagctatgaagacctggaatccagcgactgcgtgatgatcgtcggcagcaacatggcctacgcccacccggtattgttccgacgcctggaggaagccaaagcgcggcgcccacagatgaaagtgctggtgatcgacccacggcgtacagacacctgcgatttggctgacctgcacctggcgattctgccgggaacggatgtggccctgtttcatgggattttgcatctattgctgtgggaagactggattgaccgtgagttcatccaggcgcataccgatgggctggtcgagttgaagcgactggtgcatgactacacgccgcaaatggtcacgcaactgtgcgggatcagcgtcgaacagctgcgcctgtgtgctgaatgggtcggcacctccagcagctttctgtcgctgtggtgcatgggcctgaaccaatccaccgccggcagtgcaaaaaacagcgcgctgatcaacttgcacctggccactggcacgattggccggccgggctgtgggccgttttccctgacggggcagccgaatgccatgggcgggcgcgaaaccggtagtttgtcgaacttgctgccgggccatcgcgaagccgccaaccctgaacaccgcgcagaggtcgccgcctattggggcgttgaatcgctgccggcgcctaccgggttgaccgcgatcgaactgttcgagcaaatccaggccggcaagatcaaggcggtgtggatcgcctgcaccaaccccgcgcaatcgctgccggaccagaaccgcgtacgtgcggcattagcggcgtgccctttcgtggtattgcaggaggcgtttcgtaccaccgagacggcggcttatgccgacctgctgctccccgccgccagttggggcgaaaaggaaggcacggtgaccaactccgaacggcgtatttcccacgtgcgccgcgccattaccccacctggcgaagcacggccggattgggcgattaccgttgattttgcacagcggctggagcgtcgcttgcggccggggctggccagtctgtttgcctttgagcaaccggcgcagatttttgatgaatacaagctactcacccgcgaccgcgaccttgacctgtcgggcatcagccatgccctgctcgaccagatcgggccgcagcaatggccgtttcccgcgggcgcgcaaacgggaaccccgcgcctgtatgccgatggcgtattcccgactgacagcggccgggcgcactttgtcgccgacccttaccgcgccgccaaggagcagcgtgatgcgcgcttcccgctgaccctgattaccgggcgcctgcgtgatcaatggcatggcatgagccgaacgggcacggcagcgcagctgttcggccatgtcagcgaggcgctgctgagcctgcacccggatgaattgcgccgtcatcgtttcaaagaaggtgatctggtcaacctgaaaagccgtcgcggcaacgtgatcgtcgccgtcaacagtgacgacagcgtgcgcccaggtcaggcattcctgccgatgcattggggtgatcgttttctcaagggcggcgtcaatgcgctgacccaaccggcgtttgacccgttgtcgaaacagccggaactcaagcacagcggcgtgcgccttgaagcggtacacctgccgtggcagctgttcgcactgattgaaggaaatgtgcagcaacactttgaggcactgcgcccgctgtgcgaggactttgcctacgtcagcctgagcctggcagggcgcgagcgcccggcgctgctggtacgtgcagcgcataccgaggcgcccgacctgcaactattgacccgtatcgacgaactgctgggcctcaatgacggccctgtcatggcgtatgacgacccgcgccgctcgatcggcaagcgggtaaaaatcgaaaaaggccgtattaccgcgttgcgtctggcgggcgaaaccctggcccggcattggctgcagggcctttggctggaaggccgtaccgatgaccaactgcgccgctggctgttggcgccactgagtgcgccaccgggcgctgcggccgccagcagcaaaacattgtgcaattgcaggaacgtcagtgaaaacgcggtgtgcgccggtattgcccgtggcctgaacctggacgggcttaaacaagaattgggctgcggcacgcaatgcggctcctgtgtgccggaaatcaaacgtcttttggccagcaactcgcagccaatcgcaaccagtgtgtgaggggaaatcatgagcgcaaaagtctggctggtgggcgctgggcccggggatccggagctgttgaccctcaaggcggtgcgggccctgcacgaggccgatgtggtgttgatcgacgatttggtcaacccggctgtgctggaacactgcgttgatgcgcgggtgatcaccgttggcaagcgcggcggatgccgttcgacgccccaggattttatccaccgcttgatgctgcgttatgcacgccagggcaagtgtgtggtgcggcttaaaggcggcgacccatgcattttcggccggggcggcgaagaagcgatgtggctgcgcgcgcgcggggtgatggtggaactggtcaatggcattacagcaggcctggcgggggcaaccaattgcgacattccgctgaccttgcgcggtgtcagccgaggcgtaacgctggtcacggcacatacccaggacgacagcagcctggactggcgcgcgctggccgagggcgggacgacattggtggtgtatatgggcgtggcgaagctggaggagattcgtcagcaactgctggagggcggaatggcagcggatatgccggtagcgatgatcgaaaatgcgtcactgccccaacagcgggaatgccgcagtaacttggcgcgtatgcacgcggatgcattgtcattcgcgctgaagagcccggcgatcctggtgatcggccgtgttgccgccacggatcaggccgcttgcgttgcggtttcagccggcggatgaggcaaatttcaggcgaaaaaaagcccggcctaagccgggcttttttttaccactcagtaattactgagcagcttgagcttctaccgaggcttctacgcgacggttgatagcgcggccagcttcagttgcgttgtcagcaactgggcgggatttgccataaccaaccgagcttacacggttaggagcgataccgtctttgaccagaacttgcttgaccgcgtcagcacgacgctgggacagcttctggttgtaagcgtcaggaccgacggagtcagtgtgaccttcaacaacggtggtggtttgtgggtactgtttcatgaagtcagcgaggtttttcacgtcgccgtagctgttaggcttaacaaccgacttgtcgaagtcgaacttcacgtccagctcaacacgaacaacctgagcaactggagcttctggctctggagttggctctggagctggtgctggggtaggagctggagcaactgcgccagcgttgccgccgaagtttacgcccaggccgaccagtgcggagtaatcccacttgccgttgtccaggttgtagtcggactcaacaccagcacgtgcgaacaggttgttggtgaagtagtacttcacgccagcgccagcgatagccagggtggactggtcgcgacctttgtggccgtcaacttcaacgttggtacggctctggtgaccgaaaccaccttctacgtatggacgcagggaatcaacaccggcctgaccgaagtggtactgagcagtcacgctgccagtgtcacctttgatcttctgggaaccagtaccgtcgttcgaacgggtgtggttggtggtgtcgtagttcaggttgatcgacacgtcgtcggtcaagaagtaaccgatgctggcgccagggttgtagccgtcttcgatgtgcttaacgctatcgttgaactgctttttgtagaacagctggccttcaactgcgccttggccttgtgccagtgcgccgaaagaagtagcggcaataagagtaccaatggccaagcccaaggtgtttttcagtttcatccgttaaatccccatctggtgattgtaaagcagtcccacaaaccgggggacaactcggcgacaagtctaacagaacttgcctacacgtaagagatatttgccacgcactaagtttcagtctcgcccgcaaatttctcacgtaatttatcaagagcgcgtttgtaacgcatttttgtagcactcaaacccatgtgcatgatgtcagcaatttcctgaaactctagctctgcgacaaatcgaagcaccagaatttctcggtcaatcggattcacatgcaccaaccagcgatcgagtccgcccttctcctcgggtgccggcgccttttcttcagacgcttcctcaagggggtccagactcaaagcgtccatcaaccgacgctttcgccgttccttacgatactgcgtgatgcactcgttgtacgtgatgctgtagagccaggtcttgaacttcgatttgccctcgaagttcttgaggccgtacagcaccttgagcatcacttcctgacagacatcatccgcatctctatcgttccctaaataccttgaacaaacgttgaacagagtgcgttgatatctgcgcatcaattcttcgtacgcgcgtgttacgtgaaacagctccgtgtgcgagcgcgcgaccaactcctcatcagagagctcacgggggtcatagcgcgtggacagcgtttgggctttattcaaaacaagtcgtgccgacagtcaggtcaatgtccgctgcagcccggtcacccgggttcgcggcggcgtacattagcagggtttgccgggttagcggctactgacctgctgctccaggagaatccgattggacagtgacaccagttcaccctcatcggtcagcaccgttgttttcacggtaccgatctcctcgatttgcccttcgacctcgcccacacgcacctgctgccctacctgatacaactcacgcacatagattcccgcaagaatctgaccggcaatttcccggcttcccaaccccatggccagcgcaacggccagaccaacggtaatcaaaacaatcacaatcacgtggttaagcaggtcagttttgacctccaactggctgatcgcgaccgaaatactgatgatgatcaccaggccctgggcaattcgccccaggcccgcagcatagtccaaccccacgccttcggcagccccgcgcaccagcccattggccagttgcgccagtaaaacgcctaccagcagcaccaacgcgcctccgaaaaccttcggcaaatacagcgccagcatgtcgagcgtagctgaaactcgctcaagtccaagggattgagcagcagaaaccagaaaaataagtaaaacgaaccagtagacgatcttcccgatcagggtagagatcggcacttgcaagccggcacgccccaacagcttggtcaggccggtgcctgccatcaagcggtccaggcccagttttgcgagcaatttggacagcaaggtgtcgagcagcttggccacgacaaacccgagcagtaccaggaccagcgccccaaacaggttgggaatgaaattcgccactttggtccacaatgcggtcatcgcagtgaccaggctctgggtccagagatcaagttccatattcaatcagccttatcagcagtgcgagcaagaggtttacgacgggacaccggtgatacatgggccgaaccattgttcagggccatcatcaacgccggcagccaacgaccgagcagaccgaacaagtcacccgcccctacctgacggttggcggttttcaacacgcggccaaggcaagcatcgtcgtcacggttggacggcgacgcattgagcatgtcacgcaaagactgttcgaacggatcgtgcataaagacctctcgcaagtgttttaaaagacgagggttaaattcctggggtcacatggccccttcgtacgttcaggtcatattcaggtcaaacccagcgcaatcgtcgaaatagccaccattgtcccagtgcgacggccaccatcatcaggcacgcaatcacgaatccataagggctggaagagaacggaatgccgcccacatttatacccagcaaaccggtgagaaaactcatcggcaggaagatcccggtgatgatcccgaagcgatacatggtgcgattcatgcgcaggctcaaacgccggtcttcggtctcaagcacaagccccacgcgctcccgagccaattcgagctcttcaaggtaacgcgtcaggctgttgtgtaattcgttccaatagtcggcatcgtcgtcacagaaccacggcaatttgatgcgcgtgagctgggcgaaaatatcccgctgcggcgcaagaaaacgtttgagcccagcggctcgacgacgtatctgcaaaacgttgccatgctccggagtataccgttcgtcggcatccagtttttcttcctcgatatcgacgacttcagacagatcggtgaccagatcctgcactttattggtcaggtattgcgccatataaaggatgagctcggacgcggtcttcggcccttttccttccgccagttgcaccagcagctcatcggttgcgcgcagcgggcgcaggcgcagggaaatcacgcgactggccgcagcgaagatgcgcaccgataccatgtcttccggctcggcgccggggttaaggttgaccccgcgcagaaacagcagcaattctgcgtcgggcagcggcagcaagcgcggacgggtgttttcctccaacagcaggtcgcaggcgaactcgctcaagccgctggctttacgcagccacgtctgggtctgcgggtggctgcgatcccaatgcagccacaggctttcctgtggctgaagctgcaagtcgtcaagctcagtccgggcaatcgaacgcgcaccgcctttaccgtccagcaccagggcgtgcaccagcccccattgcgcgttttcttcctcgaacatcctcacccctatcggctactgcggtttattcaggcattttcagcgggcttggcgagacgatcacgccattattgtccgcatagatgtattcgcctgggcgaaaggtcacgccggcgaaagtcacgatcacattcaggtcgccaatgccgcgcttgtcggttttcatcgggtgggttgccaacgcctgcaccccaagatcagtctgggcgatgacatcgacatcacggatgcagccgtagatcaccagcccttcccatccgttcttcgcggctttctcagcgatcatgtcgcccagcaatgcgcgacgcagggagccgccaccgtcaaccaccaacactttgccggcgccaggctggtcggcctgttccttgaccagggagttgtcttcgaagcacttgatggtgacgatttcgccgccaaaggagtctcggccaccgaaattgctgaacatcggctcaaccacctgcaccaggtccgggtaggtgtcgcacaagtcgggcgtcacgtaatggttcatcgagaaactcctgtcgttaaagaagaggtcgaacatcccacggtgtacatcagaaaaacgcatcgcaacaggcattctttaggtggttgcccgtcggcggcggccatgatcagacccatctcatcgcaacgcaataaccactgcgcgactgaatatgaccagaagcgtttaatccgtcatatattagccgcaaccacacacgagtgaaacgcccttggcagagcgccgggtcaaaccgcttccagtgcctgggactctgccccggctaacggtgacagcggatctttcaaccagcgctctaccaacggccatacctcagcctgcgcggctttgctgaccagcatctcaacgtgcccgaaatccccggtaaaaccttgctggcgccccaggcacaggtattggcgatgctcggaaccgacttgctcgaatagcttgcggcacgcccaatccggatcctgccggtcgcccgccgcgcttaccgccaatagcggcacgtcgacttccgccagacctttccaccagtcctgcttgccatcgccaaaacgaccgaacaggccattccagcgcatggcttcgatcatcacgcctgccggctcgtcctccgggccgcgcttgagccgcgaaccggacacctcaccaaagcgtttcaggagcaaacgaccggtccactccaacggtggaatcttcaacggccaatgggtgcggctgacctgacagccaaacagcgccaccgaggccactgccggcgcgcccaggtgctggccgcccaatgccgccgccagtgccgtgccgcccagggaatgcccgacccagtgcggaatttgcgcactttgctcacgcacaaacgcgccaatggccggtaagtcgtaacgcgcatagtcggcgacacggttcctggcatagtcgtgattgcgtttggacaaaccgtgcccgcgcatttccgggatccacacatcaaaaccctggcgcgccaggtaagcgcccaggccgatgcctttgggcgagtaccagaaacgccggttggaaaaactgccgtgcaacaaaataaccggcgtgccccggttttccgggacatcggccaggcccaaacgcgtcacggccagctcgacggtgccgtcggggctgttgccgggtttgaggcggtacacatcttcactcaagtcgccacgacgttcagcgctgatcagggcgacgggaaacaggttgctgctgctttgcataatgctcttgcacaaaaaagggcggcgtccggaaggagttccgccctgcacagataagaatgccggtcacccttggcgagtgaccggcacttttgacgtatcgaccttaagcggacgcttggccttccgcgaggaagaaccaggtttccagcacggagtcagggttcagcgagacgctctcgataccctgttccatcagccatttggccaggtccgggtggtcggaagggccttggccgcagatgccgatgtacttgccggccttgttgcaggcctggatggcgttggccagcagcttcttgaccgcagggttacgctcatcgaacaggtgcgcgatgatccccgagtcacggtccaggcccagggtcagctgggtcaggtcgttggagccgatggagaaaccgtcgaagaactccaggaactcttcggccaggatggcgttggacggcagctcgcacatcatgatcacgcgcaggccgttttcaccacggctcaggccgttttctgccagcaggtcgaccacctggctcgcttcgcccagggtgcgcacgaacggcaccatgatctcgacgttggtcaggcccatctcgttgcgtacgcgcttgagggcacggcattccagctcgaagcagtcgcggaaggcttcgctgatgtaacgcgaggcgccacggaagcccagcatcgggttttcttcttccggctcgtagagcttgccgccgatcaggttggcgtattcgttggacttgaagtccgacaaacgcacgatgacctttttcggatagaacgccgccgccagggtgctgatgccttcgaccagtttctcgacataaaagccgaccgggtcgttgtagccggcgatgcgcttgtcgacgctttccttgatgtccgctggcaggccgtcgtagttcagcagggccttggggtgcacaccgatcatacggttgatgatgaattccaggcgggccaggcccacaccggcgttcggcaactgcgcgaaatcgaaggcacggtccgggttgccgacgttcatcatgatcttgaacggcaggtctggcatggcgtcgatggagttttgcttgatgtcgaagcccagttcaccttcaaagatgaaaccggtgtcgccttcggcgcaggaaacagtcacgccctggccgtctttcaacagttgggtggcgttgccgcaaccgactaccgctggaatccccagctcacgcgcgatgatcgccgcgtggcaggtacgcccgccacggttggtgacgatggcgctggcgcgcttcattaccggttcccagtcagggtcggtcatgtcggaaaccagcacgtcgccgggctggactttgtccatttcggacacgtccttgatgatccgcaccttgccggcgccgatgcgctggccgatggcacggccctctaccagcacggtgccggtttccttgagcaggtagcgctccatgacgttggccgaggtgcggcttttcacggtttcagggcgcgcctgcacgatgtacagcttgccgtcgtcaccgtctttggcccactcgatgtccatcgggcacttgtagtgcttttcgatgatcatcgcttgtttggccaattcgctgacttcagcgtcggtcaggcagaaacgcgcgcgctcggccttgtcgacttcaacggttttcaccgaacgaccggccttggcctcgtcgccgtagatcatcttgatagccttgctgcccaggttgcggcgcaagatggccggacggcctgcctcaagcgtgtgtttgtggacgtagaattcgtccgggttcactgcgccttgtacgacggtttcacccaggccgtaggcgccggtgataaacaccacgtcgcggaaaccggattcggtgtccagggtgaacatcacgccggccgtgccggtttccgaacgcaccatgcgctgcacgccggcagacagagccaccaacttgtggtcgaaaccctggtgtacgcggtaggaaatggcgcggtcgttgaacagcgaagcgaacacttccttggcggcgcgaataacgttttcgacgccgcggatgttcaggaaggtttcctgctggccggcaaaggaggcgtccggcaagtcttcggcggtggccgaggagcgcacggcaacagccatgtccgggttgccggccgacagggtggcgaaggcggtgcggatttcttcgttgagcttctcggggaactcggcttccatgatccatttacggatctgggcaccggtcttggccagggcgttgacatcatcgacgtccagggcgtccagcgcggcgtggatctgagcgttgaggccgctcagttcgaggaaatcgcggtaagcctgggccgtggtggcgaaaccaccgggcaccgagacaccagcgcctgcaagattactgatcatctcgccgagggatgcgttcttgccccccacatgctctacatcatggacgccgagcttatcgagggaaactacgtactctaccaaggtgatctctccactttctgtgttggaaaagctcaggacgccggctgctcagtaggagcaaacgccagcgcttgtggcctggacctggaaaataagtgagaatgcggcccactgcgggacggcaaaatcgcgcctatcatatccaagattcgccatcagcttaaggcccagggctcaaatgaaacgatctgctttctttatctccgacggcaccggcatcacagccgaaacattgggccagagcctgctcgcgcagttcgaaaacattaccttcgccaaattcacgcggccctatatcgacagcgtggataaagcgcgggccatggtacaacaaatcaatctggcggctgaaaaagacggttttcggccgatcattttcgacaccatcgtcaatcaagacatccgtgagatcctcgcaacctccaatggtttcatgatcgacatcttctccacgttcctggcgccgctggaacaggagttgagtgaacactcctcctattctgtaggaaagtcccattccattgggcacaactccaattatatggagcgtatcgaggcggttaacttcgccctggacaacgatgacggcgcccgcacgcattattacgacaaggccgatttgatcctggtgggcgtgtcgcgctgcggcaagacgccgacgtgcttgtatatggccatgcagttcggcatccgcgcggccaactacccgctgaccgaagacgacatggagcacctgacactgccggccgccttgcgcgcgcaccagcacaagctgttcggcctgaccattgacccggatcggctcacggcgatccgcaatgagcgcaagcccaacagccgctattcgagctatgcgcagtgcgagttcgaagtacgcgaagtggaaaatctgttccgtcgcgagaatattgcgcacatcaattccacgcatttctcggtggaagagatctcggcgaagattttggtggagaagggtgtggagcgcaggttcaaatagttgtattgcctgacctggccccatcgcaggcaagccagctcccacatttgaactgcaatcccctgtgggagctggcttgcctgcgatgaacgataacgcggtcctacaggtgaaacctgccaccgccctgccccaacgcggtcgccagcgcatcaaaccccgcccgcaacaactgatcatcccccgacgtattgcagatgctcgcccgaataaactgcggtaccgccgtttgccctacggcaaaggcttcggccgtggcgatcaggtaattattctgcttaagctctgcctcaatttccgacgcgcgccatggctccgggacttcaatccaaaagtgcgggctgttgaggtgagtgcggtattcaaggccggccaacaggtcgcccaccagggctttgcggcggctgatctcgttgatctgctggcgtagcaggtattccgccgtaccgttttcgatccactgcgttgccagttccaacgtcaccggcgtggccatccagcaggttgagcgcagggctgcggaaatacggctgaccagcgccggtggcgcgtgcacatagcccacccgtaatccggcggacacggccttgctcaggctgctgatcaaaatcgtacgttcaggcgcgaaatggctgaggggcggcggccggtcttctaccaatacgccgtgggcttcgtcttcaagaatcagcaggttgtgttcacgacagactttgaccaaggcttcccggcgcgccaccgataacaccgccgtcgtcgggttctggatagtgggcgtgcaatacaacgccgaaacccggtgattacgacagacttcatccagcgcgcccggcagcacaccttcttcgtccatctccaggccgatcagccgcacaccgagcatgcgcgcggccgtgatcagcccagggtaggtaagctgttcagtgaccaccgtatcgcccgcccgcaacagcgccatcatcgcgcagagcaagccatgctggccgccattgacgcagatgacctgctcgggaatcgggtgaaaatctcgctgtaccagccattgcgcccctgcttcgcggtagcgcggcaagccggcatccggagtgtaggcgctgatgtcctggaggaacttggcgttggtcgacagggtttgaaagctctgggccagaaacacggtttcctgccccggtatatgcatgttgcggctcatgtcgaagtaatgacgcggctcctcgctgacgttgcgaaaaccttcgtcacgctggcgctccatcccacgcttgcgcacgaatgtgccgtcacccactcgcgccaccaccaaccccagccgttccagctcgccgtaggcgcggctgatggtgccgatggtcacacccaaattgtcggaaagcacccgatggggcggcagttttcgtccgggttcaatcaagccttcgaggatgccgcgctccatcacatcggacaggcgtttgtacttcacgccctgaccgctggacaacccctcacgcataattgacaccatgtcaatatttgttttgacagccatcattcgccctaatagtgtgcttttacgggttcaatcaccggatgaaacaacttaatacacagtcaatatagagttcaattccggctcagggaagcaataaacgatgccaatgtccgccgttcttgaaaacacaacaaaaacaaaaactcagaagcagtggttggccggcctggtcaccagcgtgatgtttcttatcgtgtgcctgagttggggcaccacctggctggggatcaagatcgccgtcgaaagcgtgccaccgctgacctcggcaggcctgcgcttcctgatcgcgttcccgctgttcctgtgttttgccctggtgcgccgcgagccgattttgttcccgcgcgaaagccgctggttcttcgtatttgtgaccttgtcctacttcagcgttccctattacctgctcaactacggcgagatgcatgtttcctccggcctgaccgccctgctgttcagctgcatgccagtgtttatcctgatcttctccgcgctgtttctgcgtgagcgcatctatttttcccaagtggtcggcatcggcatcggtttcggcagcctctacatgatcatcaagagccagggcctgcacctggaccacgccgaattcttcggggtactggcgattctgaccgccgcgatcatgcacgccttgtgctacgtcattaccaagcaaaaaggcagcgccatcagtgtgatcacctacaacaccctgcccatcggcattgccgggttgatgctgttcgtggcgggcctgtggtttgaaacaccaaccttcgaaaacatcaccctgcgctcctggagcgcgctgttttacctggggctggtggcatcggtgggcggttttatcgtgtacttcatgctgctaaaacgcttgagcccgatcattttgtcgttcgtattcatcatattcccggtgttcgcagtgatcatcggcgcctggtacgaaggcgtggaaatctcccgagacctgatgctgtactcggccatcctgctggccggttttgcgatcaccaagttgccggttgaaaaactcctggccaagaaaaattgaccctccaatcccagcaacgcgagagaaacatggaagtcctccgccccaccgccctggaacagatctacgcccacgccaaccgcagttaccccgaggaatgctgtggttttgtcttcgccgatggcagcgtgtatctgggcagcaatatccagaatgagttgcaccgcaagaaccccgagatgtacccgcgcagcgcggccaacggctacaccttttcagtggccgacaccctgctgatgaacaaagcgttccgcagcgacaacccggtagtggtgatctatcactcccacccggatgtcggcgcctatttcagtgacgaagatcaggacaaggcactgttcctgggtgagccgatctaccccgtcagctacttggtggtggacgttcgtcagggccatgccctgggctcaaagctgtttgcctgggatggcaagcatttcgctcttcaatccttcaacgacctgcacacggagttgtccatgaacgctgtctctttccccgatattctggttcgcgtggccaagctgccggaatcgactcttgagggcaccggatcgacattgcgcgaagtcattgaaaacctctgcaaaagccacccgcagctgcgcgctcatctgtttcatgagaagaacaaccagctcaaggaacacttcctgtttaccgccgaggaagaactgatcggtgccgacgacccgttgccggaaaaagccaacatcgaagtactgctcgccacgtccggcggcatggacacagatgctttaagcaatgaacctgccctcagtaatgaggaagtacagcggtacgtgcgccacatcaccctgccgggcgtcggtcgcgaaggccaattgaacctgaaaaaagccaaggtactgatcatcggcaccggtggcctgggctcgcccatcagcctgtacctggcggcagccgggatcggcactctgggcctggtggatttcgacgtggtggaaagcagcaacctgcaacgccaggtcgttcacggcaacagcaccctgggcatgcccaaggtcgagtccgccaagcaacgcctgcaagacctcaacgcgcatatccagatcaacgcgcacaacactgcgctgaacgtcgacaacgctttggagctggtcggcgcctacgatctggtgatcgacggcacggataatttcgacacgcgctacctggtcaacgacgcctgcgtacaactcggcaaacccttggtgtacggcgccatctaccgcttcgacgggcagatcagcgtgctcaactataaaggtgggccgtgctatcgctgcctgttccccagcgcaccaccggcggaactggcgcccaactgcagcgccggtggcgtgatcggcgtgctgccgggtgtggtggggatgattcaagccaccgaggccatcaagttgctgatcggcattggcgagccgttgtccggccgcttgatgcgctttgatgcactggcgatgaaattcagcgaaattcgcttcaagcgccgcgccgactgcccgtgctgctcggaactgcgccacagtgaaagcgtggcgccggcggtctgcgccgatgccatcccaagccaaccccccctcgccgaggaacgctacatcaagccgcgcgtactcaagcaagtgcttgaacaccaccgcagcgccgacgtgctgctggatgtgcgcgatgccagcgagctggaggtgtgcaaattacccggtgtggtgcatatcccgctggccgaactggacgggcagctcgacagcctcagccgcgacaacacccactacctgatctgctacgccggcacccgcgccgagcaagccgccagtaccttgctggccgccggtttcgccaacaccaaagtcctgcagggcggcatgaaacattgggttcgcgacgtcgaacccgacatgccgttgtactgagccgagggctgactgatgttgcataactccattctcgacgttatcggccacacgccgattgtgcgtctggcgcagttttccgaagacctcggcatcgaggtctacgccaagctggaatcccttaaccccggtggcagccacaaggcgcgcatcgccctgggcatgatcctcgacgccgagcgccgcggcgtgctgatgcgtgattccgggcagaccatcatcgagcccagcggcggcaataccggcatcggcctggtcatggctggtaatgtactgggctacaaagtggtgctggtgatccccgacaactacagccccgaaaaacagaaactgctgcggctttacggcgccaaagtagtgctgtcagacagccgcctggggaataattcccacggcgaaaagtgcatggaactgcagctggaaaaccccagctacgtgatgctcaaccagcagcgcaacggcgccaacccgcaaacccaccgcgacaccaccgcaccggaaatcctccgcgccttcggtgagcggcgcgtggactacttcgtcagcggcatcggcacgggtggccacatcaccggcatcggcgaaaccctcaaggcggcgtggccggccatgcgcgtgatgggcgtggagcccgaagagtgcgacctgctcaaggaccagcacgcgccccaccatatccagggcctgtcgatcggcttgatcccgagcattctcaatgtggacgtgatcgacggcatgctcaaggtgtcgcgccaggcgtgcatcgacatgatgaaacgcatcatgcgcaccgacgccatcagcctcggcttgtcctctgccgccaacatggttgccatcgcgcagctcgcccctgaactgccgcccgaaacggtggtgttgaccttggtctacgacaatgctgacagctacctgcccagtttcgaataaccggtttcccaaccatccagaatgcgggggtgcctccatgggaggctttatcgacatgcaacagctgcacgatgagctgctcacccacctcatcaagaccctgacgcctgcgcagatcaagcagctggaaccgcacctggcgccgctgatccagaacgccgcccaggcggtggccgaagacttgatcgcctatgcctatcgcgacccggcatcccgtgggcgcggcgagttgatcctggagtcttacgcctcgttcaaggcggtgctgttttaccgccttgctcacctggtgtggaatttccccgaccagaccaacggcgtgttttcgcgcatggccctcaagctcagcaaccagggcaaaatcctctcaggcgcggagattcacccggcggccaaaatcggccgacgcttcgtgctggatcatggctacggcaccgtcatcggcgaaacctgcgagatcggcaacgactgctacatcctttgcggcgtcaccctgggcgcccgtggcattgccaacaacccggacggcaaacgccacccgcgcctgggcaacaatgtagaggtgggcgccggcgcccgcgtgctgggttatgtactgatcggcgacaacgtatttatcagcccctcgtgtgtgatcacccaggacgtgccggccggcaccaaggtcaaggtggtcaaccaggttcagttgcagaaaaacgctgagtccgaccacggcaattatctgggcgccttcgccctggatgagcgtttgcacgtggtcggcgaagtcagcgccagtcacaaggtcacggtgctcgacgccgactttcacccgttgcaggggttgatgctggaacccacggtgaaagagcgtcatcacctgcaatttcgcctgcgccgactcgacatcggcgagcagctaccgcgcctgccgttgaacctgaaagtctgcgggccggaatttgaaatcaccctgctttccccccctggtttgagtgcaatggtgcgtcacctgttgcaagccagcccactgattgtcggaggttgaacatgtctgtgcacaccatggaaaccctggcgctgttcgacagcgcgccctaccagaacgccttcagcgcccgggtgattgccgtcagcgaacacggcatcgccctggagcacacgttgttctaccccaccggcggcgggcaaccgggagacacagggcacctcaccctggccgatggcacgcgggtcgaggtaatcggcaccgtgcgcgacccggtgttgcgctcgatcatctggcatcaagtggaccattgccctgagcagttgaccgcaggcgtgcaggtggacgcgggcctggactgggaacggcgctaccagcacatgaaaatgcacacctgcctgcacttgctgtgctcgatcatcgatgcgcccgtgaccggttgcagcatcagcgcggacaagggccgcctggatttcgacctgccggaaatgaccctcgacaaagacagcatcacccgcgacctcaacgcgctgatcgaacaagcccatgcggtgaaaaccctgtcgatgcccgcctcggagtactccaccctgctgcagatcacccgcacccaggccgttgcgccgccggtgattcaaggttcggtacgcgtgatcgacatcgccggtatcgatatccagccgtgcggcggcacccatgtgatcaatacggaagaaatcggccgggtgttctgcgaaaaaatcgagaagaagagcaagcacaaccgccgagtgattctgcggtttgagtgagagattgatgctgacgcgagctagtgtgggcgttaactcacactagccaatccgctgtcgtgctttattggttttgcccgctgatttgcttagtcaaggagttcacctgcgctgtaagtttcgacgtctcctgctcaaaattctgttccatctcagcaatttgcttctcaagttcctgatttttctggttcaggtaagccacggtgccgggggcaggcgctgttgagtcattggctggggcaggcgcctttgaatcattggctggggccgactcttcattttgtggaggggcggcggtatcaggcttgacggggtctgacgaacccgtctcgggtgtgcctgacgactcgggagctgtctgcttttgaggagcacctttgctgtacgctgcactcaattcatccaatttatccgacaccaacttcattgcgctttggaattccttaagtaaatttgaaaacagattttgaatatcggtttgttgtttagccacgttatccagcccttgaggctggctttgctctgccccctgagtgctctgagtatcctgagagccctgattacccggagtgttctgagagccctgagtgtcctgagtaccctgagaaccctgagaaccctgagtatcctgagaaccctgagtatcctgagagccttgagtgccctgattgccctgattgccctgagtgccctgtgtacccggcgtggaagaagtttgaggtggggccgacttgccatccgcgcgacggttcgtgggcggagcatccggcgtcgcgggcgcctgttcaggctttttacccgacttcttgatttcttgaagcaacttgtctatttgggcatagagatcattcagcttcttcccaactttttctctcaacgatttgtgtttggcgatcagttgattatttttctcagtcagcgccgcgatctcgtcctttgaatcagcgccctgagtcggctggttgacgattttgttgtggctggaaaactgaccgcgctgttcagtgcttactgtacgcggcggcgttgactctgtcggggcattgcgtgggttgacgtggacgccggtagggttgctggaattatcatgcgccggcggtggttgcatttcgtatttgtattggggcgcatatcgttgagtatctacagtagacataaagcacctcttcagtctctcgctgggtccgcgtattgggtttgccggacaacctggcacggcaggtcatccgtctacctgattggcgtgcatcggaaaccagttccacgggagtaagaaatttgagggactgcttgtgacaaggtcaaaacgcgtcgatgcccaagcgacgtttcgtacaggaaactgacagcaaatttatgtgcttgtaacattcagaaacgtacaatcccgccagcaacgcctcgttgcccctgactcacgaaaacagcgcccgcccttcgcggtgggtcattcgtgcagcagctaagctcactcccatcacgcccctgaacctgaacgctgcaggactgactgcctatgaacaaagtgttccgcgattacctgccagcatccacgttgcgcttgctgcccaaccgttgggacttggtcgccctgcctttggtgattggctttctactgtttttctcgatcactgcccgtgaaacctgggcgcccattgccacgctacagagtgaagtgatctccctcgacccggccaacctgccggagtacgcgatgcgcaccaccctgcgcatgctcgcggcgatggtcgcagcgctggtcttcaccctgttgtacggcaccctggcggccaaaagccggcgcgccgagaaactgctggtgccggtgctcgacatcctgcaatcggtgccggtgctcggttacatctcgtttaccgtgacgtttttcctgttgctgttcccggggcgcgtgctgggtgccgagttcgcggcgatctttgcgatcttcaccagccaggcctggaacatgacgttcagcttctaccagtcgctgcgcatgctgccccatgacctggtggaagtgtcgaccaacctgcggctgtccggctggcagaagttctggaagctcgacgtgcccttcgccatgccagggctggtgtggaacatgatgatgagcatgtccggtggttggttttttgtggtcgcctccgaggccatcaccgtcggcgacaagaccatcaccctgccgggcgtgggttcgtacctggccctggcgattgctcagaaagacctgcacgccgtgggctacgtgatcctggcgatgattgtggtcatccttatgtacgaccagctcctgttccgcccactggtggcctgggccgacaagttccgcatggaaaccaccgcctcccagggcgccgcgccgcaatcctgggtgctcaacctgatccagcgcacccgcgtggtccagcgcatgctgcgcccgattacccgctccttcagccggatcggcaacaagcgtttcagcctcgcgggcggtgcgctcaaggccttgccggcagcaacaccgaaaacctcaaaagtgatcgattgggtgtggggcacattcatcgcgctgctggccgcgtatgcgctgtatcacatcgtgcagtacgtcggcaccgaagtgacctttgccgaagtcggccacgtgtttgtgctgggcctgattacgctgctgcgggtaaccgggctgatcttgatcgcttcgctgatctgggtgccgctgggcgtgatgatcggcctgcgccccgccctggcggaaaaaatccagccgctggcgcagttccttgcggcgttcccggcgaacctgctgttcccggtgtttgtcatcgtgatcctgcactacaagctcaatccggatatctggctgagcccgttgatcgtgctgggcacccagtggtacatcctgtttaacgtgatcgccggggccagcgcgtttcccaatgacttcaaggaagccgccgccaacttccgcattcgcggctggctgtggtggcgcaaggtgatgttgccggggattttcccgtactacgtcaccggtgccattaccgcctcgggcggcgcgtggaacgccagtatcgtgtccgagtacgtgtcctggggccaggacaacgtggtcgcccacgggctcggcgcctacatcgcccagaccaccgccgccggcgacttcccgaaaatcgccttgggcgtggtggtgatgtcgatcttcgtggtggcgttcaaccgcgcggtctggcgacctatgtacgcaatcgctgaaaacaaacttcgtctgaattgatgggattcgctgtgatgaatacctctaccgaacacgctgccgacaccccggaaatctactcgctgaaaaacgtcaaccgggttttcggcaaaggcaaggatgagctgcaagtgctcagcggcgtagacctgagcctgcatgaaggcgagatcgtcggcatgctcggccgctcaggctcgggcaagtccacgctgctgcgcatcatcgccgggctgatccagccgtcgtcgggcgaagtgcgctacaacggcgcgccgctcaacggcccggcggaaggcgtggccatggtgttccagacctttgcgctgttcccctggctgaccgtgctggaaaacgtcgaagccggcctgcaagccttgcaggtcgagcgcaaggaaagccgccgccgcgccctggccgccatcgacctgatcggcctggacggctttgaaaacgcctacccgcgagagttgtccggcggcatgcgccagcgcgtgggttttgcccgtggcctggtggtcaacccgaccttgctgctgatggacgagccgttctcggccctcgacgtgctcaccgccgaaaccctgcgtaccgacctgctggacttgtggagcggcaaacagctgccgatcaagtcgatcctgatcgtgacccacaacatcgaagaagcggtgctgatgtgcgaccgcattctggtgttgtcgtccaaccctggccgcgtggtcgccgaaatcaaagtgccgtttgcgcacccgcgcaaccgcctggaccagactttccggcaaatggtcgatgacatttacgcgctgatgaccgaccggcgcagcgccgatgccaaaggcatacccgagctgaaaatgggcagcctgttgccggaagtgtccactaacttgatggccggcctgatcgaaaccctggccgccgagccttacaacggccacgccggtttaccgaccgtggccgagcgacgcttgctggaagtcgacgacctgttcccggtggccgagatgcttgagcatctgggtttcgccgaactcaagggcgccgacatcaccctcaccgacgccggcaaactgtttgccgactatggcacccaggaacgcaaaacgctgtttgccgagcatttgatccgccacgtgccgctggccgcgcgcatccatcaggtgttgctggaacgcagcgggcaccgggcgccacgggtgcgcttcgagcaggaattggaagactcgatgaccgaagcctttgtcgaaaaaaccctggaaagcgtggtggcgtgggggcgctatgcggagattttctcctatgacgaccacaccgaaacgttcagcctggatgacgtggaaggcagtatgtaagcccgactgaacaacacaaaaaagtgtgggagctggcttgcctgggagctggattgtgtagagctggattgtgtgggagctggcttgcctgcgatggcatcacctcggtttaactgcaaaaccgaggcgcctgcatcgcgggcaagcccggctcccacaaaagccagctcccacattagtttggtggtggtgtttagatcacaaacaggtccacaaaccgattcaccggcgtagcctcaagccgcgcctgatccttgcacagcgcaaaaatctccccactgcgctgcgcggtaaaccgcgtcgccaggttggccttgaacttgtcttccagcaagggaatgccgtccacccggcgacggcgatgcccaatcgggtattccaccgccacctgctcggtgctggagccatccttgaaaaacacctgcaccgcgttggcgatggagcgcttgtcggcctccaggtattcgcggctgtagcgtgggtcttcgacgatgaccattttctggcgcagctcatcgataatcgggtgagccgcgtggaacgcatcctcgtactgctcggccaccaagttaccgaaggccagcggcacggcggtcatgtactgcaggcagtggtcgcggtcggcagcgttggccagcgggccgactttggaaatgatgcggatcgccgactcgtgggtggtgatcacgatgcgctcgatctcatgcaggcgctccttgacctgcgggtgcaacgtcaccgccgcttcgcaggcggtttgcgcatggaactcggccgggaaactgatcttgaacagcacgttttccatcacgtaggtgccgtagggctgggacaggctgaacgcacgtttgtcttcgggcttgagcgccaggtccttgttggtgtggctgaacagtacgtcataaaacccccattgcggcgcactcaacacacccggaatgcccatctcgccgcgcatcgcgatatcggccagacgcacgccccggctcgacgcatcgcccgccgcccaggatttgcgcgagccggcgttcggtgcgtggcgatacgtgcgcagtgcttggccatcgacaaacgcgtgggacaaggctgcgagcagctgctcacggttggcgcccatcagtttggcggtcaccgccgtggaggcgactttcaccagcagcacgtgatcgaggccgacgcggttgaacgagttttccagggcaatcacgccctggatttcatgggccatgatcatcgcttcgagcacggcgcgcacggtcagcggcgcgtcgccattggccaggcgtttttgcgaaaggtggtcagccacggcgaggatgccgccgaggttgtcggaggggtgaccccattcagcggcgagccaggtgtcgttgtagtcgagccaacgcacaatgcagccaatgtcccaggcggctttgaccgggtccaggcgaaacgacgtgccaggcactcgcgcgccgaacgggacgacagtgccttcgacaatcggccccaggtgcttggtgcattcggggaagcgcagggccaacaggccacagccgagggtgtccatcaggcagttgcgcgcggtgtccaaggcggcctgggactcgatgcggtaattgaggacgtaatcggcaatgtcctgcatgacctgatcgtagtccgggcggttgttctggtcgacgttggcgctcatggcagttctccaaaaagggttggggttagtcctcgggcttacggttgatcgggttgtggccggtctcgttgccagccttggaatggagccctcctgtgggagcgggcttgctcgcgaatgcggtgtgtcagttacacaaaagttgactgatccaccgcattcgcgagcaagcccgctcccacacaagcccgctcccacaggggttcggtgcaaggtgctagaaagcgtcgccgggcacgcgcacgaaaccttccatcaacacccgcgcgctgcggctcatgatggctttcttaacaacccattcgccgttcacctgggtcgcctcggcgcccacacgcaaggtgccggacgggtgcccgaaccgcaccgcattacgctcaacaccacccgccgccaggttgaccaaggtgccggaaatcgccgccgccgtgccaatcgccaccgccgccgtgcccatcatggcgtggtgcagcttgcccatggacagcgcgcgcacgagcaaatccacatcggcggccttgattgccttgccgctggacgccacgtaatccgcaggcttggccacaaacgccaccttgggcgtgtgctggcgctgggcggcttcgtccagatgcttgatcaagcccatgcgcaaggcgccgtaagcgcgcacggtttcaaacattgccagggctttcgggtcgctgttgatcgcgccttgcagctcggtgccggtgtagccgaggtcttcggcgttgatgaaaatcgtcgggatgccggcgttgatcagcgtcgccttgaaggtgccgacaccgggcacttcgaggtcgtcgaccaggttgccggtggggaacatcgaaccaccgccgccctcttcttccgccgccgggtccataaactccagctgcacttcggcggccgggaaggtcacgccgtcgagttcgaagtcaccggtttcctgcaccgcgccgtcagtgatcggcacgtgggcaatgatggtcttgccgatattggcctgccacacccgcaccacggccacgccgttgtggggcacgcgggtggcgtcgaccagcccggcgctgatggcgaacgaaccgaccgccgccgacaggttgccgcagttgccgctccagtcgacaaaaggcttgtcgatggacacctgaccaaacagatagtccacgtcgtggtcggcgcgggtgctcttggccaggatcaccgttttgctcgtgctcgaggtggcgccgcccatgccgtcgatttgcttgtcgtagggatcggggctgccgatcacccgcaacagcaaggcatcgcgcgtggcgcccggcacctgcgccgcttcgggcaggtccttgaggctgaaaaacacgcccttgctggtgccgccacgcatataggtggcggggatcttgatttgcgctgcgtgtgccatggttatccccttaagccgtcgccgccgattccaggaagtcctgggcaaaacgttgcaacacgccgccggcctcgtagatcgacacttcttcggcggtgtccaggcggcaggtcaccggcacgtcgacacgttcgccatttttgcggttgatcaccaaggtcagctgcgcgcgcggggtgcgctggccgaccacgtcataggtttcgctgccgtcgatgttcagggtgtggcggtcggtgcccggcaggaactccagcggcaacacgcccatgcccaccaggttggtgcggtggatacgctcgaagccttcggcggcaatcgcttccacaccggccaggcgtacacctttggccgcccagtcgcgggacgaaccctggccgtagtcggcgccggcaataatgatcagcggctgcttgcgctccatgtaggtttcgatggcttcccacatccgcgtgacctggccttccggctcgatccgcgccagcgaaccctgcttgaccttgccgttttcctggaccatttcgttgaacagtttcgggttggcaaaggtcgcgcgctgcgcggtcaggtggtcgccgcggtgagtcgcgtaagagttgaagtcgacttccggcaagcccattttcgccaggtattcacccgcagcgctgtcgagcatgatcgcgttggacggcgacaggtggtcggtggtgatgttgtccggcagcactgccagcgggcgcatgcccttgagcggccgcgcaccggcgagcgcgccttcccaatacggcgggcggcggatgtaggtgctttgcgggcgccagtcgtacagcggcgcgactttggggccggtgtcttcgtggatcgcgaacatcgggatataaacggcgcgaaactgctccggcttgaccgaggccttgaccaccgcgtcgatttcttcgtcgctcggccagatgtcttgcaggcggatttccttgccgttggcgtcgaggccgagcacgtccttttcaatgtcgaaacggatggtgccggcaatcgcgtaagccaccaccaacggcggcgaagccaggaacgcttgcttggcgtacgggtgaatgcgcccgtcgaagttgcggttgcccgagagcacggcggtggcgtacaggtcgcggtcgatgatttcttgctggattaccgggtcgagtgcgccggacatgccgttgcaggtggtgcaggcaaacgccaccacgccgaaaccgagtttttccaactcgtggcccaggcccgcgtcctccaggtacatggccacggttttcgaacccggtgccagcgaagatttgacccacggtttgcgcgtcagccccaacttgttggcgttacgcgccagcaggccggcagcgatcacgttgcgcgggttactggtgttggtgcagctggtgatggcggcgatgatcaccgcgccgtcgggcatttgccccggcacttcatcccactggccggagatgcccctggccgccaggtcgctggtggccacgcgggcgtgcgggttgctcggccccgccatgttgcgcaccacgctggacaggtcgaaggtcaggccgcgctcgtattgcgcgcctttcaggtcatccgcccacaggccggtgtggcgtgcgtactgttcgaccagggtgacttgttcgtcttcgcggccggtgagtttcaggtaggcaatggtctgctggtcgatgtagaacatcgccgccgtggcgccgtattccggggccatgttggagatggtcgcgcggtcgcccagggtcagcttggaggcgccttcgccgaagaattccagccacgcgccgaccactttttgtttacgcaggaactcggtgagcgccagcaccatgtcggtggcggtgatgccgggcagcaacttgccggtgagctccacgccgataatttccggcaggcgcatccacgacgcgcggccgagcatcacactctcggcttcgaggccgccgacgccgatggcgatcacgcccaaggcgtccacgtgtggcgtatggctgtcggtgccgacgcaggtgtcagggaaggccacgccgtcgcgcacctgaatcaccggggacattttctccaggttgatctggtgcatgatgccgttgccgggcgggatcacgtcgacgtttttgaaggcctttttggtccactcgataaagtggaaacggtcttcgttgcggcggtcttcaatagcgcggtttttctcgaacgcgtccggatcaaaaccaccggcttcgacggccagggagtggtcgacgatcagttgggtcggcaccaccgggttgacctgggccgggtcaccgccttgcagggcgatggcgtcgcgcaggccggcgagatcgaccagcgcggtctggccgaggatgtcgtggcacaccacgcgcgccgggaaccacgggaagtcgaggtcgcgcttgcgttcgatcaactggctcagcgaggcgttgagggtggccgggtcgcaacggcgcacgaggttttccgcgagcacgcgcgaggtgtacggcaaggtggcgtaggcgccgggagtgattgcatcgacagccgcgcgggcgtcgaagaaatccaggcggctgccggggagcgatttgcgaaattcagtgttcatcgtcaggactcggtcacggtaggttcacagggcgaactgtcgacactggcctggctctctgtgggagctggcttgcctgcgatggcttcactgcggtgtgacagatacacccaggtgatgctatcgcaggcaagccagctcccacagaaaagcacattggccagtgtgcttagctcatcccactcagcgacgttcgattggcacgaacttgcgctgttctacgccgatgtactcggcgcttggacggatgatgcggttgttggcgcgctgctcgaacacatgcgcggcccagccagtcagtcgcgagcaaacgaagatcggcgtgaacaatttggtcgggatacccatgaagtggtacgccgaggcatggtagaagtcggcgttggggaacagtttcttctgttcccacatggtcttgtcgatggcttccgagaccgggaacagcaccttgtcgcccacttcatcggcgagttttttcgaccagcccttgatcacttcattacgcgggtcgctgtctttgtagatcgcgtggccgaagcccatgatcttgtctttgcgcgccagcatgccgagggtgccttcgacggcttcctcggccgagccgaaacgttcgatcatttccatcgccgcttcgttggcaccgccgtgcagcgggccgcgcagggagccgatggcagcggtgacgcaggagtaaagatccgacagggtcgaggcgcacacgcgggcggtgaaggtcgacgcgttgaattcgtgctcggcgtagaggatctgcgacacgttcatgactttctcgtgcagcgcgctcggctttttgccatgcagcaggtgcaggaaatggccgccgatgcttggctcgtcggtcacgcagtcgatgcgcttgccgtcgtggctgaagcgataccagtagcacatgattgccgggaacgcggcgagcaggcggtcggtgacatcgcgttgcacgctgaaatctttctccggctcgatattgcccaggaacgagcaaccggtgcgcatcacgtccatcgggtgggcgtcggcggggatgcgttccagcacttctttcagcgcctggggcaggtcgcgcagcttgccgagtttggcggtgtaggcggccagttcggcttgggttggcagctcgccgtacagcagcaggtaggcgacttcttcaaattgcgcatcggcggccagttcgcgcacgtcgtagccgcggtaggtcaagccggcaccggcctggcccacggtggacagtgcggtctgcccggccacctggccacgcaggccggcgccactgagtacttttgcttcagccatgttcgttctccaatcttgaatttattagggagccacagggttactttttggcggcaaacagcgcgtcgagcttctgctcgaaggtgtggtagtcgatgcgatcgtaaagctccatgcgggtttgcatggtgtcgatcacgttctgctgggtgccgtcgcgacgaatcgcggtgtagacgttctcggcggccttgttcatggcgcggaaggccgagagcgggtacagcacgatggaaacatcggcagatttcaactgttcggtggtgtacagcggcgtcgcgccgaactcggtgatgttggccaggatcggcgctttcacacgggaggcgaacagtttgtacatctccagctcagtgatggcttccgggaagaccatgtcggcgccggcttcgatgcaggcggcggcacgttccagcgcagactccaaaccttcgaccgccagcgcgtcggtgcgcgccatgatcacaaagctgtcatcggtgcgcgcatccacggcggccttgatgcggtcgaccatttcctgctgggacacgatttctttgttcgggcgatggccgcagcgcttggcgccgacctggtcttcgatatggatggcggcggcgccgaacttgatcatcgacttgaccgtacgcgccacgttgaaggccgaggaaccgaaaccggtgtccacgtccaccagcagcggcaggtcgcacacgtcggtgatgcggcgcacgtcggtcaacacgtcatccaggccggtgatgcccaggtccggcacgcccagagagcccgccgcgacgccgccacccgacaggtagatcgccttgaacccggcgcgcttggccagcagtgcgtggttggcgttgatcgcaccgaccacctgcaacgggtgttcgctggcgacggcgtcacggaaacgctggccgggtgtacttttattgttcgaactcatgactcacctcgtgattggggagcgccgtccgggaagtgacgggcaatgttgcgtttggacgcgccgatatgccggcgcatcaacaattcggccagttcaccgtcacgctcggcgatcgcgtcaagaatgcggtgatgctcggcaaaggcctggcgtggacgattgggggtcgcggaaaactggatgcggtacatgcgcaccaattggtacagctcgccgcagagcatttgggtcagtgtgcgattaccggcgccttgaattatccggtaatgaaaatcgaagtcgccttcctgctggtagtagccgaggccggcctggaacgcttcgtcacgttcatgggtgtgcaacacctggcgcagctcttcgatttcggcgtcggtcatgcgctcggcggccaaacggcaggccatgccttccagggattcgcggatttcatagagttcgatcagctcggcatggctcaaggacacgacccgcgcgccaacgtggggcacgcgcaccagcaggcgctggccttcgaggcggtggatcgcttcgcgcagcgggccacggctgatgccataagtgcgcgccagttccggctcggaaatcttgctgccgggggcgatctcgcccttgacgatggcggcctggatacgccggaagacgttctccgacattgtctgggaatcgtctgacggcgccagggaggcttccgcttgatcgagcatattgtcgacacctttaaaagcaatgcggcaaaaactagccaatcagcccttaatagtcaaagaataaatccacattgtcgacaatcgtctaataaccccttctgcacgttctcggggcatggccgcctgccagcgctggcgccaaaaaagcatcatgttagaatgcccgccgcatttgcctgacatcatttgatgaaacggcgcacgagggagcttgcgcagcaatgccagtcgccttgaattaaacatcgcactgcaccgcctcaggatctatgagactcaagcccttcgttttaatgtgttgccttatgtgcttaccgggccttggcgttgccgccgagaagaccgtgtatggcctgaatgaatacgcaaaacttgccggcattgacctggaagtcgcagccaaactcgacactggcgccaagaccgcctcgttgagcgcccgcgacatcaagcgcttcaagcgcaacggtgaatcctgggtacgcttctacctggccatcgacaccgcccattcccaccccatcgaacgccctctggcccgcgtcagcaagatcaagcgccgcgccggtgactacgaccccgatgaggacaagaactacaccgcccgcccagtgattgcactggacatctgcatgggcaccgctttacgcagcatcgaagtgaacttgactgaccgcagcgcattccaatacccgctgctgatcggctccgaagcgctgaaacgctttgatgcgctggtcgaccccagtcttaaatacgcagcgggcaaacctgcctgcgccgctgacgctcctaccgccgagtaaaccgaatgcgctctttgaccctgcacctgaaaatcctgatcaccatcctggtggtgttgggtatttcggtcaccgcctaccagattttcgtgctggggattcccgtcaccgaggacgccaccgacgacctgtggaacatcgatgccaaggtcgagttcgtcgccaaccccaaggacccggtgaaaatttcgatgttcgtgccgcccctgagccgcgacttcgtcagcctcaatgaaagtttcatctccaataactacggcgtgagcgtcaaccgcaccgatggcaaccgcaaggtcacctggtcggcccgccgcgccaagggcaaccagacgctgtattaccgcctggtgctgaccaagcgttacagcggcgaaaaggtcaaggtcaaaggcccgaccttccgcgacagcatcgctgtggaaggcccggaaaaaatcgctgccgaagccctgctggcgccgatccgccagcactcggcggatgtcgagacgtttattaccgaagcgatcaagcgcaccaataacctcaacgacgacaacgtgaagctgctgctggcgggcgacccgtcgacgccgcacaaggccaaaattgtcgagttattgctgtccatcgcccatgtgccggtggaaaaagtccacaccatccgcctggtggctgatcagccgcaaaccccggagctgtggctgcgcagcttcaatggcaatgactggttgtacttcaacccggaaaccggcgagcaaggcctgcccgccgaccgcctgctgtggtggaccggcgatgaaaacctgatcacggtggatggcggcaaaaaagccatggtgacgttcagcctgaacaacagcgaaatgaacgcgattcgcctggccaagctgaccgacgaaaacaccgacgccaactttctcgaatattcgctgtacggcctgccactgcaaacccagcagaccttcatgatcatggtgatgatcccgattggcgtgctggtgatcctgatcctgcgcaacctgatcggcctgcaaaccttgggcacctttaccccggtgctgatcgccctggcgttccgcgagacgcagctgggcttcgggattgtgctgttcaccattattaccgcgctgggcttgtcgctcaggtcctacctggaacacttgaagctgcagatgctgccgaggctgtcggtggtgctgaccttcgtggtggtgctgattgcagccatcagcctgttcagccacaagctgggcctggagcgcgggctgtcggtggcgctgttcccgatggtgatcctgaccatgaccattgaacgcctgtcgatcacctgggaagaacgcggcgccaaccacgcgctgaaagtggcgattggtacgctgttcgccgcttcgctggcgcacatcatcatgagcgtgccggagctgatctactttgtgttcaccttcccggcgatcctgttgatcctggtgggcttcatgctggccatgggacgttatcgcggctaccgcctgaccgagctggtgcgtttcaaggccttcctcaaggctgattcgtaatgttcggcttctggaagacctggaaggcccttgaagcgcgggggatcatgggcatcaaccggcgtaacgccgactacgtgctcaagtacaacaagcgcagcctgtacccgattgtggatgacaagatcatcaccaaggagcgggcgatggcggccggcattcacgtgccggaaatgtacgggatcatttccaccgagaaggaaatcgacaagctcgacgacatcatcggtgggcgcagcgacttcgtgatcaagccagcccagggcgccggtggcgacggcatcctggtggtggccgaccggtttgaagggcgctatcgcacggtgtccggcaagatcatcagccatgaagaaatcgagcaccagatctccagcatcctcaccggcctgtattccctgggcggccaccgcgaccgcgcgctgatcgaatatcgcgtggtgcccgaccagatcttcaagagcatcagctacgaaggcgtgccggatattcgcatcatcgtgctgatgggctacccggtgatggccatgctgcgcctgccgacgcgccagtccggcggcaaggccaacctgcaccagggcgcgattggcgtgggtgtcgacctggctaccggcctgacattgcgcggcacttggctgaataacatcatcaccaaacaccccgacaccaccaacgcggtagacggcgtgcaactgcccaactgggacggtttcatgacgttggccgccagctgttatgagttgtgcgggctgggttacatcggtgtggacatggtgctggaccaggaaaaaggcccgctgatcctcgagctgaacgcgcggccggggctgaatatccagatcgccaacgattgcggcctgacgttgcgtacccatgcggtggaagcgcggtgggaagaattgaaggctgcgggcgtgacggaaacgccggaagagcgggttaagtttgtgcaggagatgtttgggcatattcctgctgtggaaggttgatatcagaccgcctgtgacacagagcgtcacggtatgcattcccacgcggagcgtgggaacgatcagtagcgactaatcaccgaacatcccctctaggagcaaatcctacaggggactacaatcccctcccccgcgccattagctgatccaccccgcatgtcgacctgttccgtacacccgctgccctaccgggccaaccccgccgactacttcgcggcgattcgccatgcgcccggcgcggtgctgctcgacagcggccgcccggctgccgagcgtgggcgttatgacctgctcagtgcctggccgctggaaacgctgacggtacggcctgacgaaagcggcggtgatttcctgcagcgcttgcgcgaaaacctgacgcagctgggtgaggcggcattgcccgccggtttggaactgccctttgccggcggcttgatcggttacctgagctacgacttcggccggcatctggaacgcatgccgcacttggcggtggatgacctgcacctgccggatgcacgcttcgggctgtatgcctgggcgctgatcagcgatcatcaggcgcgcaccagtcagttggtttttcacccggcgctggccgccagcgaacggcaacgcctgatcgacctgttcagcctgcctgcctctgaagcatcggctagcttcgcgcttcgcggcccaatggcgccggacctcagcgccgaggcttaccgccaggccatcgtgcgcatccaggactacatccaggccggtgactgctaccaggtcaactttgcccagcgttttcgcgcgccgtgcatcggtgatccatgggtggcctactgcgccctgcgcgaggcctgcccgacgccgttttccgggttccagagcctgccggatgacggcgcggtgctgagcctgtcgccggagcgctttgtacacatcagccagcgccgcgtcgaaacccgccccatcaaaggcacccgcccgcggggtttgacgcccgcagaagatgcggccaatgccgccgaactgctggccagccccaaggatcgcgccgaaaacctgatgatcgtcgacctgttgcgcaacgaccttggccgcacctgccgcaccggctcggtaaaagtgccggagttgttcagcctcgaaagctaccccaacgtgcaccatctggtgagcagcgtcaccggtgaactggccgacgacaaagacgccctcgatctgatcgccggcagcttccctggcggctccattactggcgcgccgaagattcgtgcaatgcagatcatcgatgagctggagccgacccgacgtgggctgtactgcggctcgctgatgtacctggacgtgcgcggcgagatggacagttccatcgcgattcgcagcttgttggtgaaggacgggcaggtgtgttgctggggcggcggcgggatcgtggcggactcgcagtgggaggcggaatatcaggagtcgctgaccaaagtgcgggtgttgttacaaaccctggaaagcttgtagcgcctcgcgctgcctggctttcgaacgttgaagccgcggtcagaaaaagcctgaatcagaacggtcgtggacggagtaccggctggacgatagcgtccggctgaccgcccaccgccgactgtgaaggatcacatgaatcgactgccaactcgtcagaaatcatttccgcgattgcatatccatcgagccgcacctaatatctcccaaactgggaggtggcagcaatgcggataatcgcgctctccaccttacgaatattctgggaaagccatcccgcttattgcgatgcaaaaacgccgctggtcgagctgtatcgacatatggaaaagaccacgtattcaacgccgcaagcactcaaagcagcgctcggaacagcgagcattctcaaaggcggcagggttgtattcaacgtgggcagcaacaagtatcgagtgatcatggcgatcgattatcagcgacagctggggttcatacgtttcgtgggaacccacgcgcactacgaccagatcaacgcggagaccgtgtaatgaacatcaaacctattcattcccaggaagacctgactgcggcgctcgcacgcgtcgagcagctgtggggcgcggaggttggctcaccagaaggtgacgagctggaaatcctcgccgtacttattgagaagtatgaggcggaacattatccaatgccgccttcggacccggtggaagcgattaaatttcgcatggagcagttaggcatgaccgcccgtgaccttgagccgtttataggcacgagcgggcgggtttctgaagtgctgaatcacaagcgcaagctgagcctggcgatgatcaagcgcctgcatgaagggttgagtattccttatgagcggttgctggctggggcttgacgggaaaatggcagtggcggtactggccctatcgcaggcaagccagctcccacagattgaacggtgtgaacccgatcgaatgtgggagctggcttgcctgcgatggggccatcagcagcgctgagaaacttacaggctcaacgaccgattcgacgccttgatgaactcttttttcaagtcctcaaaggtatgcaccgccgggaactgcgggaactcgcggatcacattctccggcgcatggaacagaatcccccggtcagcttcaccgagcatggtggtgtcgttgtaggagtcgccggcggcgatcacgcggtagtagagggttttgaacgccagcaccgattggcgcttggggtctttctggcgcagctgatagctcaccacgcggtcattttcgtcggtaatcagacggtggcagagcaaggtcgggaagcccagctggcgcatcagcggttgggaaaactcgtagaaggtgtctgacaggatcaccacctggaaacgctcgcgcagccagttgacgaactcgacggcgccgtccagtggcttgagggtggcgatcacttcctggatgtcggcaagcttgagcccgtgctcatcgaggatgcgcaggcgctgcttcatcagcacgtcgtagtcgggaatgtcgcgggtggtggcccgcagggattcaataccggttttttcggcgaaggcgatccagatttccggaaccagcaccccttccaggtcgagacaggcaatttccacaagacactcccattagatgttgttagttgagcgagcaaaaggactgccgaactctagcgactcaagctggccgccgcaacgcagggcggatttgataccatcgcttccctatagagcgctcagcgccactgacctgtaggaaccgtcctgatgaaccaagccttcgacgtcgttgaactcgccacgacttatgccaacaaatccgctcaggacattctcaagctggcgttcagccagttcggtgatgacctgtggatttccttcagcggtgccgaggacgtggtgctggtcgacatggcctggaagctgaacaagaacgtcaaggtgttcagcctcgacaccggccgcctgcacccggagacctaccggtttatcgagcaggtgcgcgagttctacaagatcgacatcgaactgatctcgccggaccagagcaagctggagcccttcgtcaagcaaaagggcctgttcagtttctacaaggacggccatggcgaatgctgcggcgtgcgcaagatcgaaccgctgcgtcgcaagctgtccggcgtaagtgcctgggccaccggccaacgccgtgaccagagccccggcacccgcagccaggtggcggcgttggaaatcgatacggcgttctccacgccggaacgcaccctgtacaaattcaacccgctggcgcaaatgaccagcgaggaagtctggggctacatccgcatgctcgagctgccgtacaacagcctgcatgagcgtgggtttatcagcatcggctgcgagccgtgcacccggcctgtgttgccgaaccagcatgagcgtgaaggtcgctggtggtgggaggaagccacgcagaaggaatgtgggctgcatgctgggaatatcatcagcaaggcctgagggctaacgcggtaaaaatgtgggagcgggcttgcccgcgattgcggtggatcagttacctaataagtcgactgacatgccgccttcgcgggcaagcccgctcccacattttgttttgcgcgccccataaaaatgtacacatcaatgtaaccataagtgccatttatgtgtgcaatccgtagtctcccgcaccaaaacgtaacacccatttgcgcacactgttcgtcgctttaacagagcgccgccccaccaaaaaacaaatacctgttcaaacggtcaatttatattgctttaaattcagctagttattttagtaatcagtaaaaacgaaattacccagattttttatagatcgaaaactggcacgcatgtggcttaaggtgaattacgctttgtatacaataaatacaaaacctacatacactttgccatctgcaacgctcgtgcagatgcgccggagcctgccggaatgcgtacaagcctctcgaataacatcgcactggatctgccctcctccgccctgagccccgaggcgccaagccccggcccgctggtactcagttcgcgcctgcataacagagacctggcgcccaccaaggtcgaaggccgacgttggggccgctacagcatctttgcgctgtggaccaatgacgtgcacaacatcgccaactattcatttgccatcggcttgtatgcgctgggacttggcggctggcagattttgatgtcgttgggcatcggcgcggcgctggtgtacttcttcatgaacttgtcggggtttatgggccagaagaccggcgtgcccttcccggttatcagccgcatcagtttcggcatccatggtgcgcagattccggcgttgattcgcgcggtgatagcgattgcctggtttgggatccagacctacctggcctcagtggttttccgcgtgctgctgtccgcgattcatccaggctttgccgactatgaccacaactcaatcctcggcctgtcgaccctgggctgggcgtgtttcgtggcgatatggtttgtgcaactggtgatcctggcgtacggcatggaaatggtgcgccgctatgaagcattcgccgggccggtgatcctggtgacggtggcttcgctggccggctggatgtacttccaggttggcggcaatattgcctggtcgattcgcgagccgctgagtggcggtgagatgtggcgcaatatctttgccggcggcgcgctgtggttgaccatctacggcacgctgatccttaatttctgcgacttcgctcgctcctcgccctgccgcaagaccatcctggtcggcaacttctggggcctgccggtgaacatcctggtgtttgccgcgattaccgtgctgctgtgcggcgggcaattccagctcaatggccgggtgatcgaaagcccgaccgaaatcatcgcggccatccccaataccttcttcctcgtgctgggctgcctggcgttcctgatcgtcaccgtggccgtgaacatcatggccaacttcgtcgcccccgcgtttgtgctgagtaacctggcgcccaagtacctgaactttcgccgcgccggattgataagcgccaccctggcggtgctgatcctgccgtggaacctctacaacagcccgctggtgattgtgtatttcctctccggcctgggcgcactgctggggccgctgtacggggtgatcatggtcgattactggctgattcgtaaaagccaggtggatgtcctgcagctgtatagcgaagaccccaatggcgtttattactacagccgtggggtcaatttgcgcgcggtcgcggcgtttattcctgcggcggtgatcgcgattctattggcgctgctgcccggctttgccagcgtcgcaccgttttcctggctgtttggcgccggtattgcagggctgttgtacctgttgatcgccaagcgtcagccgttctacgccgatatcagcggcgaaagcattgcagtcgataacgtcagtcactaaccaaggacattccatgcgtatcctcgtggtcaacgtcaacaccaccgaatccatcaccgaaaccatcgcccaacaggcgcgcgccgtggccgcgccaggcaccgagatcgtcgggctcaccccgtactttggcgccgagtcggtggagggcaactttgagagctacctggcggccattgcggtgatggaccgagtgatggcttacgaccagccgtttgatgcggtgatccaggccggttatggcgagcatggccgtgaaggcttgcaggaattgttgaacgtgccggtagtggacattaccgaagcggcagccagcacggcgatgtttttgggccatgcctattcggtggtgaccacgctggaccgtaccgtgccgttgatcgaagaccggttgaaacttgctggcctttatcagcgctgtgcctcggtgcgcgccagtggcatggccgtgctggagctggaagaggatccgctggccgccatggaagcgatcgtgcgccaggcggaactggccattcgcgaggacaaggccgaggtgatctgcctcggctgcggcggcatggccgggctggatgagcagattcgccagcgtacgggtgtgccggtggtggatggggtgacggcggcggtgactgttgctgagtcgctggtgcggctggggttgtcgacgtcgaagatcaggacttatgcgacgccgcggccgaagaaggttattggctggcccggccggtagaccgaggcgcctgcatcgcgggcaagcccggctcccacagtagatcgcattttcctgtagaggctggattcaggctcaaaatgcattttcctgtggggctggattctggctcaaaatgcattttcctgtggggctggattctggctcaaaatgcatttccctgtgggagctggcttgcctgcgatggccgcgcctcggtttacagccatgcctgaaccgcgctgaatcgctggccccaccgctgctcggcaaactgctcgatgatgaagtccacaaacgcccgggttttgccgggcagcagtttgtgttcggcgtagtagatagagatgttgccatcgtcgacgtaccactcgggcaacacccgcaccaccgcgccgctgtcgagaaacggcaacgccatcggcatgctcaccagcgcaatacccaggccttgggcgctggcgcaacaggcggcttcggagtcgctcatggtcatgccgggcttgagcaccaacgggcgttgctcacgctccgggccggtaagctgccaggagcgcacgcggccggtttgcggagagcggatcaggatgcccaggcaccgcgataaatcttcgggcgcctgcaccggcaggcgtcgcgccagataatccggcgcagccaccagcacccggtgcgccggcgtcagcttgcgcgccaccacccccggcggcagctcaaaaccaccgccaatagccgcatcgaagccctggccgatcaagtcgacctggcggttatcgaaatgccagtccgggctgatatccggaaagcgccgcataaactcccccagcagcggcaccacataacgattgccgaacaccgtgcccatgctgaccttgagcgtgcccaccggccgcccttcggcgctggcaaggttggccacggcgttctggatggtggtgaggctaccgctgacttcatcgaggaatagcttgccggcctcggtcagggtcaagcggcgggtgctgcgctggaacagccgcacacccaggcgcgcttccagcttggcgacacttttacctaccgccgccggggtcaggctgaggtgccgggctgcctcggcgaagctgccgccttcggcgctgcgtacaaagcattcgatactgccaaagctttccatatcgccccactctaaacttttggtttacacagactatagcaatcacggtctaccgggctggcggggtgaggtcgatactcgactcatcaactacttggagatcgacatgaccacacacaacctcactggcaaagttgctttgattcaaggcggttcccgcggtattggggctgccatcgtcaagcgcctggccgcagaaggcgctgccgtcgccttcacctacgtcagctcggcggcaaaagccgaagaattgcaaaacagcgtgatcgacgcaggcggcaaagccttggccattcaagccgacagcgcggatgccacggcgattcgcaatgcggtcaacgccaccgtcgaagcctttgggcgcctggatatcctggtgaacaacgccggtgtattggctatcgcgccgctggaagatttcaagctggaagattttgaccagaccttggcgatcaatgtgcgcagcgtgtttatcgccacccaggaagcggcaaaacatatgggtaaaggcggccgtgtgatcaacatcggcagcaccaatgccgagcgcatgccgttcggtggtggtgggccgtatgcgatgagcaaggcggcactggtggggttgaccaagggtttggcgcgggacctggggccgcgcggcatcacgataaacaacgtgcaacctgggccggtggacactgacatgaacccggcgaacagtgaatttgccgagacgttgattgggttgatggcggtggggcgttatgggcaggtggaggagattgcgagttttgtggcgtacctggcggggcctgaggctgggtatatcaccggtgcaagcttgaccattgatggtggtttcagcgcctaagggttctggagaacagcaaaacccactgtgggagctggcttgcctgcgatggcgctcttgaggacgctatcgcaggcaagccagctcctaccttttttgtcgctgtttattcaggggaaagggggtaggccgtaggcggccaggtcgaagtctgcgagtttgcggatgatttggtcggcgtgcgcgtacttgctgtcggccatggcttcatccggcacggcgatggcggtcatgtgggcggccttcgcggcggttacgccgaacggcgaatcttcgaataccaggcagtcctctggcgccacgcccaggcggcgggcagcggtgaggaagatgtccggcgcaggcttggcggcaccgacttccgggtcatcagccgtcacgatggtgccgaacaggctaaaccattcgcggtgcaaggtggtcttgtggccaaacgaattgcgcgacgaactggtgcccaccgcgattggaatgttatgcgccttcaagtgccgcaccaacgcttcggcaccgggcatgccgagggccttggggaaacgctcgctcatcagcggttcgcggatctccagaaattcagccggcgtaatcggcaagtccagtgccttgaccagatactcggccaggtcctgggccccacggccgatgatgtgctgcttgacgccccagtcataggtgcggccgtaacgttcggcgatgatctgcgtgacttcggtgtagatgccttcggtgtccagcaacaagccgtccatatcgaaaatcacggccttgattggaccgactgcagtacgcggtgcattcatcacaacagaaccttgggagaaggactaaaaggattcagcacaatagcggcccaggttgcctgcaagcaacctttgcggctcggtattgataaccacactgatcaactacgccaaggcagtggtgggcaaacatgcgcgtcgtaacgtttgcgaagtaaggcttacatgcagcaacagcttcgatcagttggcctcgggagacaggctaaggttggaaggcacccggcttagtgtattggcaaaaaaaggccctaaaaacttgttaaagccttatcaaaacataagccttaaataaggcttaagcaggaaaaacatgatcagtgcgtccccccacatacaagtcatcaatgacctggaaggcaagcctgcgtttgtggtgatcccttacgggcaatacctcgcacagcaaggccgaaaccaccttattccgtatcaagtcgtcagcctgattatcgatggggtcagccccatccgcgcctggcgcgagcacctgaacttgacccaggtagaagtcgccaaccgcctgggaatttcacaatccgctttcgcccaacaagaagcggtgaacaaacctcgccgggcaacgcgggaaaagatagccaaggcgtttggcattaaggccactcaactggagctatagcgttactcaggaaaatccgcgccctcatttacctcagccacacgttaaaatcagctggaacacctcggcgcctgaaagccggccaaccttaaaagcgaacccacccatgctctatcgcatcgccgccgacagcctggtgctgtttcacctgtgtttcatcctgttcgtgctgttcggtgggctgctggcgctcaaatggcggccggtgatgtggctgcacctgcccgctgcagcctggggtgtggccgtggaagtgttccacctgccctgcccgctgacccgctgggaaaacctgctgcgccacctcgccgggcaggacggttatggcggtgggtttatcgagcattacatcctcacgctgatttacccggccgggctgaccccaaacattcaattggtgctcggggcgctggtgttgctgatcaacatcgcagtgtatgtgcgcttgatcagacgggcgtaggcaggcagcccaggtcggccaatgtggcttccaccgcctgttccagcggcgtgtgcggttcccgccccagcgtcgcaaccagtcgcctgttatcgagtaacagcggtgtttgccacaggtaacgcatctcctgcatctcgcggatggtgacgacaaagggcgccatcaatttcatcaaccaccacgggaagcgacctacgcgtggttgatggcccgtcctacgcaataccacgcgctggatcgcctgggtcatctgcctgccatcggtgtccacgtgccccgccatatgaaagcgcgcgaacgcatcaaggctagcccgccgctcaatcaactcaagcagagtgcgcgccacatccggcaggtaggcccattgatgtgccacaccgggaacgcccggataactcacggcgctcaccggcttgccgggcttgaccagcccttgggcaaaccagttattagccacccgagcaccgaaaaagtccccggcccgcacgatcaacacccgcgcgccctggcgggaagcctgctccaaacgctgctccagctgcacgcggatcgcgcctttgcgggtttgcgggtgctgcggcgagtcttcgtgcaaaacgggaaaggcgtccggcccgaagttgtagaccgtaccgggcaacacgatggtcgcgccctcgacgatggccgccgcaatgctgttgtcgatcatcggcaataccagctcagcccagttgcgataacccggcgggttgaccgcatgcacgatcaccgcgcagccacgggcagcagcgagcacgtcttgacgattgagcgcgtcgcccttaagccaggacaaggtcgagttctcacgccgggccttgtccacatcccgggtcaacgcacagacttcccagcccgacgcgctcatctgccgcgccacttcgccaccaatcccgcccgttgcacccaataccagaaccttgcccatgaccttctcctaaatatgttggtgaaaccattttgtgggcggcatcgctatagataaattgccgaagagcatccagccgctatacatttatgcatggcaacgaatattggttgggagctttaccggtcattcctcggcgtactcaaggaaggctcgttgtcgggagccgcacgccagctcggcatcacacagcccacggtcggccggcacattgctgcactggaaacggcgctgggcgtggtgctgttcacccgctcgcctaccgggcttttgcccactgccgtcgcccatacgttgcgcgcccacgccgaaaccatggaacgcaccgccgccgctctcgaacgcgcggcgtcctcacagggcgatgaagtgcgcggcgtggtgcgggtctccgccagtgaagtggtcggcgtggaggtgttgccgccgatcatcaccgaactgcgacgccagcacccgcacctgcgcgttgaattgatcctgaccaaccgcctgatcgacctgctgcaactggaagccgacatcgccgtgcgcatggtgcgccccagccaggagcaactgctggcgcgacgcgtgggcttgatcgaagtgggcctgcatgcccgcgatgactacctgcaagcacacggcactccacttcaaatgcaggacttggtcagccactcagtgatcggcttcgaccaggaaaacgcgtttatccgcagcctggccatcaagggctttgaacgcagcgcctttgccatcagcagcgacagcgacttggcgcaattggcgctgatccgcgccggtgccggtatcggcggctgccaggtgcaactggccaagcaggacccacgcctgcggcgggtgctgcctgaaggtttcgcgttcaagatggacacctgggtgaccatgcacgaagacctgcgcaacagcccgcgctgccgggtgacctttgatgcgctggtcgcgggtttgcagcgttacgtacaggcttgagacagcttcactggtaaagaatcagtctccctcattccgttcgtagacgcccccatgtccgaagccttcgaagtccccagcccccacgaaaaacacatcgaacacaccaccgaacatgcccacggccgcggtgacaatttcgccagccgcatcgcagtgatgaccgcgctgatggccaccctcggcgccatgctcagctaccaggccggttccaccgaaagcgaagcggcgatggacaaaaacaacgccgccatcatcaagaccgaagccgccaaccagtggaactactaccaggccaagtccagccgccagaacctggcggaactggccacgcacattcccggcgtggatgccgcgcattacaaggatgagatcgagcgctacaaaggccagaaggaagaggtgcgcaagcaggccgaaaagcttgaggccacctccaaggaatgggatcaaaaatccgaggaagccctgcaccagcaccaccgctgggcccaggcgatgaccgcgattcagatcgcgatttcgttggcggcgattacgttgctcacgcgcaaggaatggctcaaacgcatgtcctacaccgccggcggcgtagccgtagtactgggcaccctggcctggctacacctctaacaaactgaacacgattaaaaatgtaggagctggcttgccttcgatggcggtggttcaagcagcactaatgtctgctctgccaccgctatcgcaggcaagccagctcccacctttaatctccactgttttcaggattgggctctgccgtcacatcgctatatagtaaaacgcacaacgccgttccacccgaggacatcccggtaaccgcacaacccaaagaagtccgagctgtaccgctacgccgagaaacaggccatgggctggcgactcaacctcgacatcaagggccaccgcatggcgatttcgagcactgcccgaatgccgggctgtggattctggaaatccagattgcccaccggagccagccctgcggcgctttttacgaagacttactcgcttaaggaatacctatggaacactccacccaatttcctgtgctgctgttttcctacggcaccttgcaggacaaggccgtgcaactggccaacttcggccgagagttagtcgggcagcacgacgccatgctcggctattcgcaaagctgggtagaaatcaccgacccggaagtactggccaccagcggcaagacccaccacccgatcgtcgcgccaaccgaggaaaaggctgccagcgttgaaggcatggtctttcagatcaacgagcaggaactggcagcggcggatgcctatgaagtgtcggactacaaacgcgtgtccgtggcgctggcttcgggactgactgcgtgggtgtacgtgcaggcgtaatccgacctgacgtcgtatcatgggccacctctggaggacggcccatgaacctcagcatcctttacgcactcgccgctgccgccctcttcggcgccagcaccccgctcgccaaaagcctcggcctgggcctctcgcccgtactgctcgccggcctgctttacctcggcagcggcgtcggcttagcctgcgtacgccttatccgtgatcgcggctggaaacctaccgggctcaccccgtctgaatggccctggctgatcggcgccatcgccttcggcggcatcctcgggccggttgcgctgatgttcggcctgacccgcaccgctggcgcgaccgcctccctgatgctcaaccttgaatcggtgctgaccgccgtcatcgcctggctggtgtttagagagaatgcagaccgacgcatcgtcctcgggatgctcgcaatcgtattgggcggcgtagtgctgtcgtggtccgacggtggcggcaccagctacgactggacagggccgcttgccgtggcgctggcctgtttgtgctgggggattgataacaacctgacacgcaaagtgtcggcgtcggacgcgctgtttatcgccggtgccaaagggttgattgccggattagtcaattgcagtttggcgctgtacctcggcgcgcagatacccggcgtggctcaactggcgccgatcttgttggtggggtttctgggatatggcatcagcctggtcatgtttgtgctggcgctgcgcgggctgggcagtgcgcgcaccggcgcctacttctccacggcgccctttctcggcgcggccgtggccttgctggcgttcggggagtcagtgaccgtgacgttctggattgcttcagcgctgatggccgtgggcgtgtggctgcacctgacggagcggcatgcgcatgagcatctgcatgaagcgactgaacatgggcatcggcatgtgcatgatgagcatcatcagcatgagcatgggtttgagtgggacccggcgcagccgcatagtcatgtgcatgtgcacggcgtgatgcggcatagccatgcgcattttccggatgtgcatcatcggcataggcattgaatggtgggcgttggagggttgtgagacgagatcaagtgcgctcgtcagactacttccccaacagccgaaacaacgtaaccagcgatagctcgagttctttaccccacgttaagcccaagccccactcatcgactttaacttggctgaatttctccaaatcccggagaggaataagaactgcgaaagaatttatgtgattgaagagataaacggtatcccgcttaccgtcattccattcgatttcaagggcgtgcttgctatcaatggtccgcactgcagagatgcaaagcttcctggtcatgaacctgcccctttctagaaatctattcgggcacaatcgcattttccaaccccacaaatcacggttccaagcatcacaagaacaaatttgggcaacgtcctacattctgaacggaagcgactgtctcccgtttcaaaatctccacgcctatagttgccaagtcgctctgatgagcggccgggtttggcgactcgacggcaagacggaaggtaaacgacgttatttcccggcgactgccgtttttggcagtgctctaagaaacagggtcgttgtttttatttttgtcttaatggagtcacgcatgaaccaatacatggccctcaccagcaacgacagcgccacccccgccctttttatcgataccaccgtgccgttggaaatactcctagacgccgctagctatcggcttcaagctgttactcaagtcatggagaaccttgcactacgtagtgaaataagtagtgatgcagttgtgctcagcgactttgccctgctctgctcaatcccgttgcgcgacggctgcgatctgctggatgtcatagcgcggcggatggacatgccgcgcatatgatctaagaacgctccgttttcaaacgccacaacccccaggtctctgccgaaacctgggggttttgtttgtctcgtatttgacgccacgtccctcgctttagaattcaatggctcgcctatacacttcgctgcaatggaacctgcgggattcccctcgactcagccctgactcaaacaacaagaccttataaaaatgaaaatagtgttcatcgctacgctgggattgttatcgctcatccaaccccccctgtccttcgctgaaaacaccaatgggaaaaacctgttcttacagcgatgcgccatgtgtcacggagcagatatcaagggaacaggaccattagcgaacaagagcaacccgccgacacctaacctcacaacacctgctttcaagaagcgactcaatgaatatccgggcgttatcgtatcgtcggtcatactccgccccaatggagacttgattccaagaacgttgcgagagaatggtgtgaaagtaccgccgcacgcttggacgattaatgatctgcgcgacttaaatcgatacatggtgggtgtgatttcaaaaaacaaataatgctggcagagttgctgaagtgctcatcgcggattcgcaagcatgttttctttggtttctccgtcgatgctgctgcggagcaactcaaatagcggcacggtatctgttatcccagacgcaataggattgtggatgcttccccggcgggcacatcaattcggaatcgccggtggcgttcccatgaatgttcccatatcgccttttttcagacgccaaaaaccacaaacccccggctttctctaggaaaaccgggggtttgtgtttacttaatgtggcggtgaaggagagattcgaactctcgatacaatttcttgtatacacactttccaggcgtgctccttaagccactcggacacttcaccgtatctcgtcaaaccagttcagtctgtcgaggcgcgctaatgtagtcgaaagcctttctgatggcaaaggtttttttcagaattttcatgcggttagacggttatgccgttgcccgcccggcaaggggcggtgattgtgccattctcgggcattggcggtgtgtgtttgggatggccgccacgccctgcttcgggccgtctacccgtggggatgcgggaaaagtctgactgggtagtcagtcacggcgctttaccggggcgggcgtggtgggtaacgtctgcgcatgcgcttctataaacagcctatctataacaattcctacaaggaaccgcgtcatgagtgagttgattgcctaccacctcgaagacggtatcgcgaccctgaccttgagcaacggcaaagtgaatgctatttctccggcggtggtcagtgagtttaatgcggcactggatcaggccgtgaaggatcgggcagtggtgatcatcaccggcacgccggggattctgtcgggtggttatgatttgaaggtgatgacggccgggcctaaagaggcgatcagcctggtaacgtcgggctcgacgttggcgcgtcgcctgttgtcgcacccgttcccggtgattgtggcgtgccctgggcatgcggtggccaagggcgcgttcctgctgttgtcggcggattatcggattggcgtagaaggcccgttcagcattggcctgaatgaagtggcaatcggtatgaccatgcaccacgccggtatcgagttggcgcgggaccgtctgcgcaagtcggcgtttcatcgttcggttatcaacgccgagatgtttgacccgcagggcgccttgggcgctggcttcctcgataaggtggtagcaccggaggagctgcacgcggcagcgctggaagcggcgcgtcagttgaagaagatcaacatgaacgcccacaagcacaccaagctgaaggtgcgtaaggcactgctggaagccttggatgatgcaatcattcaggaccagggccacaacctgggttgatgccttacaagttgccgttctagagcccgaccttgagtcgggctttttcttacaaaccaatccgaaatatcctaaaccgctctagccgggcgatatcggcacacgctgaaacatgtgcttaaacatcgcctatctcctacgtctgtaggggcaattgccgaatacagtgcacatccgtacactgcgccaccttttgtcccgatgggccgtgtcgatgctttttctgttacgtatgttgttgatgggcctgcactttatgctcgccggtgtgctgggcgtgctgctgggtatttgtcggccgttcaacccggacaacagccgcctgtgtgctcgcctctatggggtgcctgcgatgtggctgttgcgcctgaaggtaaaggcggatgtcgactcgctgcgcaagcccggcacgtgcgtgatcatcgcgaaccaccagtccaactacgacctgttcgtgctgggcactgtggtgccgcatcgcacggtgtgtatcgccaagaaaagcctgaaatgggtgccgctgttcggccagttgttctggctggcgggcaatgtgctgatcgaccgtggcaacgcgcacaaagcgcgccgcgcgatgctcaccactacccacacgttgcaacacgaagacacctcgatctgggtgttcccggaaggcacgcgcaacctgggcaaagggctgctgccgttcaagaaaggcgcgtttcatatggcaattgcggccggcgtgccgatcgtgcaggtgtgcgtgagtaattacgtcacgcacatgcagcttaatcgctggaacagtggtgatgtgctcatacgttcgctgccgccgattcctactgaggggctgacttcggatgacatcccgcagttaatgcaggcgtgccagaagcagatggatgaatgcattgcagagatggaccgcgaactgcaaagcgccgtaacaatcgaactcgcttcccgctaagctgcccaacacctgtcctcctaataagaagcgatcagcaccatgggtagagttgttgcggcggccgtatacagcgccggtaaaaaagtcactgatatcaccctcgacgaaggcgcagcctgggccgccaaacccgaccactttgtgtggatcggcctggaagagcccaacgcccacgagctggccaacctgcagcgccagttcaacctgcatgaattggccatcgaagacgccctggaaaagcacagccgcccgaagctggaaaccttcggcgatgcgctgtttatcgtcacctattcaccggtgcgcgagaacggcaagctggagtttatcgaaacccacattttcgccggcaacggctacatcatcaccgctcgcaacgggcattcggcgtcctacggctatgtgcgccaacgctgtgaggcgcggccgttattgctcgagcatggggaagatttcgtactctatgcgttgctggatttcgtcaccgaaaattaccagccggtgagcgaagcgatccacgccgagatagatgagctggagcgcaacgtgctgtgcagttcgctgagcgaacgcgatatccagaacctccacggcctgcgtcgcgatgtgctgcggcttaagcgctacgtggcgccgatggtggagatcagccaggaattgcagaagctgagcttcccatttatcgacaagaacatgcgcccctacttccgtgatgtgcagattcacgtgacgcggcagatggaagacctcaccaccctgcgcgatatcgccagccagaccatcgagatcggcgtgctgctggaggcttcgcgccaaagcgtggtgcagcgcaagttcgccgcctgggcggcgatcctggcgttccccacggcggtggcggggatttatgggatgaactttcagaacatgcccgagctgcaatggcactacggctattttgcggtgctcgggtttattgcggtgggctgcaccagtttgtgggccagcttcaagcgttcgggttggctttaagccgctgcctctggcttgtgtgcgacaaagcgcatcatccattccgccacggtgacgccgtggtggtcgcgctcaaggcttgcgacgccgttggtgtagaccttttcgcccagagttgtctgaagaatctccagcagctcgcgggaatagtcgtggatgaattccgggtggccctggaaacacagcacttggtcgccgatgtggtacgcggcgaacgggcaaaaagcgctggaggcgatgacggtggcgttttccggcaaggtggtcacttggtcctggtggctgatcagtagcgtcaactcttccacttccgggctcatccacggcgcttttgcgtcgagcttatagtcgtggatgcccatgccccaaccctggccggcgcgttcggtcttgccgcccagcagcagtgccaacagttggtggccgaagcagatgccgagcaacttgtcgccgcgctcatagcgctggagcaggtaggttttgagggtctggatccacgggtcggtgccaaaggaatcggccttgctgccggtgacgaggtaggcgtcaaacacttcatcatccgacgggtattcgccctgcaccacgttgtagaccacgaattcggcggcaatcggttgcttggagaacaggcgcttgaacatctgcccgtacccttggtactgatcgatcaaacctggacgcaggatatcggtttccaggatacagacgcgtagcgacataaaaaatacctgacacggtgatgggaataatgcacaccccagagcctgccttgaaatgtacctgcaaagcaagtcccgccaggtgactcactgtgggagcaggcttgcctgcgatggcgtcatatcagccggcaaaggtcttggctgatacaccgctatcgcgggcaagcccgctcccacatgggttttctgtgattcgggatagggtgtttcggtcaggcgaatatgtctcctcgtgccgctttctcaagcaacaacgccggtggcgagaaccgttccccatactgctccgccaggtagcgcgcccgggcgatgaagtcgttcaggccgtactggttgataaactgcagcgcgccgccactccacgcggcgaagccgatgccgaagatcgaaccgacgttggcgtcagccgtggacatcaacacgccctcctccacacaccgcacggtttcgatggcctggataaacagcaaacggtcgcgcacatcctgtggcgaaatctgtttgtcgggctgttcaaagcgcgctttcagctcgggccacaggtgtttctgcccacctgccgggtagtcgtaaaaaccgccgcctgccgccttgcccgtgcgtttgtactcgttcaccaacaggtcgatcacctgcgtcgccggatgcgtcggcagcgccttgccttccgcctgcaggtctttcgccgtttgctgtcggatatggctcatcaagctgagcgacacttcatccgacaccgccaatggccccactggcatgccggctttgcgtgcttcggtttcgatcatcggcgcagccacgccttcgccgagcatggcaatgccttcgttagtaaacgtgccgaacacccgcgaggtaaagaagccgcgactgtcgttgaccacgatcggggttttcttgatttgcagtacgaaatcaaaacctcgggccagggtttcgtcgctggtgtgagtgcccttgatgatttccaccagcggcatcttgtcgaccgggctgaagaaatgcaggccgatgaatttgccttgatcgggcacggcgttggccaggccactgatgggcaaggtcgaggtgttggaggcgatgacggcgtctgcaccgaccacattttgcgcagcggcagagacgttggccttgaggtcacgatcttcaaaaaccgcctcgatgatcaggtcgcagccagccaggtcggcatcagcggtcgtaggatgaatccgcgccaaggtggtttcccgctgttcggcggtcaattgcccacggctgaccttcttgtccagcagcgcagcggaatgggccttgcccttttcggcagcggccaagttgacgtctttgagtaccacgtcgatgcccgcacacgcgctgacgtaggcaatacccgcgcccatcatccccgcgccgagcacgccgaccttgcgcgtgacatacggcgcaaagccttgtggccgcgagctgccggcgttgatctctttgagctgaaaccagaaggtgccgatcatgtttttcgccacctgcccggtgacaagctcggtgaagtaacgggtttcgatcaggtgcgcagtgtcgaaatccacctgggcaccttccacggcggcgcagaggattttctccggcgccgggaagcagccttgggttttgctgcgcaacatcgacggcgcaatcgccagcatttgcgccactttcgggtgggaaggcgtgccgccaggaatctgatagcccttggtgtcccaaggctgcctggcttcaggattggcaagaatccaggcgcgagacttggccagcagctcctcgcgactagccgccagctcattgatcaaccctgcttgcagcgcctgttgcggccgcacttttttgccctccagcaaatacggcaaggccttttccagccccagcatacgcaccatgcgcacgactccgccgccgcccggcaacaagcccaaggtgacttcaggcaagccgagttgcaccgacttgtcgtccagcgcgacacggtaatggcacgccaggcaaatctcccagccgccgccgagtgccgcgccattgatggcggccaccaccggtttgccgagggtttccaggcgccgcagttgggccttcaacaccctcacgccgtcgtagaaatccttggcgtgggccttatcgactttgatcagttcgttgaggtcaccgccagcgaaaaaagtcttctttgccgaggtgataactacaccggcgatgtggtccttttccgtttccaggcgtgcgacggcggccgccatggcctcgcggtacacgccgttcatggtgttggcgctctggccgggcatgtcgagggtcagcaccacgatctggtcctggcctttttcgtaacgaatggcttcggtcatgtcaggttccttgggctcagaggcgttcgatgatggtggcgatgcccatgccaccgccgacacacaaggtggccaggccgtagcgttgctggcgcacttccagttcgtcgagcagggtgccgaggatcgcgcagcccgtggcgcccagcgggtggcccatggcgatggaaccgccgttgacgttgacccgcgcagcatcgatgcccatgtctttgatgaacttgaggacgacagacgcaaacgcttcgttgacttcaaacaggtcgatgtcttccacgcgtaaaccggccttggccagcgctttgcgcgttgccggagccgggccggtgagcatgatggtcgggtcggtgctggtgacagccgtggcgacgatgcgcgcccgcggttgcaggcctaactcgcggcctttggcttcagagccgatcaacatcagcgccgcaccgtcaacgatgccggagctgttgcccggtgtgtgcacgtggttgatgcgctccacgtggctgtagacacgcaacgccgtggcgtcaaagcccatttggcccatcatttcgaagctgggcttgagcttgcccaggccttcgagggtggagtcaccgcggataaattcgtcgtggtccagcagcacaatgccgttctggtccttcaccgcgatcagcgacttgttaaaggaaccgtctgcgcgtgccctcgccgctttctgttgtgagtgcagggcgaaggcatcgacgtcctggcgcgtgaagccttccagggtcgcgatcaagtccgcgccgatgccctggggtgtgaagtggctgtgcatattggtctgcgggtcgagcacccaggcgccgccatcgctgcccatgggcacccgcgacatggattcaacaccgccgaccaccaccaggtcttcgaagccggagcgcactttcatcgcgccgaggttcaccgcttccaggcctgaggcgcagaagcggttgatttgtacgccggcgacgctgacgtcccagtccgccaccagcgcggcggtcttggcgatgtcggcgccctggtcgcccaccggggtgacacagccgaggacgatgtcatccacctggcgtgtatcgaggtcgctgcgttgtgccagcgcagtgagcaggccggccaccagatttaccggcttgacgctgtgcagggcgccgtcggctttgccctttcccctgggcgtgcgtatcgcatcaaagatcaaagcttgggtcatgacttcctcgaacgctgtgcgtgtgtgcccctaccttaggcccgattgacacggtttcaatgacggatgcgctcattgcttttgacccccacgctcggacgaacggtagggtgctatgggaaacgccgggttaatcgttttagctgtctagccaaggcattggcgccaagatggcgataggcctcatgcctttttaagtagaaataatgattagctgatatgaaatggatctaagccacgaagaacgagggctctaaggttcaatcagtaagaagttgctgccgggttttgctggggcaactgtaagaaaagcgacacgtcacgttgcgatactgaaaaaaacggcacgcatttgacgctcaggaataacaacaaaaggcagtcagccatgttcaaacataccaaagtacgtcaggcgggacttattctgttcgccaccacattgattctgatcttgcccaacttgaccaaggtaattgggtgacgacgcgaccctcacattctgtgcactcattgcaccaggactgcagcttttggcagcacctgccgggacattgcgtatagcggtcctgttgcaggggctgtctttttgcgtgcgaatttccggtatcgtgggcgccatcgccacttcgaaccgggctccctcttgaaatcgatccttgccttcctcgccttgctgttgaccttgccggcaacggctgcgcagttgaccatcgagttggataacagcagcaagacctggcaaaccgccgacctgctcaagcacccggctgtgcagacggtacaggtcgtcgatgacgtgtcctacaagcgcaatatgacgtatcgcgcggttccgctggcctctctcctacctggcttgaagcctgaaaatcacctgcaagcggttgcccttgatgggttcgccgccgagctggcggccgcgccactgctggaaaaacacggtgcacgcgcctggctggcggtggaagacccggcccatccgtggcccgcgctggcagagggcaagccgagcgccgggccgttctatctggtatggaccgaccctcaggcagggaacatcagcccggagcagtggccgttccagatgtccgggatcaagcaattgaagacggtagccgaacgctttccggcgctgttgccggacccgacattagccgcgaatgacccggtcaaccagggcttcgcgctgtttcagaagaactgcctggcctgtcaccgcttgaatggcgccggcgatgcgcaggtggggccggacctgaatattccctacaaccccaccgagtatttcagcggggatttcctcaagcgttatatccgtgatccgcaaagcctgcggcattggccacaggcgaagatgccggcgttcgctgccagtgtgttgccggacggcgagctggacctgctggtggggtatttgaagcatatggcggggtgtaagcagcagccttgaaacttgccgggctgttgtggcgagcgggcttgccccgcgttgggccgcgcagcggccccagtaaaaaacaacgcggtgtgtcagagactcctcggtgtgtggttttagggccgcttcgcagcccaacgcggggcaagcccgctcgccacaaaaagccagcgcccacatttgatcggctccacgcggaagtttattgctgctgcaccaaaatcaccggcgtaggcgccacaaacactttggcgtgcatctgctcatgcccaccgcctcggcgcatgccgcgtaccgggcaggcgtcgaggtaatccaggcctacggccaacttcaaatgccgctccggccgggccaattggttggtcacatcgaagctgtaccaggcgtcatccagccaggcctcggcccaggcatggctggccaggtgcgtgctgtcctccgagtacaaataccccgatacataccgcgccggaatccccaggctgcgcgcgcacgccaggaacgcatgcgtatggtcctggcacacccccgcacgcccggcgaaggccttggcggcgcaggtgtcgacttcagtggcaccgggcgtgtagaccatcgactggttgagcgcgtgcatcaggtcgatcaatgcagtgcggtcacggcgtagatggcagtgctgctcggcaaagccacgcagggcctcgtcaggttcggtcaggcgcgtgctgcgcaggaacggaaacgccgactgactctcgtgttcggcctcgcgcaattcgtcgatatccacttggccgcgcgcgccgatgatgatggcgtcgtggggctcgtcgagtgtcagcacatgcaggatgttgccaaacgggtcgacctgggcgcgcaccggccggggcaaatccagctgccaactgagcacgtgctggcgctcgctgtcgtggggtgtgaggcgcaggtattggatgctggcgcgtacctggtcttcgtagtggtaggtggtttcgtggctgatggagagtctcatgcggcctccaggtaggaactgtagatggcgtcgcccaactggcgaaccaaggggataaagtcggtcagccaggcgtgcaggccttcctcgaggatttcgtcaatcgcagtaaagcgcaggcgcgcgtccatctcggcggccaggcgctgggccgggcgaccgttgaggcctggcaggctggcgaggatctggtcgatctcttcgctgcaggcgcgcagcgaacgcggcacgtcggcacgcaacagcagcaactccgcgacttgccgagcgccgggggcgtcgcggtagatctcggtgtaggcctcgaacgacgacaatgcgcgcaacaaggcgctccactgataataggcgtgggccgtgccgtcactgacggcggcagcctggtcgccggccatttcgtagcgcgcatcgagcaggcgcagggtgttgtcggcacgctcgataaacgtgcccaggcgaataaaacggaacgcatcgttgcgcatgatggtgccgtaggtggcaccgcgaaacaggtgcgaacgctccttgacccattcacagaaccggctcatgccgtagcggctgagcccctgctgggcaatatcgcgaatatccagccaggtggcgttgatgttttcccacatgtcggcggtgattcgcccacgcaccgcatgggcgctggcccgcgcggagccaaggcaactgtagatgctggccgggttggccgcgtccagcgcgaagaagtgcagcaggcgctcggcgtgcagttcgccgtggcgctcgtggtaatcatcgagggtgccggtgatcagcagcggcatcgccaactcatgcaggccatcgccgcgtccgtcctggggcatcagcgacagcgagtagctgacatccagcatgcgcgcgaggttttccgcgcgttccaggtagcgcgacatccagtacaaatccgaggcagttctactcaacatggcatcagtcctccaccacccatgtgtctttggtgccgccgccctgggacgagttgaccaccagcgagccttcacgcaaggccacgcgggtcaagccgccgggcaccacacgggtttccttgccggacaacacaaacggccgcaggtcgatatggcgcggcgcaatgccgttttcgacgaaggtcgggcaggtggataaacacagcgtcggttgcgcgatgtaggcgtggggcttggccttgatgcgggcgcgaaaggcttcgatttcggctttggtggacgccgggcccaccagcatgccgtagccgccggagccctgggtttccttgaccaccagctcgggcaggttggccaacacgtgggacagctcgtcaggcttgcggcattgaaacgtaggcacgttcttcaggatcggctcttcatccaggtaaaaacggatcatctcggtgacgaatgggtacaccgacttgtcatccgccaccccggtgccaatcgcattggccagcaccacattgccggagcgatacgccgcgagcaggccgggcacgccgagcatggagtccgggttgaaggccagcgggtcgaggtacgcgtcgtcgaggcggcggtagatcacatcaacagccttggggccgtcggtggtgcgcatgaatacgcggtcgtcgcgcacgaacaggtcggcgccttccaccagttccacgcccatttcgcgagcgagaaacgcatgctcgaagaacgcactgttgaagcgcccaggtgtgagcaccaccacgctggggttatccagcgggctagagcttttcaaggtgtcaagcagcaggttggggtaatggtcgatgggtgctatgcgctgggcggcgaacagctcggggaacaggcgcatcatcatcttgcggtcttcgagcatgtagctgacgccgctcggcgtgcgcaggttgtcttccagcacgtagtaagtgccgtcaccatcgcgtacgaggtcgaccccggagatgtgggaatacagatcgcggtgcaggttcaggccctgcatggccagttggtactgctcgttggccagcacttgttcggcggggataatcccggccttgatgatgcgctgctcgtgatacaggtcggcaagaaagatgttcagcgccttgacccgttggatgcagccgcgctcgacgatccgccattcactcgccggaatgctgcgcgggatggtgtcaaaggggatcaggcgctcggtgccctgctcgtccccataaagggtgaaggtgatcccggcgcggtggaacagcaaatcggcctcacgccggcgctgagccagcagctcggccggcgtgtcggccaaccagcgggcgaactcgcggtaatgggggcggaccagccctgccccgtcgtacatttcatcgtaataagtgcggatcatgccgtactccttgtcacccgggcgctagaaccatcgcaaggcccgtgccagcggcataaacacttaaaaatcagtgagttgaataaaccccggaatccagccgcaccgtcctggtgcgcagaatgcccggcgtcatgtcccgcgcttcatcacaatgcgggctttgactatcaacagcatagtcagagttgatttcactgcccgcctgcccctgcggataatcactcccatctgctgaacaggatgcgtcctacagcttcagcgaaccgatcttccctttaggccaccctctttgggtggcttttttttggtgcagaaacctgcagcgcaagttccgcgaatatttctggcgcacaaacaaaatcggccgacccaaagggtcagccgatacgctgtgttgctcataacgtgccgctacatgggtaacccacgcacctcctgcttgacgccccatccctcgatgatcccgcccaaaggctcgaccaccgcttcaaagtcttgctcgaagtctcctatgccgtcgtaggttgcgaacatgattttgctcagttccaagtaccaggcgccatcatcgcgcgcgctgacctgggcattcagggattccccacgaaatcgacccgcagccctgcgcgcccgttcctcatccgggaaaatggcgtagaactcaatggggtgaaaacgtgagaagtcaaaaccgccttctttcatgcggcgcagtacgttggtgctgatgtcttcttgataggctgtgctcatgaaacgtcctcctcaaactgatggatagactttccgtgctccccgaagaccgcgccctgctggcgcgggtgctacggcattaacgtcaccgcgggaaaacaagcatgtagctgacaagaccagaccttagcgattcattcgctgatctcacttgcagagtagcgcgaagctatcacctccaccagaggcgcttgaatgacatacagggaatgttcaggcggcgggcgagatgtcgaggatttgaatgctgttctggtctttgagaatcttgaccgtaggctcgggtttacggccctcaaggtcattgaggtcgagctcggcagccacgggcacgagcttgttacgaatcatgtgtgccgcatcttcgaggctgggcttgtgatcgcaggtgaactgctcgacggactgtacgccgtgatcatcaacgaaggtaatttgccacgtttgcatcggtgcctcctcgataaaacccgtgtgtgggcttacaactatctggaccttgagggctcggcaaacgttccactcaggtcaggaggcacccgattaactgcgattatttttcagcgtgttctttcaacgctttcaaggtgttgaacggcgcgtccaccacgaacttgttggccagccacgacggcacgctgccacctggctcggtgtgcacttggtaggtcacttcggtctggttgtcgcctttgggcaccagcttccaatagccatctacctgggccacgcgcacgtagcctttgacttccggctggtaggtcggcacttccagcagtttacgggtcacggtgccgtcagccgccttggacgtggtgatctcaaggatcgagtcgcggtcggtcacagggaacggtgccttgaactgggtgtaggtccagctcttgtcaccttcggtcttgagcagtttttgcgatttgcattcatggatccaggagcaggcaccggccacgtcttcctgcagggcctggatcttggcgaccggcgccttgatcacggtcacaccgcgatacgccttgtacttggagccggcaatttcgctcagggacaccttgataccgtcttcgtccttggcgacttgccaatcctcagcctgtgcagtggcagcaaacaacactgtaaaaccgcacaacacagccattcgtttcagcgaacccatcgttgtattccttattgttgaagttctgatagtaaagcccatcaagctgccgtcatctgctcccaccaaccgatcaaccggatcgcatcggcctggtcggtgccacagacatccggatccgccttgaaatcactgcacaccgctgggcgttccggttggccaaacagctggcatagctgttcgaccgacaggtgcaggcagcgttcgcccgccggtttgccgttaggcatgcccggtaatggcgaactgatggagggggcgatgcagcatgcgccacagccttcacggcatttcatgaccagcaggtcctcgacggctcaattgggacggccgggctagagtacgcccttaaacagccgttttaaaatggtctaactggggtttttcgcagaaaacaaaagtgactgaccagtctgcgacagatggtcggtgggcaacgtcacctttgcggaaaaatttattgcttgaattcgaaatccagcgcggcgccttccacgtcacggcgctcatcgttgcgcagttgcagcttcatctcattgctgagcaggcgaccgttgatctggaacgcactgttgtcggcgggcttttcaccaaacatcggcggcaacaaaggcacgctcttgggtttgggcatggtgccgatgggctgcaagtgcctgaccatttccgacggcagggacaagtccaactgtgccgatggcagtttggtttgggccacttcatgggcggatttggatttgctcgcaatcggtgcgcgctttttaacgctggcggctttcttcttggtcgccgtggcttttttagccggggccggctttttcgcggcagttttctgcgaggcattggcggcgggcttgttttcagccacaggggctgccgccagcaccgtgccaacattgcacaggcttaacaggccaatcaccacagcagcgcgaaaaatagaggtcatatcgccaacagcattaacggcagagggccatatgctcgcttgttgtgcgcggcctgacaagcctggtgattagccagctaccgttactgtcccctttagacccctcaaccgacgctataaaagtccggctgcggttccctgacacagctggctggccagcattcccaacgtcatcagcgcccgctctgcctcgcggttccacggcgtaccgcaattgaggcgaatacagtggttgaactgttccgtattactgaaaattacccccggcgcgatgctgatgccctgctgcaatgcgcgtacgtgcagttcctgggtattgacccgtccgggcaaactgacccacaagatgaagccgccggtcgggcgagtcatctgcgtgccttccgggaagtattgctgcaccgccaattggaaggcgctgagattcttgcggtattcctggcggatgtaacgcaaatggcggtcgtaaccgccgttttccaggtaggccgcaacccccatctgggtcacgctgcaggccgagtgggtgctgaacatctgcagccgctggatttcctgctggtatttaccggcgatcatccagccgatgcgtacaccgggagacagggtcttggaaaagctcgagcagtagatcacccggtcgaggcggtcgtaggctttcagggccttggtgcggcccagttcgaacatcagctcgccgtagatatcgtcctcgacgatctggatatcgaaatccgaggccaggcgcagcaactgtttctggcgctcctcgggcatggttgcgcccaacggattgctcaaacgcgtggtcagcaccaaggccttgatcgaccattggttggccgccagttgcagggcctcaaggctcatgccggtggacgggtcgctggggatctcgatgactttgaggcccagcaggtcagccagttgcagcaagccgtaataggtcggtgattcggcggcgatcaaatcgcctgggcgggtcagcacgcgcagcgacatctgcaacgcatcgacacagccgtgggtgatcaccacttcggaggggtccactaccacgccggcatcgcgcatgcgaatcgccacctggcggcgcagcggctcaaaaccggggctgaacatgtaactgaatgcccgtgggctctggaagcgcgtgaccttggccagttgctggtgcagcgcacgtaccggcaggtaatccacactcggcacggcggcgcccaacgggaatacgccttcgcggcgtgactcgaccaatacctgctggatgatgctgctgcgggtgaccaaccccggccgctcgacccgcgcgatgtccggcgtcggcgccgtcagcgccggcgtctggtgcacgtagtaacccgactgcggccgcgcccggatcagcccctggtcttccaggttggcgtaggcctgcaacacggtcgcgtggctgacgttgagctgggagctcatcttgcgcaccgaaggcacacgctcgccgggttgatagacaccacgacggatgtcttcagccagttgctgggcgatacgttggtagagcaacagattggtcatgacgcagcactcgatttcacgggtattttatttttgtgtgaaacataccggcacagtttagaagtgtacggggacagttgcgagaatagtcgagcgcgggcggcagtgatagaaaaaactgtgagggtgtagaacatgaaaacccgatcagtgatcgggtttgctttgggtgggagctggcctgagttgggtcttagcgggcggcgcctagctggcccttgtcgtcggagaacacaatttccacccggcggttctgcgcgcggccacgttccgaggcgttggcttccaccgggtactggtcgccatagccttcgacctggatacgtttttcgtcgatgcccaaatccatcagcacatcggccaccgattgcgcacggtcgcgggacagtttgaggttttcctgctcgccaccggtgttgtcggtgtagccctcgatgcgcacaacgcgcttggggttcagttgcaggaactgcacaattttcagcactgtgcgattggccgagttttgcaactgcgcctcacctgtgtcgaacagcacatcgcccagggtcatcaccaggccgcgatcggtctgggtggtggtcaggctggcgatttgctcttcgagccacttgccctgttgctgcacgctggccagtttgttttcgcgcagggccaattgcaggcgttggcgctccagttcgagcttggtgccgcgctcggcgttgagcccctgctcggtatgttcgcgggcgatcgcgctgtaacgctggctcaggtaggcgtaatggaccacgtcggcgccgctgccccagtagctcgacaagcgatcggcacgggccagggactcaccggcgcgaatcacatccttgggcgcgaagcgcagcacattggcgtcttccttgaccttctggaagtcggtgccggcctgttgcaacgcttgctcgctgttcggctggctcgcgcaaccgcccaaggcggcgctgcccagcagcaacacacagctcaaaccacggatcatcgggctcattgggcttctcccaactgcaattgcttacgcaggcgggtgatgcgcgtgttcagcacgttgagttgctcctggctcttgcgggtcagaattttggcttcggcgaggcgcgcgtccagttcggcctgttcggcgcgcatgcgcgcgtgtttgtaggattcgtcggccatgtcggccttggccctggcgaacttgtcttcggccagtttcagctctggcgaatcgtcggcgctggcacccacggcgctggcttgctccaacgcttgctgggtgaggcgtatttgttcattcggcgcaggatcggctgcacatcccgccaaagcgacaacggcgagggccgcgaaaagaggtcgaatagtcactgtaaatccttactttgctggggtgccgacgggttgctgcaattgcgctttccaacgctcgaggttgcgctgcatcgctgcttgcaccacaccggacgcgggcaattctgtcatctttttggcgagctgtccgcgcagccacggatcgttgcaggcggagttgtgggaaatcgccaggtacaagccgggctgatcaatcggcacgtcgcgcgcaatcaggtcgttgctcatgcccagggtctgggccatggccatgccggaatatcgcccggcgagcacgtagtccacttccccgagcagcagtttctggaaggccggcgtcaacgtaggcaagcgttgcaggctgagctgctgggcggcgaaggtgtcgaagtcggcactcaggcgtgcgcgttcggagaccgcgcccttatggccgtgcaagtcggcggcggtggcgtagaccaacggcgaatccttgcgggtccagaccaggtagtcgatttgcgtcaacgccgggtggatgtagtcgagggtttccaactcgcccaggttcagcggcgcatcggcgagaatgtccatgcgcccgctgcgcacctcatccagggccaaggaacgtttgccgccgtagagcaggtcaattttaagccccagctccttgcccacttgttgcaacacgtcggcggtggcgccgatcaggtgcgtggggtcttgtgggtcgcgccataacaacggtggtgcgtccgggctgccggtgatcaccaggcgctcacatttgccggcagccagcgccaggcttggcagcagcgacaaggccaacactacgtgacgcaaatccatggcagtttctccaggttaaaaaggtgcgcaaaaaaaaagcccggtccaaagaccgggctctttataagtgaagcggctggattagaccagcttctccaactcaggtacggcttcgaacaagtccgcaaccaggccgtaatcagccacctggaagatcggtgcttcttcgtccttgttgatcgcgacgatcactttggagtctttcataccggccaagtgctggatcgcgccggagataccgacggcgatgtacagctgtggcgcaacgattttgccggtctggccgacctgcatgtcgttgggtacgaaacctgcatcgacggccgcgcgagaagcgccgaccgcagcgcccagcttgtcggccagggcgtacaggtgcttgaagttgtcaccgttctgcatgccacggccgccggaaacgacgatcttggcagcggtcagttcaggacgatccgacttggccagctcttcgccgacaaagctggaagtgccagcgtcgtgggcagcggagacggcttcaacggcagccgaaccaccttcggcggcgaccgggtcgaaaccggtggcgcgtacggtgatgacttttaccgaagcgttggactgtacggtcgcgatggcgttaccggcatagatcgggcgcttgaaggtgtcagcgctttcaaccgagatgatctcggagatctggtcaacatccagctgcgcggcaacgcgaggcaggatgtttttgccgttggaagtggcggcagccaggatgtggctgtagcccttgcccagttcagcaaccagcggcgcgacgttttccggcagctgatgcgcgtaagcggcattgtcagcgttcaggactttgctcacgccagcgattttcgcggcggcttcagccacggcgccagcgccttgaccggctaccagtacgtgaatgtcgccaccgattttagcggcggcggccacggtgttcagcgtggccggggccagcactttgttgtcgtgttcagcgattaccaagatagtcatttttagattaccttcgcttcgtttttcagtttctcgaccagttcagccaccgacttgaccttgatgcccgcgctgcgtgcagccggtgcttcaaccttgacggtcttgttggtggaggcggtggaaacgcccaaagcgtctggagtcaccgactcaagcggcttcttcttggctttcatgatgtttggcagggacgcataacgcggctcgttcaaacgcaggtcggtggtaacgatggccggcagtttcagcgaaactgtttgcgcgccgccgtcgatttcacgggtaacagcaacgctgtcgccgctgacttcgactttggaggcgaaggtgccctggccgtaaccggtcagtgcagccagcatctggccagtctggttgttgtcgctgtcgatggcctgtttgccgaggatcaccagctgaggctgttccttgtcgacaacggctttgagcagcttggccacggccagggaggtcagctcttcagcggattcaaccaggatggcgcggtcggcgcccagtgccagggcggtacgcagctgctcttgagcagtggcagggccgatggaaaccaccacgatttcagtcgccacgcctttctctttcaggcgtacggcttcttccacagcgatttcgcagaaagggttcatcgacatcttgacgttagcgaggtcgacgccggaattgtccgccttgacgcgaactttcacgttgtaatcgacaacgcgtttgacagctacaagaaccttcatggattcctcgttactctccggtgaaaagaaagtcgcctaggcgaacctggcggttgatgctcatcggcacacaagggcacctccaaaaacctcggcgagtgactcggcgatggggaagtgacgaccgttcgtcagtggtgactgagaggtcattctttatcgcagcgtgtaaactgcgcgccatcgtttgggcgcgcgtcacctgtcttgcttttggacgtgctcttgaaacctgcagtctgcctacggtaagcgcaaaaccgaccgtatattgaccggaacgcctattctggtcaatacggcaaaatagccagtcataagccgcgcctctttgatttacctagcctgcgggcaattcaaacaaacgtttgtattggacgctgccagtggtgtagatataatgcgccacctagagagaaaggtgggtcatggctgctgcgaatgcggtgatgacagacacgacaccgaacctccacccattagaaaaaaagcctgttgagccttgagtaggagatagcctgtggaacgcgaatacatggaattcgacgtggtcatcgtcggcgctggcccggcaggcctgtctgccgcctgccgactgaagcagaaggccgccgaagccggtaaagaaatcagcgtctgcgtggtcgagaaaggctccgaagtcggcgcacatatcctctccggtgccgtgtttgaaccccgcgccctgaacgaactgttcccggactggaaagcactcggcgccccgctcaacacccctgtggtgcgcgatgacatctatgtactgcgcagccccgaagcctccaccaaggtgcctgacttctttgtgcccaagaccatgcacaacgaaggcaactacatcatttccctgggcaacctgtgccgctggctggcccaacaggccgagaacctgggtgtggaagtctacccaggcttcgccgcccaggaagcgctgttcgacgaaaacggcgtggtgcgcgggatcatcaccggcgacctcggcgtcgaccgtgaaggcaacccgaaagaaggcgtgtacacccccggcatggaactgcgtggcaagtacacgctgttcgccgaaggttgccgtggccacatcggcaagcaactgatccagcgtttcaacctggacagcgacgccgacgcccagcactacggcatcggcctgaaagaaatctgggaaattgacccggccaagcatcaaccaggcctggtggtgcacaccgccggttggccgctggacatcatgagcaccgaaaacaccggcggctcgttcctctatcacctggaaaacaaccaggtggttgtcggcctgatcgtcgacctgtcctacagcaacaccttcctgtcgccgttcgatgagttccagcgcctcaagcatcacccggtgctggctcaatacctggaaggcggcaagcgcgtcagctacggcgcgcgtgccctggccaaaggcggcatcaactcgctgccgaagatggtcttcaaaggcggcgccttgatcggctgcgacctgggcaccatgaacgtggccaagatcaagggcagccacaccgcgatgaagtccggcatgctcgctgccgacgccgtagccgaacgcctgttcgccgactccgaaggcggcgacgaactgaccaactacgtcgacggtttcaaagccagctggctctacgaagagctgttcgccagccgcaacttcggcccggcgatgcacaagttcggcccgatcctcggcgccggcttcaactggttcgaccagaacatcctcggcggcaaaatgccgttcaccttgcacgacaccaagccggattacgcctgcctgaagctcgccaaggacagcaagaaaatcgattacccaaaacccgacggcaagctgagcttcgacaagctgagttcggtgttcatctccggcaccaaccacgaagaagaacagccgtgccacttgaagctcaaggacccaagcatcccgatcggcaccaacctgccgctctacgatgaaccggcgcagcgctactgcccggccggcgtctatgaagtgatcaccaaggaagacggcgagaagcgcttccagatcaacgcccagaactgcgtgcactgcaagacctgtgacatcaaggacccttcgcagaacatcacttgggtgaccccggaaggtgcgggtgggccgacttacccgaatatgtaagccagctgcttgaacaaaaaaggctcccaactgggagccttttttatgcccgacacagatcaactgtgggagctggcttgcctgcgatggcggagtatcagtcaaccaatctttagctgacccaccgctatcgcaggcaagccagctcccacatcgagcgaggtgtggtcaggcagcccgctcttcaccggggctgcgctcaaaatagcgcttatattcgcgactgaactgcgacgtactctgataccccacactgtgcgccgcctgcgccacgcccatgccttccaccagcagcaactgctgggccttgagcaagcgcaaccgcttcaaatactgcaccggcgacaacaacgtgcaacgcttgaaatgctcatgaaacgtcgatgcactcatgtgcgcataacccgccaaggtctcgatattcagcggctcggcgtaatgggcatgcaggtggttcaacgacgtggcgatacgtgaaaactgcccctgctgctcgaccagtgcgcgcagcacatcggcctgcggcccgcgcaaggcggtgaacaacacttccctgacccgcgccgcgcccatgatccggctttccagcggatcgtgcaggcactgcaacagccgttcgacactgccgcgcatcgcgtcatcgagcatcaccgaactcatcgactccagggtctgcgccgtcggcggcggcccggcctgcatgcccatggccatgaccaattcacccagcaccacgcgatcaatccccaccgtcaccccgtacagcggcgcctcgggggccatggcgaacgtctcgcactcgaacggcaccggcatcgcctgaatcaggtaatgcccggcgccatactccagcgtccgtgggcccaggtaggcgaccttgctgccctgggccacgaacatcaggcttggctcgtagatctgcgggccgcgtgccacatcgcaactggcgcgcaacacctgcacgcccggcaggtgggtcggggagaaaccgtcgcagggcgtaaggccctcaatcaaggctaccagcttggcattggcgtcgagatggcgagtcaacaacatggcaaaaaacttcgcaaaaaggggatgagaacatcatcgcaggtctgagggcacatggatccaaacaaggggcactcccggacgaataggcatgagactcggagcaatcgccatggccgcatccgggcccggcgcggagaatgcgccgcctccctagttattcctgttgcgaggtttcctcatgtataccgccatcggttatgccgcccagtcgcccaccactcccctcgcccccatgtccttcgaacgccgcagcccgcgcgccgatgacgtggccatcgagattctctactgcggcgtgtgccactccgacatccaccaggcacgcaacgagtggggcattgccgtgtacccgctgatgccgggccacgagattgtcggcaaagtcaccgccgtcggcgccagcgtcaccgcgcacaaagtcggcgacctggtcggcgtaggctgcatggtcgattcgtgccgccactgcgacgcctgccacgcagacctggagcaatactgcctcgaaggcccgaccatgacctacgccaccccggaccgggttgacggcagcaacaccatgggcggctactccgacagcatcgtggtcagcgaacacttcgtggtgaagatcccggccaagctcgacctggccagcgccgcgccgatcctgtgcgccggcatcaccacctactcgccgctcaagcactacggcgtaaaggctggcgacaaagtgggcgtgctgggcatgggcggcctgggccatatgggcatcaagtttgccaaggcgatgggcgcagaagtcacgctgttcacccgctcggcgagcaaagctgaagaaggccgtcgccagggcgccgatcacgtgatcgtgtccaccgacgccgagcagatgaaagccgcagccggcagtttcgacttcctgctggacaccattccggtgcagcacgacctgaacccctacctcgacgtactgcgctttgacggcgtgcacattctggtcggcctgatcgagccggtggatccgccggtgaatgcagccaagctggtgctggggcgtaaagtgctggccggttcgttgatcggcggtatagccgaaacccaggaagtcctggatttctgcgccgagcacaacatcacctgcgacatcgaaatgctcgacatccgccagatcaacgaggcttacgcccgcatgatcgccggtgatgtgaagtaccgctttgtcatcgacatggcgaccttgaaggcctgacgctgatcgttcccacgctctgcgtgggaacgcaggctgtgacgctctgcgtcaccattgtggacgcggagcgtccggggcggcattcccacgcggagcgtgggaacgatcaaaggcctgatcaggccttcgcgcccaactccgctgacagccgcgctgcgacctgtttgatcacagggatcagctcggccattttttccagcggcatgtagggcacggtactggcgatgctgatgccggcgacgattcgccggctggcatcgcgcaccggtgccgccacacaacggatcgacggttcgttgtcttccagatcaaacgcataaccgcccgccacgtattcgcgcatgcgctgctcgaactgtgcccaggattgctccgggtgctgcggccattgctggctcttgccaccaaccggcaggctggcttcatacaggcgctgccactcctgcaccgaatcatccagcagcattgccttacccacaccggtacgcgccaacggcatgcgatggccgacgcgcgagcgcatttccgggccgttgcggccagggttcttgtgcaggtaaagcacgtcgtcgtattcacgaatggccaggtggatggtgtcgccggtcagcgccgacagttcatccaggtacgggatggccaaggtcaccatcggcaactcttcacgggcctggaaacccaattcgatcagcttgggccccagcagataaccgacttgcggcaccacacgcaggtaacgctcctccaccaggcaactggccaggcggtgggtggtgctgcgggtggtgccgatgcgcttggcgatctctttcaagtcgcgcgcaccggccgccaccgcttgcaccacgcccaggccacgcaacagggtctgggtgccagtgggcgcggcgtctttaacgggggtgtgggcgttttcctgcatatcgggcctattggggaagtacgaaaacggcgccattatggcaaaagcagcccgcctgaacagaggagatccactgtgggagctggcttgcctgcgatgagggagtgtcagccaatcaatgtgtaagctgacacaccgctatcgcaggcaagccagctcccacattttgacctttacagggtcagactttaacgctgcttcatacggtcgataatcaccgccagcaacaggatcgaaccgcgaatcacgtactgataaaaggtgtcgatgttcttcaggttcatcgcgttctcgatgatcgccaaaatcagcacaccggcaatcacgtgccgaatcatgccgatgccgccgctcagcgatacaccgcccagcacgcaggcggaaatcaccgtcagctcaaagccctgcccaatcatcggttggcccgaggtcatgcgcgaggcgaggattacaccggccaaggcgccgatcagaccgtgcacggcaaagatgatgatcttggtgcgatcaacgttcaccccggccagcaacgccgcttcctggttaccgccgatggccatggtgttgcgcccgtaggtggtgtaattgagcaaccagccaaagaacacaaagcacagcacggtgatgatgatcggcaccggcacgcccatcaactggccgttaccgaacacaaagaagcgctcatccatcaccccgacggccttgccgttggagaagatgtaggccaggccacgcacgatctgcatggtcgccagcgtcgcgatcaacgcgttgatgcgcagcttggcgatgacgatgccgttgatcagccccaccaccaggcccatggccaacgccgccgacacgccgagcaccacgctgtcggtatcgcgaatcacaatccccgccaccacgccggcacaggcaatcaccgagcccaccgacaggtcgaagtgccccgacgccaggcagaacaacatggtgcacgcggcaatgcccaccgtggaaatcgccaggccgaggccacgcatgttcagcggcgagaggaagttatcgataaacaacgcgctgagcacaaagatgctcaacgcggcgagcagcattacccaatcatccagaaatttgcgttggttgaaacctggccagaagccttttgcagtctttacctgggacatcattcacctcgaattcttcaagcccgcgtacgcggaagtgccagttgcaatagctgtgcttcgtccgcttgatcgcggttcaactcgccggtcagcacgccttcactcatcaccaggatgcggtcggagatgcccatcacttccatcaggtcgctggacaccacgatcaccgcaatgccgctggccgccaggttgtggatgatctggtagatctccgacttggcgccgatgtcgatgccgcgcgtcggttcatcgagcagcaacaccttcatcggcatcgacagccagcggccaagaatggccttctgctggttgccgccggacaggtacatgattttctggtcggcgttcggcgttttgactttcatcgccttgatttgctggtcggcgttgcccttctcccacccctcacgcaagagccagccaaacgtggaatgggcgccgcgtgcgctgatattgatgttctcggcgacgctggagagcggaatgatgccttcctttttacggtcttccgggcacagcaatacacccgccgcgatggcatcgcggggtgagcgcagttgcaggttttcacccccgagttgcagttgccccgcagtggaacgcgtcagcccgctcagcagccgaaacaactcggtacgccccgcgccgaccaacccgaacaggccaagaatctcgcccttgtgcacctgcaggttgaccgcttcacgcaagcccgggcccagcaagccctcaaccttgagcgccacttcgccgcgctcacgcgggcgatagtcgtagatgtcctgaatgtcgcggccgaccatgcaagtcactagctggtcgtgggtcagcgtggccatgtcgtcaaaggtgcgcacaaagcggccgtccttgaaaaccgtcaccgcatcgcagatacggaacacctcttccatgcggtgcgacacgtagagcaccactttgccttcgtcacgcaggcgcgtgatgatcgccatcaagcggtcgatttctcgcgccgagaggctgctggtgggttcgtcgaaggcaatgacatgggcaccacgggacagcgccttggcgatttccaccagttggcgctggcccagcgacaaccgcccgagtttttcctgcgggtcgatttcatcggccaggcctttgagacacgccagcgcctgcttgcgcagttggccgccattgaccacgccgaagcgcgacggcaagtgcccgaggaacaggttctcggccacggtcatttccggcaccaggtgcagctcctggtggatcaccgcgacgccgctggcaatgctgtcggcggcggatttgaagtccatggtctgctcgccgatctgcaccgtgccgctgctcggaatgtaggcgccgccgaggattttcagcagcgtcgacttgcccgcgccgttctcgcccatcagcgcgtgtaccgaatgcggccgcgcttcaaagctgatctgcgccaaggccttgaccccgggaaaatccttgccgatgccgttgaaccgcagggccgcgccggtcatttccacagaccgattttgctcaactcttccttgaagttggcgcgggtgattagggtcacgttgtccaatgcggtgaacttggcaggttccgtgcctttggtcacccactcgaacattgccgtggcggttttgtagcccgaggcgtcagggctcagcagcatcgagccatagaaaccggtgtcggacttcttaagctcttcgatggcgtcggtgccgttgatgcccacgccgatcacgttggcggccttgaagcccgcgctttcggtggcgcgcacgccgcccaatacggtgctgtcgttcatgccgccgatgatcaggtttttcgcggtgcccggcagtttcaccagcgccgagttggtggcatccatgctgcccggcacgtcgagggttttctgcgcgctgaacaggatgtggtcagcaggcaagccggcagccttgaggccttctaccgaaccgtcggtgcgtttcttgccggtttccagctcgtcaaaggtgttgatgacggcgtaggtttccttccagtcccagttgcgatgcttggcttcggccgccatggcttcgccttgtttctggccgattttgtaggcgtccaggccgacgtaaggcacgtcttccatgggcttgcctttggcatcgacgaaacggtcgtcgacggccagcactttcaacccattgagcttggccttggccatgatggccgggcccagggacacgtccggcgggcagatcacaaaacccttggcgccgttggctgcgagggtgtcgatggccgagagggttttctcgccgtcaggcacagcgatcttgatcacggtgaaaccctggtccttgccggctttttcagcgaaggcccattcggtctggaaccagggctcttcggcctgtttgaccaggaagccgatcttgacttcttcggcagagacgaagccgctgaaggccgcggcgagcgccagggcgccgagtgttttcttgaacatgaaccacctcgttcttgttattggaaacgtttttagtcgtggtacatcacagaccgcccgccatcgatcatcaggcaggttgcattgataaagggtgcctcatcggtggccaggaacagcgccgtcatcgctacctcgaccggctggccgatgcgcttgggcgggtgcaaatcgaaggcacgctggcgctcggcatgcgggtcggggaaaccgttccagtagtcgacgttgagctgggtttcgatataacccggcgcgatggcatttacgcggatgcccttgggcgcgtattcgatgcccagcgcgcgggtcaggccgagcaggccgtgcttggcgaccgggtagggaaagcagccggggatgatgtggctggaatgggtggaagcgatgttgatgatgttgccgatgccctgttcgatcatgtgcggcaacaccgaacggcaaccgaaccaggcaccgtcaaggtcgatggcgaagcagcggcgccagtcttcgtcgctcatttccagcgggtcgcggaacacattgaccccggcgcaattgaccagcacatccacgcggccatagcgctcgatggccaggttgaccagcgactgccattgttctttggaggtgatatcgacggcttgcgcgacaatcttggcgccacgtgcgcgccagtgggcggcaactttctcaaccttttcgccctggatatcagcgatgaccagacgggcctgctgggcctggaagcaggcgacgatcgcctcaccaatgccttgggcggcgccggtgatgatcacaactttgtttttcagccgctcgccgtaggtgggctcgggcacagcgggtaacgacaacggttggggctgcatcgcttcacctgttttatttttggtagtgagtgctgatgctgccgactataaacccatcttttgagatatctcaatatataaatttgcatcccatatattgaaacaaaaacaaaaaaatgtgggagcgggcttgctcgcgaatgcggtgcatcagtcaataaatcattagctgaacaat

SEQ ID NO: 31 - DNA, 222225 bp, Pseudomonas poae FL10F
agtattacaatcactcgcgtatcaagctgaagctaaacggcctgagccctgttgcatatagaactcaggccgttcagccataggcatgtaatcgtccagctttgtggggtcagttcagagcgtgggaacgatcagtaattcaggattggtaaaccttggcaaaaccgtcgcgaattttctgctccggtagctcgtcggcaataaatacaatcacactttcgcgcgcctcgccctcggcccattcggtgtcccaatcgaagccgtagagtttcagcacaccctggaacaccatccgctggtcttccccggcaatgttcagcacgcccttgtagcgcagcagttgcttgccgtggtcttccagcagctcgttcataaactcgctgaggcggtcgatatccagcggctggtcggtgcgcagcaccaggctggaaatgcggtcgatggacggcgcggcgctgaccgggcgcaggttcatgccggcgttgaggttgaaaccgcgcacatcgagcagctccgccaggtcgatggcgccgtggtcgaccactcgaatcggcgcgcggcggttgatgcgggtcaggcgctggctgagggcgtcgaaggtcgcttcgtcgaccaggtcgcgcttgctcaccagcaggcggtcggcaaaaccgatctgcgcttgggcgatggtttgggtcaggtggtgttcggcgtgagctgcgtctaccagtgtgatgatgccatcgaggatgtagcgctcgcgcagctcttcatcaatgaaaaaggtctgggccacgggcgcaggatccgccaggccggtgcactcgatcaccaggcggtcgaaggcgatctcgccactgtccaggcgctcaagcagcaggtacagggctttggtcaggtcggtgtggatggtgcagcacacgcaaccgttggacagggtcatgacttgcacgggctctgcgcccagcagctgggtgtcgataccggcgtcactgaattcgttttcgatcacggcgattttcaggccgtgctcggctttgagcaggtggcgcagcaaggtggttttgccggcgccgaggaagccgctgaggatggtgacggggatgggagaggacaaaaatattctccttttcagatgaaataacggaaggaacacaaaacaaatgtgggagctggcttgcctgcgatgcagacaactcggtctttcaatcagaccgaggtgatgccatcgcaggcaagccagctcccacataaagccctgcttccacagggcaattgcactaacccaaaaggcaggctagcagcacttgggcccacccttgccaccgtaacgggcttcctggcgttcccggaagaacgccttgtagtccatcaccggtttgtccgggtgtttggtttgcatatgctcgacgtacgtgtcgtagtcgggcatgccgaccatcaggcgtgcggcctgaccgaggtatttaccgaggcgactgatgtcattgaacatgcttgcaatcctcgattacgcgtccggtacagcctggaacggggcttctttatccgtacgttctttgttgccccaggcggcgacgccgaccttgagcgcatagaacaggatgctgaacaccacgaacaggaacagcgccgtgagcgttgcgttggtgtaggcgttccagatcacgtgttgcatctggtcgatgttcttggccggcgcgaggatctggccgttggccagggcatcgctgtacttcttggccagcgacaggaagccgatcgccgggttggcgtcgaacagcttgatgaagcccgccgtggtggtgcaaatcagcagccagacggccggcagcatggtcacccagatgtagcgctggcgtttcattttgatcagcacaacggtggcgagcatcagcgcgataccggccagcatctggttggagataccgaacaacggccacaaggtgttgatgccgcccagtgggtcgatcacgccttggtacagcaggtaaccccacatcgctacgcaacctgcggttgcaatcaggttggcggtccaggactcggtgcgcttgagcgacggcacgaaggagccgagcaaatcctggagcatgaagcgaccggcacgggtgccggcgtcgacggccgtcaggatgaacagcgcttcaaacaggatcgcaaagtggtaccagaacgccatggtgttttcacccggcagcacactgtgcaggatctgcgcgatacccaccgccagggtcggcgcaccgccggcacgcgccaggatggtggtttcaccgatgtcatgggccaccgccgtcaaggcttccggggtaatggcaaagccccagctgctgacggtttgtgccacagccaccacatcaccgccgaccaccgcagccgggctgttcatggcgaaatacacgcctggctcaatgaccgaagcggcaaccatggccatgatcgccacgaacgactccatcagcatcgcgccgtaaccgatgtagcgcgagttgacttcgttatccagcagcttgggcgtggtgcccgaagaaatcagtgcgtggaaacccgagaccgcgccgcaggcaatggtgatgaacaggaacgggaacaggccgcccttccacaccgggccggtgccgtcgatgaattgggtcagggccggcattttcagctctggcatggtgaccaggataccgatcgccagggcgatgatggtgccgattttgaggaaggtggagaggtagtcacgcggcgccaggatcagccacaccggcagtactgcggcaacgaaaccgtagccgatcagcatccaggtgatctggatcccggtgaaggagaaggccttggcccagaccgggtcagcagcaatctgcccgcccagccagatcgaaccaagcagcaacagcacgccgatgatcgagatttcgccgatgcggcccggacggatgtagcgcatgtacacgcccatgaacatcgcgatcggaatggtcgccatcaccgtgaagatgccccacgggctctcggccagggccttgaccacaatcagcgccagcaccgcgaggatgatgatcatgatcaggaagcagccgaacagcgcgatggtcccggggatgcgccccatttcttcgcgcaccatgtcgcccagggagcggccattgcgacgggtggacaggaacaggaccatgaagtcttgcaccgcaccggccagcaccacgccggcaatcagccacagcgtgccgggcaggtagcccatttgcgccgccagaaccgggccgaccagcgggcctgcaccggcaatcgccgcaaagtggtgaccgaaaagaatgtgtttgttggtcggcacatagtccagaccgtcattgttgagcactgcgggggtggcccgccgtggatcgagttgcatcacgttgttagcgatgaacagactgtagtaacggtacgcaaccaggtagatggccacagcagcgaccacgatccacaaggcgttgatcgcctcgccgcggcgcaaggccactacgcccagggcgcacgctcctacgattgccagcaccagccagggtaggtggcgtagcaggctattattatttttcatttttatattccagccagggtggacagaaaggacagccagtccgagtttagcgctactggccttaaaggccacccccctacattggtctagagccttgcaacagtaaaaaaagcagaaataaaagcctgatgatggcgcagggctacaatcctcctatccacagaggatttcaccatgagcgaacagccgtcttatcgccgccgttttcggcgtatcgccttcgatgcacgcacgaccattgcgcaagacggctggaattggccggtgcaattggtggacttgtcgctgaaagggttgttggtgcaaaggccggatgactggcgaggtaatcgcgccgaggcgttcgacgtggacatccgccttgacccccaggcgcatatcaagatgcaggtgaagctggcccatgatgagcatgggcagctggggtttgagtgcgagcacatcgacctggagtcgatcagccatttgcgccggctgatcgagctgaacctcggcgatgaggaagaacttgagcgcgagctcggcgcgctgctgcaggtgtaacgctttacggaaacgccgtacgtgccgggaattcgttttctgcgtcccagtagcccgccttttgactcgaggtggcttgccattggccgtcgacaaaccggtaggtttcaaagcgcgtggcgaaatcatcatcgccgtcgccgtccataaatgacgagacttgcaacaactcatccgcgccgccgtcggcgggggttgcgatctgccacgcggctttgccggtctgggccagggtcaatggctcgaccttaccgtcggcgcccgtgtagctcacgggtttgagttgctgtttggctggcagcagcagttgcgtcgcagggccgctgtaactgcccatcggcgccgtctgatcaatgctcaaaaaatacacagggtccggcagccctttgagcggggccttctcgactttggccaatgggtaaccaagctcttcgctggccagcacttcgccggacgccgacagcaagcgaacgcgggctttgagcagcgggttttcgaccagatcaccgggctcgtcaaacgagtcctcgtccaggccattgccccagctgtctttgtgcaattgagcgctgatacgctggtcttccagcacttgcagcacgctgccgtcctgggtcgccaacttctgcgccgaccggtaaccggccggcagcttggtcgactcggccaaggtgatgcccggcaaacccaccaaggccatgaacagggcaacggctgcccagcgattcgtgttgtgcattgcactcatccctgactgatccatgaattattcgaacagtgcatccaacgcctgctcaaggcgcgtgacgccaatcacctttaacccagcgggcatttcttttggcgcgttgcccttgggcacaatcgcacgcttgaagccatgtttggcggcttctttaaggcgctcctggccactcggcaccgggcgcacttcgccggacaggccgacctcaccaaacaccagcaaatcatggggcagcggcttattgcgcaggctggacatcaccgccgccatcaacgccaggtcggaggcggtttccaacaccttgaccccgccgaccacgttaaggaacacgtcctggtcgtgggtgggaatgccgccatgccggtgcaacactgccagcagcatcgccaagcggttctgatccagcccgagtgtgacccggcgcgggttggccaggtggctgtcatccaccaacgcctggacttccaccagcatcggccgggtgccttcccacgtggccatcaccacactgcccggcacttcttcctgggcacgcgtgagaaaaatcgccgatgggttggagacttctttcaggcctcggtcagtcatggcgaacacgcccaattcgttgaccgcgccgaagcggtttttcaccgcccgcagcaagcggagccgaccatcggattcgccttcgaaatacagcacggtgtcgaccatatgttcgagcactcgtggcccggccagcgcgccttctttggtcacgtggccgaccaggaagatcgccgtgccgctctgcttggcataccgcaccagcagcgccgcactctcgcgcacctgggacacgccgcccggtgccgactgcaactgctcggtgaaaattgtctggatcgagtcgatcaccatgaccttgggcttttcgatgcgggccgtggcgatgatgctttcgatgcaggtttcggtcatcacccgcagttggtcctggggcaagcccaggcgccgggcgcgcatggccacttgctgctgggattcttcgccggtgacgtacagcgccggcatgcggctggcgatgctgcacagggtttgcagcaggatggtcgatttgccgatgccggggtcaccgccgatcaacaccaccgagccgtccaccaggccgccgccgagtacgcggtccagctcgccggaggcggtggagaagcgcgggatctcttcaacgctgacttcggccagggttttgatctgcgcctgttgcccggtccagccggcacggccggtgggggccgcagcgccgccgctttcaatcatggtttccgtcagggtgttccatgcgccgcactcggtgcactggccggcccacttgggaaaggtcgcgccgcactcggtgcagccgtacatgcgcttggcctttgccatttgagaacctccaaccgaaaaaccgcgatgatagctcagcgcggtgccggggtccgaatttcaccactggccaatcgtgaagcgctgttgccgattgggtcttcggcgttgaggtcggcgcctttggcttttaattcatccagcagctcgacgcgcttgaacagcccggcgtacatggccgcggtctgcccggcgccatttcgctggtcggggttgcagtcggtggccagcaggcgctgggcgattttcagctcacccttgaagatcgcgcccatcagcgcggtgttgccgcgtttgtcctgcacacaggcgtcggcgccggcgttgagcaagcgctccacaaaagaaccctggccgtgataagccgcgaggatcagcgcggtgtagcccttgtcgtcctgggtgttgaggctgtagccggattcgatgaacgtgttgagcatgtcgatatcgccacggcgggcggcgtcgaagtagtagtcctgcaactgcgccttgagcgcgaccgggtcaggcgactcggcatgggcgacaaaagccagcatcgccattaataaaccaatcgaaatacgcatggggtgttctcctgccaggagtcgacgcccgtgcaagggcgccgaccggaacggacgtcagtcggtcagtttgtctgccagcgctttcacgcgcgccaggtcacctttagcgactttggtcacgccggtgccgtattcagggtccgccttgtagaggaacgacaggatgatgtgcttgctctcatcgtcagtcgtcgccagcgagccgccgaagttttcgaccaagtcctggcgctctttcttgctgtaggaacggtacaaatcaccggcttgcttgaagttctgctcacgctggatcttcgcttgctgagtgctgcccgacagcgccgactggctgtagcgtgcggtttgcggctcttcgcgtggcagcaggcggcttggctggtagttcacgccggtggtggttttgcctgagttcatcgcgccgtcctggttaccgttgttgacggtcacccgtggagcgttgatcggcagttgcagggcattcggccccaggcggtacatctgcgtgtcggcgtaggagaacactcggccttgcagcaggcgatcttccgacggctcgatgcccggcacgaggttggccggggccatggccacttgctcggtttcctggaagacattcgccgggttgcggttcagcaccatctggccaactttgcgttccggcacattcggccagattttggtggcgtccaatgggtcgaagtcaaactttgccaagtcctcaggtttaaggacttgcacgtacaagtcccacttggggaagtcgcctttattgatgtgggtgaccaagtcgttggtcatatggctgtagtcacgcccttgcacgtcggtgacttgtttggggtcgaggttcttgatgccttgcaggctcttccagtggaacttgacgtagtgcacttcgcccttggcgttaatcaacttgtaggcatgtacgccgttgccgtccatttcacggtaactggccggtgtgccggagtcggaatacagctcggtcagcgtgcgggtggactcgggcacatgggagaagaaatcgaaacggcgggaatcgtcgtccaggttagtgcgcgggtcgggcttgaacgcgtggaccatgtcagggaacttgatggcatcgcgaataaagaacgtcgggaagttattgccgaccaagtcccagttaccttcggcggtatagaacttggtggcaaagccgcgtgggtcgcgcagggtttccggggaatggttgccgtggaccacggcggagaagcgcacaaacaccggcgtggcctcaccggccgcaaacactttggctttggtcaggtcgctgaggttgtcggtgacggtgaaggtgccgtgggcgccggtgccacgggcgtgcaccacgcgctcggggatgcgttcacggtcaaaacgctgcaatttttgaatcagttgcacgtcttgcagcagcaccgggccgttggcaccggcggtttgcgagttctggttgtcgcccacggcggcaccgttatcgcgcgtgaggttggcggcgtgtacggagagcgaaagcaggctggcgcttgcgagcatcagcgcatgtcgcgcgagaaccgggccgcgcttcattggattgttcatcgaggtttcctctggtttttttagtgcacattcagttgtgcttgccagaggctagtgacccgcgagtcagaagataaatagaaaaaccccaccgggccgattaggaaaatacggtggtaagccactgaaatagcgagtattccgcgcgcgattggtggcactttgcaaactatttgcgatttaatgtgtcgataaaaattgacagtgttaacggttgtgtcgcgcaagccttctgcgactgacttacactgacctccacccttctcatctgtaacaaggaataacctatgggcgtgatcagtgagttcaaggccttcgcggtcaaaggcaatgtggtcgatatggccgtcggtatcatcatcggcgccgctttcggcaaaattgtttcctcgtttgtgggcgatgtggtgatgccgcctatcggtctgctgatcggtggcgtggatttcggggacttggcgataacgctcaaagccgcgcagggtgacgtgcccgccgtggtgctggcgtacggcaagttcatccagagcgtgatcgacttcgtgatcgtggcctttgcaatcttcatgggcgtgaaggcgatcaaccgcctgaagcgcgaagaggctgtggcccccagcttgccgccaacgccaagcaaggaagaagtgttactgggtgagatccgcgatctgctcaaggcacagaacgacaagccgctttaatcagctcgggcttggcaaaaaaaggcgcctattgcaggcgccttttttttacctcggcggtttaccagtagttttccactgccacctggccaggacggcggctcaggctcagttgcatgtcgcgttgcttgagcagttggcgggtgtcatcgaccatctgcgggttgccgcaaatcagtacgcgggagtgttccggggtcagttcaacgccggcagcacgctccaactcgccattctcgatgagggtggtaatacgcccattcagcgcgcccggatgcagctcacgggtcacggtaggaatgtagacgagcttgtgagcgtgctcggccaggtactcacgctcgcccagttccttgatcaacgcctgatacgccagctcctgggcctcccgagcgctgtacaccagcacaatgcgctcgaatttttcccacacctcaaagtcctgcaggatcgacaggaatggcgccacgcccgtcccggtgcccagcaaccacaaatcacgtccgtcgacaaagcggttgagggtcaggaagcccgtggcttgacgctctaccagcagcgtatcgcccacctgcaggcgactcagctcactggtgaattcaccgcccggtacaacgatggaaaagaagtcgaggtgctcgtcaaacggcgaagacacaatcgaataggcacgccatacggtgctgccatccgccttggcgacgcccaaacgcacgaattggcctgccgtaaaccgaaaacccgggtcgcgcgtagtgcgcaaggtaaacaggctgggggtcagcgattgcacgtcgagcaaggtctggcgggtaaatttctcagcactggccgtcatgaggagctccgtttaacaggtgccctagtgtccctcaaagtcgcgcggggaaacaccgctggtttgtactggcattgcgattgttcgacagtcttacaggcaggcatgaagttaggctgtccagctacttgtaacaattaaatacaaggcggctgtctagttcgaactaatcatttagctatttcctcgcttacttcatgtcattagatgacgccttgaatttaattgccatcaatttgacatcgccgacaagttgttaaaaacaatgagattttccttacagcacgtcgccccgtacaaaaataaacattctgtacacattagggaaaatgaaatgcggataacaggcaaatttttttcacacaaattacgtaggacatgtcctacactgattttcgtgccgcattgggggccaggacgtacccaagtcacactaacacccatggagagttaccaatggttaactggcgcaatacaagactccccaaactggagggtgagaacaagatcaccactgtttatgagatggtcatcaatcacacctaccagctagggtttgaatactgttctttcacaatgagctcacaacaatccaaccatcagacgaagcctatcaatttaaataactacccgaatgaatggaacacactttataaccaggcgcacttttttgatgtagaccctgtcgttgctcactgcaaacgtagcgtgctgccgattgtgtgggagcagaagacctttaacgcctcaccggatttatgggcgctggcccagtcgtttggcgtgctcttgggctggacccaggcagtgcatgacttccagggcgtgttcagcatgctgaccctgggtcgaagtaccggcaaagtcacccccgaagaactttacgagaaagccggccaggtactgtggctctgccacgcgatgcacgcagtggtagcccataaatatgccgacaaaccgggcatcacgcccccttgcaagctgacgccacgggaaacggacatcctcagatggtcagccatgggcaagactgcatcagacatcgccacgatcctgtgcctgtcagagcgtaccgtgggctttcatatcagcagttgcctcaggaaactgggcgtcaataacaagatcgccgccgtgctctgcgcctcgaaagccgggttgttttagcggctttagaaacaccgcatgtaatcccatcgaaaaaaaagtaacatttacggccaattctgagtgttgacgcagttcccgttgcggaagtcgcctcgcagttcactcagatggttgcgccggctgcccacagccgccgaacacccatcgatgacccagagcctcccccgccatgcccctgcttgacagccccttcgcccagctcgacctgattcgccagcctgagcaacacaatgatccgctgcaggccttcgacgccgccgacgagtacctgctcagctatctggccgagcagcagcccggcgctgcaacccgtgtgctggtgctcaatgacagtttcggcgccttggcggccagcctggaaggccaggtgcagctcacgtccagcggcgattcgtttctcgcagcccttggccttgagaaaaacctggtgcgcaacggcaaggcatttgacgcggtgacgtttgtgcctgccagccaggtgccagtggggacgttcgaccgcgtgctgatccgcgtgcccaaaaccctggcgctgctcgaagagcaattgatccgtctgcaagggcaattggcaccgggcgccgaagtggtcgcctcggcgatgatcaagcacttgccacgggccgcaggcgaattgctggagcgttacatcgggccgatgcacgcatctctcgcggtaaaaaaagcgcggctgctgatcgcgaccgcagaggctcgcccgaacgccgtgtcgccctaccccacccgttacagcctggacacaccgagcatcgaactgctcaaccacgccaatgtattctgccgcgaaggcctggacatcggcacccgcgccttcctcccacacttgccaaaaaatctgggcagcgcccgcgtggcggacctgggctgtggcaacggcgtattggcgatcgccagcgcgctgcaaaaccccgacgcgcagtacaccttggtggatgaatcctacatggccgtgcaatcagcactcgaaaactggcaggcggctctgggtgcgcgcgatgtgacggtgcgcgccgacgatggcctggccggccaggagccagactccctggacgtggtgctgtgcaatccgcccttccaccaacagcaggtagtgggcgatttcctcgcctggcgcatgttccagcaagcgcgatcatcactggtggttggcggcgccctctatatagtcggcaaccgtcacttgggttatcacaccaaactggcgcggttattccgtggcgtcgagcaagtcgctaccacaccgaaattcgtgatcctcaaagcgcgcaaataaaaaaaccctgccgctcttgcgagtgacagggctgaaaagccgggccgcgaggcccggattgggatgtcagtgggtcgtcaggccggccgcgttcatgaacatacgcatcaggctggcgacgacgaacagcgccagcacactgccagtccagatcatcgccaaccaccccaggcgccgccacagcggctgtttctcggcctgttcgatctcttgcaacgacggtttgccggacatgaaccaaccctcctagtgatagccgtcttcgtgggtgaccttgccgcggaacacgtagtagctccagaaggtgtagcccaggatgaacggaatgatgaacagcgtgcccaccagcatgaagccctggctctgcggcggcgcggcggcgtcccagatcgagactgacggcggaatgatgttcggccacaggctgatgcccagcccgctgtagccgaggaagatcagcaccagcgtcagcaaaaacggtgtgtagtgcgcattgcgcgccacggcgcgaatcaaaccgtacatggtcaccagcaccaggatcggcaccggcaggaaccagaacaggttcggcagggtgaaccagcgcgaagcgatttccgggtgcgccagtggcgtccacaggctgacgatgccgatcaccgccaacaccacgaaggccaatggccgcgccaggttgtgcatctgctcctgcaacttgccttcggtcttcatgatcagccaggtgcagccgagcaacgcgtatgcgatgaccaaggcaacgccgcagaacatcgtgaacggcgtgagccagtccagcgaaccaccggcaaactgacggtcgaccaccgggatgccatcgataaacgcccccagcgccacgccctggaagaacgtcgccgcaatcgagccgccgataaacgccttgtcccacaggtgacgcttgtcgtccttggccttgaagcggaactcgaaggccacgccccggaagatcagcccgatcagcatcaggatcagcggcaagtacaacgccgacaacaccaccgaataggccagcgggaacgcgccgaacagcgccgcgccgccgagtaccagccaggtttcgttaccgtcccagaccggggcgacagtgttcatcatcacgtcacggtcgacttttcccggaatgaacggaaagaggatgccgatacccaggtcaaagccgtccatgaccacgtacatcatgatgccgaagatgatgatcacggcccagatcagcggaagatcaatacccatctcaattccccttgtgctggatgtgggcgtggtcgtggtcgtcatcgctgccatcatcggcggcagacaacggacgcgccggtgtacgtttctggccagggccaccgtgggtcggctcgctgccttcgtgggtttgaggccctttgcgcaccaggcgcatcatgtagcccaaccctgcgccgaacagcgcgaagtacaccaccacgaacagcaccagcgtaatcgtcatctgcgccaggctatgcccggaagaagcatccgccgtgcgcatcagcccatagaccacccacggctggcggccgatttcggtggtgaaccaaccggcgagaatcgcgatcaggccggacgggcccatccatagcgccaggtacaggaacggcttggacgtgtacatcttgtcgccccggcgcagccagaggctgaacaggccggtgaagatcatcaggaaacccaggccgaccatgacccggaacgaccagaacacgatggtcgagttaggccggtcttcaggcggaaactccttgagcgccggcacttgtttatccagcgagtgcgtcaggatcaggctgccgaggtacggaatctcgaccgcgtatttggttttctcggccttcatgtcgggccagccgaacaggatcagcggcgtcggctcgttgccgatattttcccagtggccttcaatcgcggcgattttcgccggttggtgcttgagggtgttgaggccgtggaagtcaccgatcaccgcctggataggcgccacgatcagggccatccacatcgccatcgacagcatggtgcggatcgccgggttgtccttgccgcgcagcaagtgccaggccgccgaagagccgacgaagaacgccgtggccacaaaggccgccgtggccatgtgcatcaggcggtaggggaacgacgggttgaagatcaccgccagccagtcggtcggaatcacgcggccgtcgatgatttcaaagccctgcggcgtctgcatccagctgttggacgcgagaatccagaaggtcgagatcaacgtacccacggccaccatcaccgtggcaaagaagtgcaatttgcgcccgaccttgttccagccgaacagcatcacccccaggaacccggcctcaaggaagaaggccgtaagcacttcataggtcagcagcggcccggtcaccgcgccggcgaagtccgagaaacggctccagttggtgccgaactggtaggccatgaccaagcccgagaccacgcccatgccgaagttgacggcaaagatcttcgaccagaaatggtagaggtcacggtaggtgtcgttatgagtcttgagccacaagccttccagcaccgcaaggtaactggccaggccgatggtgatcgccgggaacaggatgtggaatgagatggtgaacgcgaattgaattcgggcgagatctagcgcctccaaaccgaacataagtcttcctctgtcaggtaataccggctgctggctgggagcctgcacccactgcccccacggatatggagtgtggcgaatttcaattcgtttctttttttaaccaaccacgcagggagtctggcctttcggccgccagaacaatcccggggcagggtttgatctggatcaagcattgatgaaagagtagtcccattttcggctgaaagccgtgtggttcattgacgcgtgacaggttgcctcagtcttgagtgaacgctgatgtagtgagggggcttgccccccgtcgcagacaactgcgctctacgctgataactcatcttgcaactatttgttacagcttgatgctaatctcggcattccctccgctcccgacctgaattcccgatgcctacccgtgaacctgcgttgctattgcgtcaccatcgccctttcatcgcgttctggctggcacgaatcttcaccgccagcggcttccagatgctcaccgtggccatcggctggaacctctaccaactgaccggtaacgtgctggacctgggtttggtcggcctggtggaattcgtaccgcgtgtactgttcatgctgcacaccgggcatgtggccgaccgctatgaccggcgcaaggtcgccgcaatctgccagaccgtgcaagcgctgattgccttgtccctggccatcggcggcctgaccggcaacgtgacccgcgagatgatcttcatcctcgccttcctgctcggcgctgcgcgctcgttcgagatgccgaccacccaggcgctgctgccaagcatcgtgcccagcgcgctgttcccgcgcgccgtggcgtcgtcgcaatcggcgcagcaactggcgaccatcgtcgcgccggccctcggcggtttgctgtatgcgtttggcagcgtgtgggtgtatggcccgacagtggcgttgtacctgatcgcctgcgtattgaccctcaacctgcccgcccgccagaccccattgaataaagccaaggccaccctggactcgttgctggccgggattcgctttatccgcagccgcccggacatcctcggcgccatctccctcgacctgttcgccgtgctgctgggcggcgctaccgcattgctgccggtgtttgccaaagacatcctgctgaccggcgcctggggcctgggcctgctgcgctcggcacccgcggtgggcgcgttgttgatgtcgctgtggttggcgcggttctcggtggaccggcaagtcgggcgggtgatgtttacggctgtcggcgtgttcggcgtggcgactatcgcctttggcctgtcgacctcgttctggttttcgctggcggtgctggtggtgctcggcgcggcggacatgatcagcatggtgattcgcgcctcgttcgtgcagttggagacaccggatgaaatgcgcggccgcgtgagtgcggtcaacggcctgtttatcggcgcctccaatcaactcggcgaatttgaatcggggattaccgcccactggttcggcacagtgcctgcagtggtgatgggcgggattggcacgctggtggtgacgggggtgtggataaagttgttcccgaccctggccaaccgcgaccgtatgcatgtgccggtggaagagaccagagtctgaccctcaacacaattccttgtgggagctggcttgcctgcgatagcggtggctcagcaactgattagtggctggtacaccgttatcgcaggcaagccagctcccacatgggttctccactgggtttactgggtttgagggttgcgctacagcaccttatccagggtgatcggaaagtcccgcacgcgcttgccggtggcgtgataaatcgcattcgccaccgccgccgcgaccccgacgataccaatctcaccgacacccttggaaccgagagcgttgacgacttcgtcgtgttcttcgacaaaaatcacgtcaatttcgccaatatcggcgttcaccgggatgtggtattcggccaggctgtggttcatgtggcgacccagttgatgatccgtctgggtttcttcgtgcagcgccatgccaatgccccacaccacgccgccgaggatctggctgcgggccatcttcggattaaccacgcgcccggccgcaatcgcactgaccacccggctgaccttgatggtgcccaggtcttcatcgacccgaacttcgacaaacaccgccgaatgggtggccgtggcgtagccttcacgttttttgtccggctcgctgtcgacctgtacttccaatgcctcttcgccgctgtccttgatcagttgggccaacgacacactcacatcccccgtgtgcaactggccgtcttcaaagcgcacgacctctgcgtccttgaacaccgggtaagtctgccgggcaatcttcagcaatttgtcattcagcgcttcgcacgcctgctgcacggccgtgccgacggacgacacggtgaacgagccgccctgtaaaggcgcggtgggcaaggacgagtcgcccagcaaaaactggatatccgccattggcacgccgctggcctgcgcagcaatctgggtcatgaccgtgtaggtgccggtgccgatatcggtagtggcgctgctcaccgtcagtttgccctcggtgtcgatgcgcgccttggcgctggccttcatttgcatggcttcccacacgccgccggccatgccccagccgatcaactggttgccatcacgcatactgcgtggctccgggttgcgctggctccagccgaagcgctcggcgccttcgctgtagcatttgcgcagggctttgctcgaccagggtttgtcttcggcctggttgcgttcggcgtagttgatcaggcgcagttgcaccgggtccatgcccagcgcacacgccagttcatccatggcgcattccaggccgatcacgcccaacgcggcgccgggcgcgcgcatgtccattggcgtgtacacatccagcggcaccagcttgtaggtcagttgcacgttgtcacactggtagagcatgccgctccattccaccacgtgttcgctgaaatcttcgaagcgcgacgtctggccaatcgcggtatgccccagcgccagcaggcggccgttggcggcggcgcccatctgcagacgctgcaacgtgcgcgggcggtagccgaaggtgaacatttgttgacgtgtcagggtgacgcgcaccgagcgcttgagcgccagcgcgcccatcaccgccaacggcagttgatattgcgggcgcaggcccgagccaaaggcgccgccgacaaacgcggcaaaaatccgcacctggcttttatccaagccgaagactttttgcacataagcctggcagttctgcgggccttgggtcttgtcgtggatatgcagggtgccgtccgcttggtacagcacggtgctggcgtggggctccatcgggttgtggtgttcgatcggcgtgctgtagtgcatgtcgaggctgacggcggccgcagcccactcggcctggaagttgccgcgtggcgcaggtggcgtttgcggcgaagggtacgcttgctcctgcagggccaccaggtcggtttcgaaggcttcgctggcgtactcaatctcgatcagcgaaccggcatgccgcgccagttccaggttatccgcaatcaccagcgccaacggctggccgctgtacagcacgcggtcgttatacagcgggcgaaatggcgagccatccgccgcatcggcgtcggcgaaagcctcatcgtaactggcgagtttgggccggttgaggtgatcaagcaccatgaccacgcccggcagcgccaaggctttggacgcatcgatcctgacgatccggcctttggcgatggtgctggagaccacactgccatgcagcaagcctttttcgggaaactcaccggcatagcgtgcctggccagtcactttgagcagaccgtcgacgcggtccaagggtttgccgacagcggtcatgggcgttctcctgcgacagcggcatcgctcagggcgcgaataattgcgcggcgcgccagcttgatcttgaagccgttgtgttccagcggctcggcgtcttgcaacagggcgtcggcggcggcgctgaaggtttcacggctgacggactggccaatcagtgcggcctccaccgcgcggtcacgccacggtttgtgcgccacgccgccgagggccaggcgtgcatcgacgatgcggtcgccgtccagttcaagggcggcggcgacggaaaccagggcgaaggcataggaggcccggtcgcgaattttcaggtaatggctgtgattggccagatggtcggcaggcaactcgatggcagtaatcaactcatcgtcagccagcaagttgtcgcgctgtggcgtatcgccgggcagtcgatggaagtcggcaaactcgatagtccgcgcaccacctcggccttctacgtgcacccgcgcgtccagtgccgccaaggccacacacatgtccgagggatgcgtggccacgcagtgctcgctggcgccgaggatcgcgtggatgcggttcaagccggtgcgcgccgggcagccgctgccaggctcacgcttgttgcacggcacattggcgtcataaaagtagtagcaacgggtgcgctgcaacaggttgccgccggtgctggccatattgcgcaattgcggcgaggcgcccgccagaatggcctgggacagcaacgggtaacgctgttcgatcaacgggtgccaggccaggtcggcgttgctcaccaaggcgccgatgcgcaagccaccgtcggcggtttcttcaacctcatgcaacggcaggccggtgatatcgatcaagtgttcggggcggctgatgttttctttcatcaggtccagcaggttggtgccaccggcgataaagcgcgacgcggcgctgctcaggtgcacggcttcgtgcacatcggcaggcttgctgtactggaaggggttcattgctcacctccctgggcgcggcaggccggcaaggcttcttcgatggcatcgcggatattgttgtaggcgccgcagcggcacaggttgccgctcatcagctcctggatctgcgcggtgtcatgggcacgaccttcattggccaggccgacggcggagcagatctggccgggggtgcagtagccgcactggaaagcgtcatgcttgataaaggcctgctgcatcgggtgcaacacgtcgccctgggccaaaccttcgatggtggtcagctcggcgccatcacacatcaccgccagggtcaggcaggcgttcacacgtttgccatcgcgcaatacggtgcaggcgccacattgaccgtggtcgcagccctttttgctgccgaccaggtcgagttgctcacgcaacaggtcgagcaaggtggtccagggcaacacgtccagttggcgactctggccattcagagtcaggcgtatcgggtggctgacgaacggcttggccgccgcgccattgggggttgcgctcataaacacctcacgggttgttatccatccgcggcgttcaggaaagtcgccgtctcaggggtacgacttcccggggttttgagcgttcaaggcaattgataggtggcgatcagcgaatgctgagggtggtgaccagttgattgcgcggcgggttgatcgaggtgttgctgtactggaagttgccgccagcttggatattcaactggaacgtatagatgtagcccatcaacgtgcccgcgccgctgcacgcctggctgaccgagcccacctggcagatggcggtgctggtgccggacactggcgcgccgtcgaaggacgcctgggagctattgcccagcccgacttccatcacgtacaccagcgtttgcccacggtgtgtgcacatttgggtgctgaccgcgcgttcagggatggtttcggtgcaactggccgactgcaccttgaacacccgcacctcgctcaacgccggtgcagacgcgccccacgccggtgctgcaccgagccacaggccgagaatggcgaacagagctagactgctggcgttggcttttttcatgctggtaacgaccctggattaaacgtcggcgcagtatgcctcaaggccatgaacccacaaaaccaagcctatacgccattggccttcggctgctggtatgatgcgccgctttttccgatcctctctgaaaccacaggcgcttggcgcagtttgtgctttgacttagaggtcaacaaataacgacgcaaaatagcgtcacagggagccggcatgctggaaaagctgtttcaactcaaggcacacaacaccaatgtgcgcaccgagattctcgcggggatcacgacctttctggccatggcctacattctgttcgtgaacccgagcatcctcggcgagaccggcatggacaagggcgcggtgttcgtcgcgacctgcctggccgccgccatcggttcgaccgtaatgggcctgatcgccaactacccgatcgcactggcgccgggcatgggcctcaacgccttctttacctacaccgtggtcctgcacatgggccacacctggcaagtagcgctgggtgcggtgttcatttcggcggtgctgttcttcctgctgtcgatctttcgcatccgtgaatggatcatcaacagcatcccactgcccctgcgttcggcgattgcggccggtatcggcctgttcctggcgctgatcgccctgcataacgccggcatcgtggtcggcaacccgaataccctggtgggcctgggcgacctgaaacaacccgcgccgatcctggccacctttggttttatcctcatcgtggccctggaagccctggccgtacgcggtgcggtgctgatcggcatcctggcggtgaccattgtttcgatcctgttgaatgtcaccccgttcggcggcgtgatctcggtgccgccatccctggccccgaccttcctgcaactggatatcaaaggcgcgctggatattggcctggtcagcgtgatcttcgcgttcctgttcgttgatctgttcgacaactccggcaccctgatcggcgtcgccaagcgcgccggcctgatgggcaaggacggccacatgccgaaaatgggccgtgccctgatcgccgacagcaccgcggccatggccggttcgctgctgggtacgtcgaccaccaccagttacatcgagtccgctgcgggcgtgagtgccggtggccgtacgggtttgaccgccatcgtggtcgccatcctgttcctgctggcgctgttcttctcgccgctggctgccagtgtgcctgccttcgccaccgcaccagcgctgctgttcgtggccgtgctgatgacctccggcctggccgaaatcgactgggacgacattactgttgcagcgccggtggtgatcaccgccctggcaatgcccttcacttactccatcgccaacggcatcgccttcggtttcatcgcctggaccgccatcaagctgctttcgggccgctaccgtgagctgaacccggcactggtgattctatcgattctgtttgtgatcaagctgggctggttcaacgcatgacttttgacgccgcaagctacaccgctcaactgcaagacaaggtcacgcgcctgcgtgacctgctggcaccgttcgacgcccccgagccgcaggtcttcgattcgccgctgcagaacttccgcctgcgcgcggagttccgcctgtggcgcgaaggcggcgagcgctactacgcgatgttttcccaggacgacaagcgcacgccgatcctgatcgaagaattccccatcgcaagccagcgcatcaaccagttgatgccgcaactcaaggccgcctggcaagccagcgcggcactgagccacaagctgttccaggtggagttccttaccaccttggccggcgacgcgatgatcaccctgtgttatcaccgcccgctggacgagcactggcacacggccgcgaacaagctcgcggccgacttgaatgtgagcatcatcggccgctccaagggcaaacgcgatgtgatcggccacgattatgtggtggaaaaactcgaagtcggcgggcgcacgttcagctatcgccaacccgaaggcgcgttcacccagcccaacggcacggtgaaccagaagatgctcaactgggcttacgcagccttgggcgatcgcccggatgatttgctggagctgtactgcggcaacggtaacttcaccctgccattggcgacccgcgtacgcaaagtgctggccaccgagatcagcaagacctcagtgaatgcggccctgagcaacctcgatgaaaacgctgtggataacgtgaccttggtgcgcctgtctgccgaagaactcaccgaggcgctcaacgaagtgcgcccattccgccgcctgcacggcatcgacctgaaaagctacgaattcggcagcgtcttcgtcgacccgccgcgcgccggcatggacccggacacctgcgagctgacccgtcgcttcgataacatcctgtacatctcctgcaacccggagacgttggcggcgaacattgcgcaactgcatgacacgcaccggattacccagtgtgcgatgtttgaccagttcccgtggacgcaccatatggaatccggagtgttactgacccggcggtaattcagcaccctcttcttctttcttgcgtggacgaccgcccttcttgccattggctcgggcggccgccgacttggcggcgctgcttttgcgaccgttgcgcgaggctaccaggcttgtcgccaggtccatcaagggctggctggtggcgatcaggccggtgatcgacacgtccagatcctgcgcctcacagcacaacgccttgccgccaaagccgacctccagttgctcaaagtcctcctgggaaaacccttcgaactccggtagccccgccacaggcaacatgacgcggctgccgtcgctgaagccgatggaaatgcactcgttttcatagcgcacgttgctggcgttggcgtaaagacgtttgagcttgcgcccacgggcgattgccttgtcgacatcggcctcagtgagcggtttatagggcacagttttcgcttttacgattttcataaattaatccccacgcaatctggcgctcttaccagattcaaaattgtccgttgctctacaacgtcgtgccaggcacttgcgatgacatagacaccacgtcgaatgaccaacccttgaaccaattcaccagcgtcccaatcccaggaatgattctccaggcaaaccgtttgcagtttctcccaccagatcctgcgtgcccgcgccaagtagtgccgctgcatgatcgcctcgcggatttccttcaggatcgctgtaggtggtcgccttcgttcaggttccacatcccacaactccacttccccatccaaaaaactgaaacgaaaccgtgcatcccatgccttgcccctgacatgcacgtgaggcgggcaatgctcatccctgacgaacaccgaaattacatatcctttgtaagcacctactctcatcgtaacccatccgttaggttattctccgtcgagttacacttttcctcgtgcagcccgacaaccggctccaaaatcccgaagctgtttcacagattagtaacgacgaacaacccggcgaatgcccggttgtaaccactcatgccgacggctggaaataccccgccaacgcccgcaagtcctgctcgttcagcaaccccgcgtaatacttcagctgaatccgcgccagcaaatacgcatgccgcgcattcgccagatcacggcgggcggtgaacagttgttgctcggcgtcgagcacatcgaggttgacccgctcgccgccgctgacgctttttttcgtggccgccaccaacgccgtggcagagctgacggccatctcataggcgcgcactttcgctgcgccgctggtgttgagattgaattgcttgcgcagctccaccagtgtgacggcggtttgcgcgtccaattcatagtgggcctgggacagctggttcgccgcctggcgcgtggacgccgacaccgagccaccggcaaacagcggcaagctgacctggatgccgacgctgttggtgtcgtacttctggttgtagctgctttccgaatcggagctggtttttcggctgctggcgtacaggctgactttgggcaaatgcccggcgcgtttgcgctccacttcataagcggccacgtccagcgcgtgatgctgggacttgagttgagggttgttggccatggccaattcgcgccaggtgtcgaagcggttcggctccagcggcgggatctcgaattgacgggccagcggcgccagttcctcaatctgcaacggttggccgacgatggcttccagctcgcgcagggcgctgtcctgggcatccagagattcgatctcttcggcctgggccaggctcagccgcgcctgggtttccagcacatccgtgcgcgtaccttcgccgcccttcagcaagcggtcattgagctgcaagcgttcgacaaacgcacgcctctgcgcgcggctcaactcgatgcgctcctgggccagcaaggcctggctgtaggcactgagcacacgcacggccagctcctggcttttgccgcgaaagcgctcatccgccatcagcgcctgggcagtgccctggcgaaagcgcgcgtaggcttcgtaatccaacagcggttgctgcaaggtgagggtcgatgcgtagctacggtagtcgcggtcgctggtgacatcacccgccgtcaattcggactcgttgcgcgagttgttgtaactccacgacaaattcggcaataacccagcccgcccgatcacgcgattttcttcaccggcttcgcgttcctgaatggccgcctgaaacgtcggatcgttgcgcagggccaggtcataagcgtccagcaaacccaaagcgttcgccgccggtgcacagctcaaaaacacgctaaacaacagcgccttcattcttccaccagggccatgtgggtgcgatccagcaagggtttgaacagatagttgagcatcgagcgctcgccggttttgacgaaggtttccaccggcatgccggggcgaacctgcacgccatacagttgctgcataccggctgcgctgacctgggcgcgcagcgtgtaatacggctcatcggtgcgctcatcgacctggcggtccgccgaaaccattgtcacttcaccaaccacccgaggcgtggtggcttggttgaacgccgagaacagcaactccaccggcaagccagggtgcaccttgtcgatcatctgcaccggcacgcgcgcttccaccagcagcggttcaccttgcggcacgatatccagcaacgcctggccaggcttgatcacgccgccttcggtgtacacctgcagcccaacgacgacgccggaaaccggcgcgcgcaccaggctgttggccaactcaaactcagccgaggccaggcgattgcgcaggtcgtcgctgcgggtgcgggtgtcggccaactggctgcgcaggtctttctggaagtcttcaccgagttggcgaatgcgcaggcgcagctcgaggacctggcgttgtagctggccgatgcggccgaaatcctcggcgatggtgccgtcgatttgcgcgtacaggcgctcactgtcgagcaggcgattgcgcgggatatagccgtcgcgcgccaactcgcgcaggccttgcagttgctcgttcaacgcggccctttgctggactttgctcgcttgcgaatcccgtgtgccacgcaactgcgcctcggccccggcaatggtttcgcgcagggcttgctgctcggtggccagcgcctgggcgcggctggtgaacagttgtcgctgcaaattcaggacgctggcggcatccggctcattgagcagttcggggccaaaagcgatggctgataaaccttcgctttcggcagtcaagcgcgcttcgctggccagtgacgccaggtactggctgcgcaaggattgcatctgcccgcgcagcggcgtttccttcaaacgcagcagcacctggcccgccttgaccgtttcaccgtcgcgcacctcgatgcgttcaacgatgccgccggtggggtgctgcacggttttgcgatggcccgagaccattacctttccggacaccgccacgcccttgtccaatggcgccaacgccgcccagccgagaaacccggcaaaaccaccgagcaccagcaaccagcccaggcgtgcgtattttttgtcgtccagcgccagcacattattgggctgaccgctgaccagcagcggtttgctttgactcatgccggttttccttcactgaggcggtaactcatgctcatgctcgacaccggtttgcttggcgtgggtttctgccgcgcctccaatacccgcgcggtcgggccgaaggcctgcagctggccgtccttgaggatcagcaactgatcggtcagggtcagcacgttggctttgtgggtaatcagaatcacggtgcgccgctgctgcttgagttgcgcaatggcctggagcaacgcctgttcaccgacttcgtcgagattggcgttgggctcatccagcacgatcagcgcgggcaggccgtacaacgcacgcgccagcgccacgcgttgtttctggccgccggacaaaccggcgccgccctcgcccagttgtgtgtcgtagccttggggcaattgcaggatcagctcgtgtacacccgccatctgtgcagcggcgaggaccttgtcggcctgcacctcggcaaaccgcgcgatgttttgcgcgatgctgccggcgaacagctggatgtcctgcggcaggtagccgatgtgcgggccgagttgctgcttgtcccactgagtcaggtcggcgccgtccaggcgcaccttgccggccagcggtgcccaggcgccgaccagcacacgcgccaacgtggatttgccgcaacccgatggtccgatcacgcccagcacttcgccggccggcaggtcgaaaccaacgttggccaacgccggccgacggctacccggcgcgcaggcgctgacgtgctcgacggtcaattggcctttgggcaccggcaaactcatgcgcaccgggcgcgccgggttgtctgccagcagctgcgacaagcgctcataggccaggcgcgccgaaccccattgcttccacacgccgatcaactggtcgatagggctgagcacccggcccatcaggatcgagccggcgatcatcatccccggcgtgatatcgccctgcaccgccagcaatgcgcccaaccccagcaccagtgattgcagcgccaggcgcacgcccttggaccaggcggtgacggcggcggtcctttcactggccaggttttgctgggcgagaaacgcttgatgctggctgaaccaacgcccgcgcaaagtgccgagcatgcccatggcctcgatggtttcagcgttacgcaagttggccgtggcctgctggctggcgctgatggcgagctggctggcctgggccatcggcgcctggctgacatgatggttgacccacgccagcgcgatcaacaacaccgcaccgcccaacgccaacaggccgagccagggatggaacaggaaaatcaccagcaggtacaccgggaaccacggcgcatcaaaaaatgcgaacagtgcctggccggtggcgaactggcgcagggtggtcaagtcttgcaacgcctggcctgccgcctgggtactgcccttgagttgcgcttcgaacgcggcgtcgtacacccgctggttcaagcgcatgtccatttgtgtgccgaggcggatcaccacttggctgcgcacccactccaacgcgcccatcaggccgaacaggccgaggatcatcaacgtcagcatcagcagggtcatctgattgcccgaagccagtacccggtcgtacacctgcagcatgtagagtgccggggccagcatcagcaggttgatcaccgccgagaacaggccgatgttgaagaagccacttttataggccgtgagggcggccagggtttcgttgccgacgtggcgcatctgggattctcaaagggttaagcgggcagcggcgccgcgttgacaggcgagacggcgctgcgcagaatttgcgcaccgccgccgcttgaagaagtagaaggctttagcgacggcggtgtgtcatgcggcgaacgggagagcgatctccccttcgcttttttcatgcagcagtgattcaggcagcgagtgcccagtcctgcgccacatcttgcacgccgaccagagcgacgtccgcggtggctgcgccggcgtgtgccgccaggcccgccgacacttcgtcgaaggtgctggcagtggacaggccgaagtcgtcgagcaagttgttgagcacggtttccagcgcagtggtgttgccctgcatcaggccgaagatcacgctttgcacatcgttgcccgctcggccggcaccttcggcggcgctcaggtcgaggccgttgaatgcgactttgaagtcgttcaaggtgaaatcgctgccgctaccgccgcccaggccggtgcccagttgcacgttgtccaggtcgccccacaggtagtggttcaggttgttgccggcaggcagcgaagggttgaacacatagtgcaggccattgctggtgtcgctatcggcgataaacgcgtattcggagccgctggcgccgtgggtcgaatactgatcgccgctgagggtgccgttgctgaaaccaccggtgttgctggcgccgtggccagcagtgttgaacccaacagcccaagcgctcaggtagtcggagaccgacagtgaacccaggcccgaatcgtagctaacagaaatagtcatcgctaaacctcgttaaacaacgttgttgatgagcacgccaaagcggcgcgcttttttgcccagccttgggcaaaacctgtgatcgcgtgccgtggcacacggatcagaacttgtattccagcattccgctcagcgtccgcccgcgcgccaggctgaggttgttggcatcgcccatggcgacgaaataggcttcgtcggtggcgttttccaacgccagtgcgatgttcaggtgatcagtcatccagtaactggcgtacaggtcgtagagggtgtattgcggccacatcgcctggtccatcagctcgtagccttgctgattgaggttttcgccgttacccgcgctgtaacgcacacgtacgccggtatccaggcgcttttccaggaagcgcacgcccagcgtcagcgagccgcgatcggcaggcatgtaggtggcgttgcccatgattcggccgcagctttccttgttgttggcgacgttgtcgtcgagcacttcataggttgtgaccggccgcaggctgatgcgcccgttcggcagcgtgaagcgttccaggcgcgtggttcttggcccggtggtcttggccccgcccatgtaatagttcttcgagcagaactcattgctgccgatcatgtgcgtgtagctgaggttggcgtatgcgcggcccatgtcgtaattgagctggtattccaaaccgcgaaagcgcgtcgggttggtgttgttgacgtaggccatggtcccgagaaagccgcctacttgggtctcgggcaagctgacgctggtgttgaggaaggagaagttttcaatccgggtatcgaagtacgccaccttcatgccgaggcggtcgtcattgaagaacaagccctccttgaacacgttcgtgcccacttcccaatcccgcgactcttcaggtttgaggtacgggttggggaacacccgctccccggaaccgccgccgtgggggcggccggtcataaaggtctctgtgaccgccggcgggcgccagcccttgccccaacgggtatagagttgcagccagtcaacgcccggcttgaccgcaatgccgaaggtgggggagaactttccttcttcacggtccacatcaatcacttccgacacacgctttgcgcccaccaggctattgaagaagcggtcgcgccggtacaaggtcatgccggtctggccttcgagccgataacggtcgtaacgcaggcctgcatccagggtcagccaatcgccgtattcgtattgcaggctgttgaacaggctggcgatggtgcgcttgccactcggcgtactgccttcggcatagggcagcagtgcgaggtcgttggcggcctcaactttgttggtgcgtggcttgaactcgtcctggtacatctccaggccgtagttccagctcagatggccgcgctcgccgaaatcaaagcgcgaggtgttgtcaccctgcagcccccaggtgtcagtctggaagtggtcggtgtaggcgcccacgtagttccccgtgcctggcgtggacagcgtgggcgtattggcgcgatccagttgggtggtgacgtagtagaccttggctttcaggtcgatcagcgggttatccggcgtgtagctgtagtccagcgcgaagttcttggcgttgaggttgttcttgctcacgcgatggtagtagacgctttgcaggtcatcggcgatgtaggcccaggcatcattgctgtcgctgtcgctttccaggtagctcagttgcacgcgttggtcattgggcaggttcagaccaaacttgacgatctgcgaacgggtgacactgcccatatcgccgacttcgctgttcaaccaatcatcaaaggccgctggcgcgtatttacgcgcgcgcatattggtgcctagcttttgatcgttatgggtgcccgcgcggtaattgccgaaatgccgctcgctgtaacccagcagcacatcgccgcgctcatccccaaaggcaaccactccgctgccgttgaagtaagtgccgttacccagctcgccgatgccgctgccggcgcgaaaacgcccgccgatctctttgccatctttaagaaattcgctggcgtccaaggtcttgaacgaagcaatcccgcccagcaccgccgccccgccctggcccgactggctgcccttgtcgatctcgatgctggagatgaattccgggtcgatcaacatcgtgccgttgcgctgctggtggccgttgacgttgaagttctggcgcatgccgtcgatgttcatgttcacccggccatagtcctgcacgccgcgaatgtttacagagaggccagggtcgcgctgattgacggcggtgtagacgccggcggtttcttcgagcatgtcggcggcgtgacggggtgggcgtttgtcgatcatgtcacggctgatgacggccacggactttgggctctggtacacccaatcgccggcctggccgttggtgttgccggtgatggtggtggtgccgacggtcatggcgccgtcgtgggtgtccgtgacgcgattgagggtgacctggcgctcgccggtaaagcgatactccaccggtgcgccgccgagcaaacggccaaggccttcctgcacgctgaagctgcccttcagtgccgtactgctcaagccttgcagacgctggctgtcgaacagcacttgcaggccggcttggtcagcaaacgccagcaccgcaatgcccagcgattgcgccggaatatcgaacatctgcaccgcaggctgagtggcgcccacttgaggctgcgcggcgtacaccggcgccgttatggcgaacaggcccaaatgaatagccagggctaaccggtaaccggtgacacgccccgtggtgagtgctgacatttctggtttccctacgctgagcgctttttgtttatgcgaatgcttctcacctagcaagacgtacgaggcccaggaagtcagtaagtgtttttcgaaagtttttcaggaaggtgtgtcgcgcacggcgggaggcaggtctcccaccggcttatcaatagatcaggctgaggcccgccaggtccaagcgttgcacttggagttcctgggtcaaggtgcccagcgcggtgtcgagcatgtcgaggcggaacacgccgctgacttcgcgatcgcccaaggccgggttggtcaacaccacgtggcctgggcgatagcggttgagttgctcgatgaccttggccaatggcaaccggtcaaagatcaacacaccgcgccgccaactgatggcgcgttccacattgaattgatcaaggggcaccacgccgtcctggggactgtagcgcgcgacctggccttccttgagcacggattcgctcgggccgtttttgggtgcgctttgcagagacacttcaacgctgtgctgtagcacgccaacccaggcctggctggctccttcacgctcgaccacaaaccgcgtgcccaacgcacgcgtctgcccggcggcactttgcaccacgaacggccgcgtttcctgcccggtcatgggcgccacatcaaaaatcgccgagccctgaatcaggctgatgcgccgctgtacgccgtcgtagtccaagcggatggcgctggcggaatccagtacgaccgtgctgccgtcggccaggtgcaccgtgcgcacttcgcctttctgggtgacgtagtcagcctgcaggcgcagcaaggcatccggcccacgcacccagccaacgcccgccaccagcacaaccaccgcgactgccgccacgcgctgccagagtctgcgccgtttgggccggcgtaccggcaacggtgctgaagatgggcgctggcgatgcaccggttcgtccttgtgcaactcgcctagggcggcccacgtctgctcggcaaaacgcagtgcggcctcatggcgactgtcgcaggcgatccaatgtcgcagctcggcctgctcctgttcggtcagggcaccggcgtgcaggcgcaccgcccactcggcggccgcctcggtaatgctgtgctgttgcggaccctggctattcacgtgtgaatctcgaattttcgttatgtaaacgctgtgacgtctggcccggcgcttttcggtaattcattcgtcggatggcttcacctcgccttcctgcaagcgttgcatcacatacgccaaggccttggccagatgcttttgcacagagctgtcggagatctccaggcgccgggccacctgggcatgggtcatgccttcgatgcggttcagacggaaaacctgctgggtgcgttccggcaactccgccagtgcctgcttcaatgcctgtcgctgctgctgcgccattgcctgcgcctccaagccggccacgtcatcttcaatctcggccagcgcctcgtggggcacggagtctgtcttgcgccgcgcctcctggcgaatatggtcgatcagcagattgctcgccgttcgatagagatagccctgggagttgtcgatgcgctcgccggccggtttttccgccaggcgcaggaaactctcctgcaccaggtctgcggccaattgcgggtcccgcaccttgcgcgccagatacccgcgcagggtatcggcgtgcttgagaaacaggcctttgagatccacgtccgacaaaccgactccctggaatgtgatggaaacagaccggcatcttaagcgttgtcgagaatgattttcaattgatatctaatctgattatccagtacgaacgcgctgaataacggttcgataatcgaacacatccgccgccatcaattgaccaaattaaccatccagtacattttatcttcacaacctataagaactgtggagaccccctaaatgccgcctatcgtgctggtgctcaacggccccaacctcaacctgctcggcactcgcgagcccgccacctatggccatgaaaccctggccgacatcgccgccctgtgcggccgcagcgcggaaaaactcgggctgaaaatcgagttccgccagaccaaccatgaaggcgaattactcgactggatccacggcgcccgcgcccggtgcgccggcatcgtgatcaaccccgcggcctggacccacacttcggtagcgattcgcgacgccctcgtcgccagtgaagtgccggtgatcgaagtgcatttatccaacgtgcacgcacgtgaggcgtttcggcatcactcctttgtctcacccatcgccaaggcggtgctcgcaggcttcggcagccacggctaccacctggccctggaacatttcagccacacgttgaaagggtgaccttgatgaaaccgcgcatcctcgccggcctgatcggctcgggcatccaggcctcccgcactcctgccctgcatgaacaggaaggtgacgcccagggcctgcgttatctgtaccgcctgatcgatctggaaccgctgcaactgaacatcaacgccctgcccgacctgctggacgccgccgagcggatgcagttcaccgggttgaacattacctacccgtgcaagcaggcgatcctaccgttgctcgatgagttatccgacgaagctcgaggcattggcgcggtcaataccgtggtgttcaggaacggcaaacgcatcggtcacaacaccgactgcctgggtttcgccgaagggtttcgacgcaatttaagtgatgttgcgcgtcaacgcgtagtgcagatgggcgccggcggtgcaggtgcggcggtggcccatgcgttgctggcggaaggcgtggaacagttgagcattttcgacgtagacagggctcgcgcccgcgaccttgtggataacctcacccagcgtttcggcagcggccgcgcccaggtcggcaaccatttggaaagcgccatcgccgaggcggatggcctggtcaacaccacgccgatgggcatggccaaactgcccggcacgccggtgccgagcagcctgttgcgggcgcaattatgggttgcggaaatcgtgtactttccgctggaaaccgagctgctacgcgacgcccgcgccttgggttgccgcacgctggatggcggcaacatggcggtgtttcaagcggtcaaggcattcgagttgttcagtggcgaagcgccggatgcgcagaggatgttggcgcactttcagagcatgaatacctgactggcgaaaaccgaatcgcaaaaatgtgggagctggcttgcctgcgatagcggtgtgtcagacagctgatttatagctgatagaccgccatcgcgggcaagcccggctcccacattgattacatccaggtttgcgaaaggagagatttcagacctggaggtaacgcatcaccgaatcacaaatcatctcgcggtgccgctgtttaaccgcttcgtccgccagctcgatctgaaaaatctcactgaatgtatgacggttggacacccggtaaaaactgaatgagttgatcagcaagtgcacgtccaacgggtccaacccctggcggaacaaccccatctcggcgccccgccgcaacgttgccccgagcccttcgagaatattgctgttcatcgccttgatcgagtccgagcgctttacgtattcggcgttgttgatattttcgatgctgacgatccgcacgaaatccacgttctggtcatggtgatcaaaggtgaattccaccagccgccgtatcgcttcgcgcggttccagggccgtgaggttcatgcgggtttcagtgttgcgaatgtcgccgtagagtttctccagcacttcgacgtacaactgctccttgctgccgaagtagtaatagatcatgcgcttggaggtgtggatacgctcggcgatggcatccacgcgagcgccggacaggccctgctgaacaaactcgacaatggcttcctgaaggatattttcgcgggtcttttccgggttgttcttacgactcttgcgcggtgcgtctgacacagcggagaggtcgggggtcagggtcatggtgcgctcacggccatttttgttgtgcaggccgcgattatgggccgaggcgctccccgaaggaagcacccggccgtcagtcataaccgtgcttggcgcaccgcgccgctgcgggatttggccatcgctgccaggcgcaccgctacgttggccgcgccgtacccggcatagccgtttttgcgttggatgatctcgaagaaaaaccgcccctcgaaaggctcggtgtacacgtgaaacagctctccaccttgggcgtcacggtcgtacagcacgttgtagtacgccaactcgctgagaaactcgtcgtcgaaatcaaaccgcgcggccaagtcatcgtagtaattgagcgggatgtccagcaacggcacgcctgcctctttagcccggcttacctcggcgaaaatatccgcgcagtcaaacgcaatatggtgcacacccgagccgcgatagctcgacagcgcgtgggaaatggcggtgttgcggttctcggaaatattcagcggcaggcggatcgagctgcagcggctgcgtagcgcgcggcttttcaccaggccataagggtcgggcagtaccacctcgtcgtcggcttcgaaatccagcaggcttttgtagaacagcacccaactgtcgaggctgtcggccggcagcgccatggccatatggtcgatgcgcagcagcccgccgcttgaggcagtattcgcttgcaggttgaagtcggtgtcatacagcccgccctcgcttgggtccaccaggtaaatcaggctgccgtccggcgcgcgcacggcggccagttcaagctcatttggccccacgagaccgcgataaggctggcccttgtaggccaccgcccgctgcaacgccttggcgctgtccttgacccgaatggccgtggcgcacagcgacggtccatgggcttcgaaaaagttgtgggcaaaggaatagggttcgcagttgaggatcaggttgatgtcaccctggcgcaacaggctcacactcttggaacggtgctgcccggctttgacgaaccccaggcgctccagccactgcgtgagcttggcgccgaggttttcatccacggcaaattcgaggaattcgatgccgtcgtattcactggcggccggggtttcaaacagaatatcgaccggcttggcaggctgttcctgcgccaggcgctgacgggttttctcttccaggtacagcagcgaacgcaagccatccgccgcattggcccgggtcggggccgcacggaagccgtcgttgaaaatttccagggacagcggcccggtgtagccactcttgatgattggcgcgagaaagcccgccaggtcgaactcgccctgccccgggaagcagcggaaatgccggctccactccagcacatccatggccaggatcggcgcatcggccatttgcacaaagaagattttgtcaccggggatatcggcgattccactcgggtcgcccttgagtgacagggtgtgaaaactgtcgagcaacacaccgaggctcgggtggtcgacctgccgcaccaggttccacacctgttgccaggtgttcacatgcttgccccaggccagcgcttcatagccgatgcgcagaccacggcggccggcgtgttcggcgagcaggctgaggtcgtcgagcaaaatacgttcatcgccgacgcaatcggcggaagcattgctgcacaccaataccaggtcagtgcccagctcctgcatcaagtcgaacttgcgttcggcgcgttccaggttgcgcgccaggcggtcgcggcggcaaccttcaaagtcgcggaacggctggaacaaggtgatggcaatgccgaggtcggcgcacatctgcctaacttcccgtgggctgccgtcgtaatacaacaaatcgttttcgaagatttcgaccccatcaaaaccggcggcggaaatggcttcgagcttctccggcagggtgccgctcaaggaaacggtggcaatggaacgttgcatggggcgactcccggcaattgttgtttgcgacaaattattcgcccctagcctacacgcagcaattaaaatgtacgaaccagttagtttttcgggcgattaccgaacactatgccggtttggcgaattgacgatgttttaaccgctgcgcaccatcgaacctgcaccaagacccagaacacaccataaaaatttcaaaaaacgggtacgacctcatgcctctgcaaaatcccgccctggccgcgcgcccgggcaacccgcaagccggtatcggcgacaaaatccgcggcgccatggccgtgggtaaaacgcgctggggcatgctggccctggtgttcttcgccaccacgcttaactacatcgaccgcgccgcgctcggcgtgatgcagccgatcctcgccaaggagatgagctggacggcgatggactacgccaacatcaacttctggttccaggtcggctacgccatcggctttgtgttgcaaggccgactgattgaccgagtcggcgtgaagcgcgtgttcttctgcgcggtgctgctctggagcctggccaccggcgcccacggcctggccacctcggccgtagggttcatggtctgccgctttattctcgggctgaccgaggccgccaactacccagcctgcgtcaagaccacccgcctgtggtttccggccggtgagcgcgcggtggccacgggtatcttcaacgcgggcactaacgttggcgcaatgatgacgccgatgctgctgccgctgatcctgcacgtgtggggctggcaggcggcgttcctgtgcatggcatcgttggggggtatctggctggtgttctggggcttgaagtactacaacccggaagaccatccgacggccaaacaatccgaattggactacgtgcaacaggaagtcgaacccgaacaacccagcgtgcctttcagccgcatcctgcgcatgcgtggcacctgggccttcgccctcgcctacgcgatgaccgcgccggtgttctggttctacctgtactggctgccgccgtttttgaaccagcaatacaacctgggcatcaacgtgacccaaatgggcatcccgctgatcatcatctacctgaccgccgacttcggcagcgtgggtggagggattctgtcttcgttcctgatcggccgcgggatgaacccgatcaaggcgcggctgttgtcgatgctgctgtttgcctgctgcatcgtcggcgtcatcatggccgccggctccagccagctgtgggtcgccgtattcgccatctcactggccatcggcgcgcaccaggcctggaccgccaacatctggagcctggtgatggactacacgcccaagcacatgatgagcacggtgttcggtttcggtggtatgtgcgcggccattggcggcatgttcatgacccagatcgtcggtcatatcctcacggtcacgaacaacaactacaccgtactgttcacgctgatcccggcgatgtacttcattgcgctgacgtggatgtacttcatggcaccgcgcaaaattccaaaagtcgacgtttgagtcaacgccgccgctgctgccaggcagcggccaacccgctcatgcagatcaccccgatgccgaccaccgtggtcatgtcgggggtatgcttgaacaccagccagcccagcaaccccgcaaacacgatctggcaatagccgaacggcgccagcaaggccggcgccgcaaagcggaaggcctgggtcaacatcaagtgggcggtcatcccgcacgtgcccagcgccaacatcagcacgccgtgccacagcgtcggcagctgccagaagaacggcaccagcgcactcatcaccaaggtattgcacagcccggcaaaaaagttgctggtggtcggcgtgtcgtattggctgaggatgcgcgtaagcagttggtagaagcagaagaacagcgccgaacacagcggcagcaacaccgccggcgtaaacagctcaccgccggggtggatgatgatcagcacgccgacaaacccacagatcacagccagccattggccgcgtgtcacatgctccccgagcagcggcaccgacagcgccgtcacgaggatcggcgcgaggaagttcaccgccgtggcttccgccaacgggatgtaatgcaacgcagcggtaaaaaacaggctggtgcccaacaggcacaacgcccgtaccacctgcatgccggggcgtttgctgcgcagcacgcgcaagcccgattgcggcaggaagatgccggccatcaacaaggtgtgcaccaggtaacgcgcccacaccaccatcacaatcggatagaacccggccaggtatttggacagggcgtcgtggctggaaaacagaaacgtcgccaccacaatcaacaaaatgcctttgaaaggatggttgacgccggaaaggggtgtactgacagtcattgaattctcttgcgtggcgggctgatcgctgagcactgaacgcaatagcactcaacccggtaatctagcaggcgggccgtagtccgccccaagagcataaccaaacaccgtgcgaacagcgcactaaatcacgggatttgagtccaacgctgcacgttcccccgcgcgttgcacactttttaaccaaggccttgccgctatgaaaaaaacactcttcgttctttctgccttcgccctgctcactgcttgtaaccaagagtccaaggaagcccccaaacccgcaccggcgtcggtgcaagccaccctggtgccggctaccccgcccaccgataaatgggtcggcaaatggcttggcgtcgaaggcctgaacctgaccatcgccaaggacgacagcatcggccgtggccattacatattgaccatgaagtatggcctcgacgccgacgacgaaggcaccttcaaaggtgaggccaacgaagacggcatcgcctttacccgcccggacggcccgcaacagctgagcgccggtgatggtgaagccaccggcctgaaatggctggcggataaaaaagactgcctgattgtcgataccggcgaaggctactgccgcgactaaccccgcgcagctgacacaactttcatctggcgcccctgcctgcacggcctgacagcagcgatactaggcaactctcgtctcttgtcggacagccgggctggcgccattcattcgcaccaacaacactgctcttagaaaagtgttcgacaggttcatcgagaggattgccccatgctatggaaaaaaggccgacgcagcgacaacgtggtagatgcccgcgatgacagtggcggcggcggtggcggcatgcgctttggcggcggcaagggcctgagtttgacggcgattgtgctgatcgtcgggatcggctggctgactggccaggacccgatgcagatcctcggccagttgaccggccaggtcgagcaagcgccgtcggtgagcacgcaatcgcgccaggcaccgccggccaacgacgagcaagccgattttgtccgcgcggtactgggcgacaccgaagacacctggggccaggtgttcaaggaaaatgggttggtctacaagaacccgaaactgattctgttccgtggccgggtgaattccgcctgcggtggcgcgacctcagccagcggcccgttctactgcccggctgaccagcaagtgtatctggacctggatttcttccgggaaatgtcgcaacgcttcaaggccgccggtgatttcgcccaagcctacgtgatcgcccacgaagtcgggcaccacgtgcaaacgctgctgggcatctcggccaagattcaagccgcgcgccaacagggccggcagatgcaaggcgacggcggcctgctggtacgccaggaactgcaagccgactgtttcgccggtgtgtgggccaaccgtgcgcaaaagcgcctgaactggctggagcccggcgatattgaagaagcactgaatgcggccaacgccatcggcgatgaccgtttacagcaacagggtcaaggccgcgtagtgccggactcgtttacccacggcacctcggcacagcgggttcgctggttcaagaccggcttcgcccagggccagatcactcaatgcgacacttttacagcgaagagtctttagatgaataaacgattgggtctagtgctgagtttgatgattgcctgttcttcctccacctgggctgccgaaaaagaacacggcgtcaaagtggtcagtcccgatcgttttcaactggatgccggcgccctcagcctgggcttgagccaggactggagccagccgctgcccaacgtcacccgcgcactgatcatcgtgcacggtcgcctgcgcaatgcgcagacctacctgcaaagcggtgaagacgcggccagcgctgccggggttgctgccaacaccctggtgattgcgccgcagtttctcaatgagtcggacataaagcgcaaccacctcgacaaccaggtgctgcgctggaacggcaatgactggatggccggcgacccctccaccgggccaggccaggtcagctcctacggcgccctcgaccagatcatcaagcacctgggcaaccgcaagctgttcccggctctcaaagaaatcgtggtggctggccattccggcggtgggcaagtggtgcagcgtttcgccctcaccggccacgaccacccgatgctgcaaaccgaaggcatcagcctgcgttatgtggtggccaacccgtcgtcctacgcctacttcagcccacagcgcccggtgaaattcgacgcggccagttgcccaggcttcaacgattggaaatacggcatgcaaaacctgccggactacgccaagggccagagtgcacaacagcttgaacaggcttacgtgtcacgcaacatcacttacctgctgggccagcaagacaccgacccgaaccacccggcgctggataaaagctgcgaagccgaaacccagggcgcgtatcggttgattcgtgggcacaattactttgattacctcaaggcgcgccatccgcaactgacccagaagctggttgaagtgccgggggttgggcacgatggggacaagatgtttacttcacctgagggtgagaaggtgttgttccctaagtaactgacacgtaagagttaaaaaggtgggagctggcttgtgtgggagctggcttgcctgcgatgcaaacacctcggtctaccagacataccgaggtgttcctatcgcgggcaagccagctcccacacaggcccgctcccacctttgatcttcagtgtctgggttagatcatccggcgcaaaaccgcgcaatccgccgcatgccaatccgccaactccggccacgggttctcaggcaagttcaccaacaccgtcctggtccccgccgcccgcccgcaatccaggtcaaagcggtaatccccgaccatcaccatctcactgggcgacactgcccacgccgccgccaatttcagcaacccacccggatccggcttgggcggcgcatcgtcacggcccaacacatcctcgacggcaaagcagtccgccaggccaatcgcctccagggtgatatgcgccaactcccgcgcattacgcgtgaggatgccgaggcgataaccgcgcccggccaattcgcgtaccagttccaccgcgccatcggccgcaatagaacccagcgccagttcgcgctcatgctccagcagccaggcatgcttggctgctgcaacgtctgccggtaaagctgccagatgggtgaggatgtcatcctcgggcggaatctccagcgccacgcgaatcgcagcaaaatcatgcacggccaccgtgagggtgccgtccatgtcaaacacccaatgcttaacgtccgacaggctcatgcccaatccttgcgatggcgaatcaagccttcctgggtcaccgacgccaccagttgcccggcgcggttgtacacgctgccacgcgagaaaccccgcgagttgccggcccacgggctgtccatcgcatacagcaaccagtcatcggcgcgcaggtcagcgtggaaccacagcgcatggtcgaggctggcgacctgcatatctttctgccacacggtcttgccgtggggcagcaacgaggtggtcaacaggccgaaatccgaggcgtaggccagcaggtatttatgcagcgccggcgcatcagccaaggcgccgtcggccctgaaccacacgtatttgaccgggtcggacggctgcgggttgtacgggtctttttccgtcaccgggcgcacttcgatcggcttggggcacagcaacttgtcgcgcatgtgctcaggaatcaggtgcgcacgctgcttggtcagttccagctccgacggcaggttttccgggccgactaccacgggcatggtggtctggtgctcaaagccttgctcgtcgtactggaacgaggtggtgcaggtgaaaatcgggttgcccttctggatcgccgtcacgcggcgggtgctgaagctgccgccatcgcgcacgcggtccaccgagtacaccaccggcaacgatgcatcgccggggcgcaggaaataaccgtgcagggaatgcacatgccgcgcttcttctacggtctggctggccgccgacagcgactggccgagcacttggccgccgaacagctggcgaaaacccaggtcctggctgcggccgcgaaagaggttttcctcgatcggctccagggtcagcaagtccaccagatcttccaatacttggctcatagagcaactcctacaacaatcgatagggcattccgggctgcttatccgtgcagcgtgtccaaccattgggcgcgggtgatgcggtacaaaacatgatggcgcagcgggtcatcggctgcgaccttggggtgttcaaaatctgcctcgggatcgtaatgcataccgatggcctgcatgactttttgtgatggcagattggtttcggtggtaaaggcgaggatttcatccaattgcagccggtcgaaaccacagcgcagcgctgtccaggccgcttcgctggcgtaacccaggccccaatgctcgcgagccaggcgccagccgatttctaccgccggggtgaagtccgcttcaaagctgacattttgcagcccggtcaggccgataaattcgccagtgtccttgcgctgcaaggcccacaggccaaagccgtattcagcgaaatgcccgcgaatgcggccaatcaacgcagcgctttccagatggctcagcttggccgggaaataacgcatcacctgcgggtcggcgcacatgcgcgcaaattccgtcaggtcgctgtcgcgccattggcgcagcaccagccttgcgctttccaattccagtatcggctccatgggtccccctcccttgccatgtgcgtgagtgtacagcgctggtaagatccttcgcaggttcccgtcagaaaatcccatgcccttgccattgatctaccacgatgactacagccccgagttcccggcggaccaccggttcccaatggacaagtttcgcctgttgcgcgatcacctggtggacagcggcctgaccgaggaccgccaactgctgcgccccgaactgtgcccgcccgagattctggccctggcccacgacgctgggtacatcgaacgctacatgggcggcgagttgtcccgcgaagaccagcggcgcctcggcctgccgtggaacgaagccctggcgcggcgcaccgtgcgtgcggtcggcggctcgatactcgccgccgaacaagcactggaacacggcctggcctgccacttggcgggcggcacccaccacgcccactacgattacccggccggcttttgcatcttcaatgacctcgcggtgatcagccattacctgctggccagcggccgcgttaaccgcgtgctgatcttcgactgcgacgtgcaccagggcgacggcaccgcgcgcatcctccacgacacgccggacgccatcaccgtgtcgctgcattgcgaaaagaacttccccgcgcgcaaggcccagagtgactgggacatcccactgcccatgggcatgggcgacgccgattacctcaaggtggtcgacgacgcgctcaactacttgctgccgctgtaccagcccgacctggtgctgtacgacgccggcgttgatgtgcataaagatgacgccctcgggtacctcaagctgacagacgcaggcgtcgccgcccgtgatgaacgtgtgatgcgccactgcctgggccgcgacatcccggtgatgggcgtgatcggcggcggctacagcaaggaccgccccgccctggcccgccgccacggcatcctgcaccacagcgcccaacgggtgtggacgtcatcaggttgtcattgaagtgtgcgcgttacccacaatgcctgtggaacggcctgtggataacttgagcgtaagggcctgaaagcgagtagccgtatggcctgtaggaaagtgtacgttttttgatcaggcagctacaccgctgtcgggtagaatgctcggcctattcagcgaccgcagccttgcccatgcctcagacctcttctcaacacgtcactatcatcggcggcggccccgccgggctgatggccgctgaagtcttgagccaggcaggcgtgcgcgtggacctgtatgacggcatgccgtcggtggggcgcaagttcctgctggcgggcgtgggcggtatgaacatcacccactcggagccatacccggcgttcctgtcgcgctatgccgaacgcgcgcctcacatggcgccgttgttgcgggcgtttggtgccgacgccttgtgcgaatggattcatggcctgggcatacaaacctttatcggcacctccggccgcgtgtttcctaccgacatgaaagccgccccactgctgcgcgcctggctcaagcgcctgcgcgaccaaggcgtggttatccacacccggcatcgctggctgggctgggctgctgacggcggcttacttatccacagcccggacggcgagaaaactgtccacagcgatgcggtgctgctggccctgggcggcggcagctggtcgcgcctgggctccgacggcgcctggctcaagttgctggaagacaaaggcgtgccttacgccgcactgcagccgagcaattgcggcttcgaggtgtcagcctggagtgaattgatggtgagcaaattcgctggcgcgccgttgaaaaacgtcgccatcggcctggcggatgacaagcctcggctgggcgaatgcgtggtcacggccaccggcatcgaaggcagcttgatctacgcgctgtcggcgtcgattcgtgaagccatcaatcgcgacggctcggccacggtgcacatcgaccttctgccgagcaagccactggacaaggtgcaggctgccttggccaagccgcgtggttcgcgctcgatgagcaagcatttgcacagccagttgggcctggacggggtcaaggctgcgctgctgcgcgagttggcgcccgcagaacacttcaatgacccggcgcagctggcggtggcgatcaaggcgctgccgctgaccttggtgaagacgcggccgctggatgaggcgatcagcacggcgggtggcgtgccatttgaggcgctggatgagcggttgatgctcaagcaattgccgggggtattttgtgccggggagatgctggattgggaagcgccgaccggcggctatttgctgacaggctgttttgccagcgggcaggcggccgggcgaggcgttcttgagtggctggccttgccccactcaacaacagaacgccgcgtagtggggataccaattcaggaatgacccacacctggttttactgcaagggttgtctcaggccaccacgatacaacggcaaatctgctttttgtttcgcgcgtaacgccataacggctgcgcgcagactctcattaccctgctgccaaacgttgagcaaatgctcatccatcggaaatcgttctatcgcctcctccgaagccggttgagtgggtggccgatagacaggctctaacgcttcacgctccaagtcgtccaaatacgtttttctcaccttatacaccctccgctacagaactattccacctgcacgatcaattgttaatggggtatttataagccttgtaactagcaccaaacttgttctcccactctttaatattaggatcgtctgcccccagtaacgttatcaacttatcgataaattcactctgcacctggtagggctcatcaccgctttcgtacaggggggcaacatctttgtggtagttactgagcagtgtttggtactcctttaacgcagtttttcgcatgccatcatatatatcttcacccttcttcctttcttcgggcgagatcttaaagtggctttccctatgatccaggtactccctgtattcgcgaaaagcgggatacagagcccccttatccttaagattcgtcgctccggccagcagctcaccgcttttttgtacagcctgttgatatgcaacggcatccgcggcttttttggccgcggcatccgctgccttactctttctagactcaataacccctacgccagcgcctgtaaccagcaagcccgttgccgcaattatcgcaaacggaaccagaaaaacagccatactcacctctctattgtaattcgatatttacaatagatcagtggcgagtaagaaatctaagttccaaacacttacagggcagttgatgaccaaaagtttctacacagggagaaacacacaaataaatttatacaatcattaacctgtcgtttcgacaccttgcagggcgtcgagtgagcggcattgcaccgctcacttaattcaccacgccttcgttaatcaaacaaaaggcttacttcttcttacgcggccccgtgttaaaaacaggcactttacgcaccggcttaatcgaaggctccgacggcgccacgtcgccactgtccacccacttgcccaaattgcgcttgccaccgccaccacccgaagccttgggcttcttcggcttcttcggtttcttcggcttcttcacgacctggccactggcatcggtgtccggcacacggtgctccggttcgaagtccggctccatcttgcgggtcaaggtctgacgcgtcagcatctcgatggccgacagcatgttcacctcatcggcacacaccagcgaaatcgcctcgccggtattgcccgcccggccggtgcggccgatacggtggatgtaatcctcggccacgatcggcaggtcaaagttgaccaccaacggcaggtcttcgatatccaggccacgcgccgccacgtcggtggccaccagaatctgcacgtcgctggacttgaagcggtccagcgcacgttggcgggttgcttggggtttgtcgccgtggatgccgtcgacattgatgcccaggccctgcaacttatccaccagcgcatccacgccgttacgggttttggcgaacaccagcacctgcttccagcggcccttgcgcatcaggtgcacaaacagctccggcttgcgcttcttgtccaccggcaccacccattgtttgacggtgttggcggcgacgttgcgcgggctcacttcgatgctcagcgggtcgttgagcatctgcccggcgagcaggcggatgtcatcggagaaggtcgcggagaacagcaaggtctggcgctttttcggcaacatgcggtagatgttcgccagctcttcggaaaagcccaggtcgagcatgcggtcggcttcatccagcaccagggtttgcagctggttgagcttcagcgcgttctggcggaacagatcgatcaggcggcccggcgtggcgaccagaatgtcgacgcccttgcgcagcttcatcatctgcgggttgatgctcacgccgccgtacaccgcgtacgtggtcagcggcaggtgctgggcgtattcggcgacgctggcgtgaacctgctcggccagttcacgggtcgggcacaggatcagggcgcgcgccgagttggcggccactttcggcccttccatggtcagcaattgcaggagcggcagggcgaaacctgcggtcttgccggtgccggtctgggccgcggccatcaggtcgcgaccggccagcaccgccggaatggcttgcgcctgcaccggcgtcggggtctggtagccaagcgtctcgagggcgcgcagcaagggttcgatcaggccaagtgtggcgaaagtcatgtgtttaccgtaggaaaaattcagcgcaaggtcgcaatgcgccgcagtttaccttatttccggcttgggcttgcgccactggggcaggctgatcaacagcacggcgctgatgatcaccagcatcgccagggcttcttccatgccgatggtctcgccaacgaacacaatgcccagcaacaccgccacggccgggtttacgtaggcatagctggtcgcggccgccgggcgaacgtgcttgagcaggtacatataagcattgaaagcgatgatcgaaccgaacacagccagataggccaaggccagccaaccttcaatcggcgggattgagtgcaggcgctcaccggtcagcgcactgcccaccagcagcaaggcaccggcgatgatcatctcggccgcactggccatggcgcccgccggcaacggcaagtgcctgctccacaccgagccgaaggcccaagaggccgcagcaaacagcaacagcatcgccccggtcgggctcgattgcaggttggagcccatgttgagcatggcgatgccgataatccccagcaccacgccggcccattccagacgggtattgcgcgcgccccagaaatatccgcacaacaacgtgaacagcggcaccgtcgccaccgccaacgccgccacgccggaggcaacacccgtatgctcggccaccgtcaccgcgccattaccaaaggtcagcagcaaaatgccgatcttggcggcggccttccactgcacccacgttggcgcaggcgccccgcgccagcgcaaatagccatacatcgccagccccgccaccaggaatcgaatcccgccgagcatcaacggtggccagtactccacgccgattcgaatcaccagataggtggaaccccaaatcacatacagcgcaaaaaaagcggcaatcaacggtaagggaaaacgacgtgggccaggcattgggtagctctgcggcagaagaagggaggcttattctagaaaggcagcacgctaaacataagttacaaaacctgtttaaaccgcccgtacacttttcaaaacatggttatgaaggctataaaccgtgcattcgaaagccacgcatcaccggagccttatcatggacaaatacgaccgcatgctcctcagcgctttgctcgaagacggccgcgcttcctacgcgcaactggcccgcacggtaaacctctccgcccccgccgtggccgagcgcgtggccaagctggaagccagtggcgtgatcaccgggtatcaggccaaggtggacttgtccaaaatcggcctgccgatccaatgcacgatcgaactgcgcctgaccaacaacggcagccagaaggtgtacgacgccctcgcggaaatccccgagctgaccgaatgtcatcgggtgacgggcgacccgtgcgtgatcatgcaagcggcggtgggctcgatgccggagctggagaacctgatcaatcgagtggcgaaattcggcttcagcaaaacctcgatcattttgtcgagcgcgatagcgcggcgggtgccgttggggcagttggaagggaaagccacctgacaccgatcgaccgatcgttcccacgctctgcgtgggaataccgccaaggacgctctgcgtccgcttttaaggtcatgacgcagagcgtcacaggatgcgttaccacgcggagcgtgggaacgatcaacgatcaaacaggcaatctacggtgggagctggcttgcctgcgatggcgtcagttgcctcacaatcaagtcgacaatctgcttgatggtcgtgatgtgatcccagtcttcctgagtcgcctgcaggttgaattgccacttgatctgcataacgaagcaggtcaaatcgtcatcaatgatcgtgaaatcatggatgaaatccgtgtgttccgtcacttggcttcggtcgataaaaccaatgatatcgacgaacagttgaatcactttttcggtgatctcagttctcataagaccaaattccttttcgctactaacgccggatcttaattgtttggtggaagtcagcgtttggcgaaaaagaaaccagaagaatccgatattccaacaagactcaacctactgactgttccgatatgtcgcaaaagcccccacgatcgttcccacgctctgcgtgggcatgcagcccaggacgctctgcgtccgctcttgaggtcgtgacacggagcgtcacaggaggcgttcccacgcagagcgtgggaacgatcatcgtaagcgtcagaacccgcgatgcttcttcaaatgctcattgatcttcgccgccggcactttctgcaaggtgcacagcagttcatgagacagttcgcgcaaaccgtgggtacggcgcaattcttcagccagatgcgccgtgaggttggccgccatctccgcatccgccatcgcccggtgagccttgccggtgtggggcagttgggcgaacgaattcagcgtaccgagcttgtggttcggcgccgaaggcatcaaacggcgcgccagcagcagcgagcaggcgaatttttgcaggcgggtgcggcggatcaggcccagttcgaagtcccagaacttctggtcgaacgcggcgttgtgcgccagcagcggcgtggtgccgacgaactcattcacttcgttcatcacccgctcggccggcggtgcactgcgcagcatggcgttgctgatgccagtgagttgttcgatgaaccccggcacgcgcacgcctgcattcatcaggctctggtagcggtccacgatttggccgcgttcaaggatgaccaccgcaatttccgtggcccggcagtggctgctcggggtgatgccggtggtttcaaagtcgatgaccgctatacgttccaaacctgttccaactccgtctgacaattgacttatttgagcagcaacgcgccttcgatcggcacgtagcggctggcggcgcgtatcagtgaattggccgtcagccccggcacgccgtaggccacggcttcgacgccgtgcttttggatgatgcgttcgagcagcatgtcgaaatcaccgtcgccggaggccagcaccacttcgtcgacgtggtcggcggcgtccatgatgtccagggtaatgcccacgtcccagtcgcccttggccgagccgtcagcacgctgaatgtacggcttgagtttcaccgtgaagccaagattgcgcaggatctgctggaattgctgctgcttgctgtcgccacggtcgatggcatacgcatacgcttcgacgatctgcccgcgcgaactgatgtccgcccacagggccgcatagttgaagtggcagccgtaggcctggcgcacggtgtagtagaggttttgtacatcggcgaacaccgcaattttcttcaccgcacttcctcatgacagccaggcgccagcgcccggaaaggcgccagtatgccagccatggggaagtttcagcgaaaaatcagcccggggcgacgaagcgccccggttgagtgcgggtcagacgaaggagtcgtcgtcgccaaaagacgaggaatcgtcggaatagtcgttgtcggcgaagctgtccgaggcattgtcgttgccccagctgtcattgccggcgaacttctggtcgtcgttgccccagttgccgttgtcactggctggcgccggttcttcgcggatgatttcttccacgacttgtggctgttgcgagttgtggctgaacaggctgctgatgccttcagccagcatcacaccaccggccacgccggcagcagttttcagcgcgccaccgaggaagccgctgccaatcggcgcggcgggtgcttgctggggctgctggtaattttgctgcggcgcgccgtagttttgctggggggcaggctgaccgaaagacggccgcgccggttcacgccagccgccggaggatggcgcagcgctttgtgccggctgcgagtcacgggaaccgccgccgaagatgctcgacaggaaaccaccgctgctcggcgcaggttgtgcggcctgagacttggcccgctgcaactcatcctgcaattgctggatctgctgcgcctgttgcttgttctgcgcgtcgaggcttttgatcgcgtgttcttgcaccaggatcgactgggtcatgtagtacccggcggccggttggcgagtcatgtgctccttgatccgcgcttcagccagggcgtcgcggggggctgagtccgtttcggcttgttgcaaccgtgaaaacagtccatcgatcagggtttgctcttcgctgttcatggcgacctcgttagattgccggtagaaatcatgggcctgcctgtaatcaagcaagctacgccctagttatggggctcttgaccgacgtttcaatggtctttacgcaaggtttacgtttgcttacggccggccatgatcggttaaagtgtgggccttgcttttaggcctgtgatgaacctgatgaatccgttagacgtattgcgcgactccttccgtttcaccctgcgcaacctgggcgccatcgtccagttgtgcctgccgttggtgattctcgaagccctgctgcaacaggtgctcgatcacatgctgggcccgaatacgttccccggatcccccatggtggcgagtttgttggtgtacccgctgtacaccggcgccttgatcctgtttcttgacgcgcgtacccgtggcgagtcgccgcgcactaaagatgtgtgggcgatggcgctgaccctgtggccacgtttggccctactgacagccatcagctcgctgctgctcgtgtatgcgttttcgttatattacctgccgggcctgggcctgatggtcatcctggcgtttgccgaatacgtgctggtattacgcggcatgtcggcgttggaggcgataaaggaaagtgtgcgcctgagccgagggcacttctggcgaattctggtgtgcctgctgtgcgtgatgacaccgctattgctgatcaagggcgtcagcgaggcggcctatcctgatcccgcgccgctgctgggcctgttgatcgacagcgcccaaagctttctgcaactgtttacctgcgtggtgatgtttcgtttattcatgctgatcggtggcgatgccgacgcgcggtgatatgctccgtgccattcctggaacgctataagccgagccgatgacccgtttagtgcgcatcaccctgttgagcctgttgatcatcgcgggcctgctcgccgccctgatctacagcctgacctggcgccctgccgacaaagaaaccctgcccgtgagctgcgtcgcgccccgtgcgccgaccctgctgccggggcaggcgctcaaggtcatgacctggaacgtgcaatacctggccggcaaaaactatgtgttctggtacgacaccgccgacggcagcggcccggacgaccgtcctaccgtggaagacatggcctccagcctcgacgaagtcgcgcgggtgatccgcgatgaacaacccgacatcctgttgttgcaggaactcgacgaaaacgccaagccgtcgcactaccaggaccaaatcgcactgttgcaagagcgcctggtcgacctctacccgtgcagcgcccaggccttcgactggaaagccgactttgtgcccaacctgcatatcttcggcagcgtcggccgcaagctggtgaccctcagccgctaccagatcgagcacgccgaacgcctgcaactgccggtgtccccggccaacttcatcagccgccagttccaacccaaacccgcgttattgctgacctacctgccgctgagcgatggcggccaactggccgtgctcaatacccgcctggatggcgacaggcctgggcgttcggcggtgcaggagcaagctaaagccacggtgaaattgctggataagttcgaaggccgtggcacgccctggctgatcggcggggatttcaacttgctgccactggggcaattcctgcgcctggatgccggcaagcgcggccagtattcgccagacagcgagctgcatctgctgtgggataaatacccgatgatcccgagcaacagcgaatccagcggcatcgaccgtgagaaatggctgacgcacttcccgaatgacccgaacgtggatggcccggatcgtacgttggattatttgttttacagcccaaggatcaagcgggtggaggcgaaagtgcggcaggaggatacgctgcgtatttccaatcatttgccggtgatcgcgcgcttcctgttgcctgccgctcaataaccccacaccacaaagctcaatatgtatggggacttttgtgggaaggggcttttgtgggagctggcttgcctgcgatagcatcgcctcggtgaaacagatagaccgagtcgtctgcatcgcaggcaagccagctcccacacaagcccgctcccacattagatctccacaatgcctacttgcgcggtttgatcctggccgtcgcttccgccaccaacgggtcatccggccagtaatgcttcggataccgccccttcaaatccttcttcacctcggcataggtactgcgccagaagttcgccaagtcctgggtcacctgcaccggccgccgcgccggggacagcaggtgcagcttgaccacttggcgcccaccggcaatgcgtggcgtgtccgccagcccgaacaattcctgcaggcgcactgccagaatcggcggctgttcgctgtagtccaaacgcaccgatgagcccgagggcactttcacgtgctggggcgccagctcgtccaggcgttgcggcagcggccagggcagcaggttgtgcaggaagcttgcaatatccaggttggcgaaatggctgaggcgcgagactttgcccaggtagggcatcagccaatgttccaggctggcgagcagcgccttgtcgctgatatccggccattcgctggtgttgccggcgtccagctggcgcagcagcatgacgcgggcctgccattggcgcagttcgggcgtccacggcagcagttccaggcctttgcggcgtacgaggttgaccagtgcctggctacgcgcagactcgtcgaggccggtgagcggttcgcggctgagcaccagttcgccgactttgcgctggcgttcggcgcgcaacacgccttcgcgttcgtcccagtccaactggtcgacattgcgcacttgctcggcaaggaccgtgtcgaacagcgccgggtcaaaatcggcggcgaggtagatacgttcttcgcgctggccctggcggctgccgaggtcggcaatcaccagccagggttgtttcatcaggctgtcggcctcggcgaacagcgcggcgcggccgttggccaggcggtattcggcgccgccggggcggcgttgctgggcgacgcggtccgggtaggccagcgccagcaaggcgccgagccagcgcgggtgatcggggtcggccacggcttgcgtcgcctggcctcttaaatagccacggtattgccgcgccagttgcttggctcgctgcacgccgccttgggtgccgcgcgcacgttcttcgccggacatcagcgccaagcggctgtgcaaatccgcaccgccgccgcgcaggatgtcgcgctcgcccaacagcgcggcaacatcacaggcagtggccgccagcccaaggtcctgcccacgcaacaataaatgggcgatacgcggatgcgccggcaactcggccatcttctggccgtgggcggtgagtgtgtcgtcattcaaggcgcccaggcgcaccagcaaatcctgggcttgggcatacgcggcggtcggcggcacatccagccacaccaactgcgtcggcgtgacgccccaacgcgccagttgcaaggccaacccggcaaggtcggcggcgaggatttccgcgctgccatacgctgccaggccttcatgctggtcttcggaccacagccgataacacacgcccggttccaaccgccctgcccggccggcacgctgggtggcgctggcgcgggagatgcgttgggtgtcgaggcgagtcatgccgctgccggggtcgaaacgcggcacccgcgccaacccggcgtcgatcaccacgcgcacgccattgatggtcaggctggtctcggcaatgttggtggccagcaccactttgcgtttgcccgcgggtgccgggtcgatggcagcgcgttgcgcgttgaggtcgagttcaccgtgcagcgggcacagcaacacatcggggcgatcacccagggcgtcggccagttgttgattaacgcggcgaatctcggcctggcccggcagaaacaccaggatgctgccggtctcgtcgtgcacggcctcaaggatggtctgcactacacgcggctcgataaattcaccggcctgatacggccgaccccagcgcatctgcaccgggaacatacgcccttcgctgcgcaggatcggcgcgtcatccagtagcccggccaggcgttcgccttcaagggtggcggacatcaacaggattttcagcggctgctcatcgcgaaacaaatcgcggccgttcaggctcagggccagcgccaggtcggcgtcgaggctgcgttcgtggaattcgtcgaagatcagcaggcccacgccctccagcgccgggtcgtcctgcaaacgccgagtgaggatgccttcggtgaccacttcgatgcgtgtattggggccgactttgctgtccagacgaatgcgatagccgacggtttcgccgaccttttcccccagctcactggccaggcgttctgcggcggcgcgggcggcgaggcggcggggttcgagcatcaggatggtttgcccggccagccatggttcgttcaacaatgccaggggcacgcgggtggttttaccggcgccgggcggcgcttccagcacggcttcatggcgaatcgccaaggcgtcacgcagggcgggtaaaacatcatcgatcggcaacgaattcatactggctccaaagcagagcggcgagtataacggcgaactgccggatgccggtggtggtctcaaaaacaccgctggcttgcgacatgaatgcagtcaaaggtgggagctggcttgcctgcgataacggtgggtcagccagcccatatggcacacaaacaccgctatcgcaggcaagccagctcccacattggatcatcgtcgtctgatagatctggcttatagtcacccttaaatgtgttcaggagagtcttcatgcgtatcgcttcccgtgtcatcggcggtgtcctcgccgtcaccctgctgagccaattgacggcctgcggttcgatcttctacccggaccgccgtggccagatcgacggcaagatcgacccggccattgccgtgctcgacgccgtgggcctgctgttttatgtaatccctggcctgatcgcgttcggcgtcgacttcgccaccggcgcgatctacttcgagccaggcaagaccgcccaggtcgccccggaaaaactgcgcgaagccatcggcgccgacggcaaggtcgacaacgccaagctgcaaaccatcatccagaaagaaaccggccgcaccttgccgctggatgacccgcgcatgatccagttcaagggcagcgtgcaacagctagcttccctgggcctgcaacccgctgcttaaggaccgttcatgaccagcagtcccgaacacgccaggctcttgcgcctggccacacgcgcgtcggtgggcgtggcgtgtgcgctgattatcaccaaggccatcgcctggtggttcagtggctcggtgagcatgctcgccgggttgaccgactcactgctcgacggcgtgacctcgctgctgaatttgctcgcggtgcattacgcgctgcgcccggccgatgatgatcatcgctatgggcatggcaaggctgagtcgctgtcgggcatggcccaggcgctgtttatcgccggcagtgcggtgctgatcgcgttccaggcgtaccagcgcttgcagcatccggaaccggtcggcgcgccgtggctgagcattggcgtgatcgtgttttcgctggtgatgacggtagcgctgctgatgctgcaacaccgggtgatccgcgaaaccggctccaacgccgtgcgcgcagattcgctgcactatcgctcggacttgatgctcaacggcagcatcttggtagcactggtgttggcgggtttgggctttcatcaggtggacgcgtggttcggcctggggatcgccgcgtacatcttgtggagtgcaatccagatcgcccgagaaagttttgcggtgttgatggacgaagagctgccgccggatgtgagccagcacatgctggagctggcgcggggtgtgccgggcgtgttgggtgcgcatgacctgcgcacgcggatttccggcagccactggtttgtgcagctgcacctggaattgccgggggaattgacgctgtcagtggcccacggcatcagcgaccaggccgccgatgccattcacgccgcctacccgcgcgccgaagtgctggtgcacgccgacccgcgggaagtggtcaccggtaacaaggcctagtactgcacctgatagccacggctggtcaggcagttgccctgagcctggcggtaggtttgcaccaccgccgggtccggggcgtaggtgacggtgcgtgggtcgaacccgctttgctgcacggcccagcgataacaatcgtaaccgtcctgctgcacctgagccggtgattggccgttggccgggtaggccgtcacgtcatacccgttgccctgcggcgcgggttgcggcgccggcacttcggtcggcggctgcaccaccacgtattgctgggtggcgctttcgtaggtgtagtaggaaccggctgcgaggaaaaacagcgcgctgcccacccacacttcccgcgcgtagtccggcaggtattgcacgcgaatgccgtacggcggcgtcaccaccacgtagcgcgggccttgcgggcgataccagtagccgccggagaagaagtaatcctggccacggtaaggcacgcggtaattgcggtcggggaaacggtcgacgatgtagcccgggcggtattgcgggcctgggccccagccgttgccgtgcccattcgggcggcccggccagcggttgtcattggggtggccattgttgaagccgccaccagggcgcgggccggggccattgccgccctgccaatgcgggttgccatcgttgcgacgtgggatgtcctgataatagccctggcgcggttcctgggtttgccgaaccgtgtccggacgcccctggatcggcaggttattcgcaggttgcggcgctggccgaggctgctcggcattttgcgggcgaccttgccattgcccgccgccatggggctgttgctcggcgcggtcgaaatgctggttttgcggacgcggctggttgttttccgggcgcggttgattgttctgcgggcgtggctggttattttgcgggcgcggctgttcgttgccttgccgcccgccttccgggcctctttcatgctgaccgccgccttcagggcgcgggtcgtcggccatcacttgcgtgccgacggtgaccatcagcaaacctacacctgccatacgccagatgcgcttcatgctattcctcactgcggataagggcctagaacgtccggcctcatagatgagactggaaaagcctcgcccggttctgagacaggttatcagtcacgagaagtattttttcggctaaacgcgcaggcaaagaaaaaggggtgacccgtcggccaccccttgagaatttcgtccttgctcaacgcttttgacgttggctcacctcacgccgtcttgtggacagtgtgcagcctggaggccggctcaaccctgctggggcggcggccgcaacgggcctgattgggctcgctgcaagtggactgttgtccaggcggtgattctgttggtaatcataggctcgccgcgccggcagatgattgcgaagattgcgtcaataaacagtgcttgcgcaatttttaacccttcatagataattcgccgcaatagttacgacaaaggccaacccaatgagcaagcttgaccgatacgacctgagtattttggcggaattgcagcgcgacgcgaggatctccaaccaggagttggccgaacgcatcggcctgtcgccttcgccctgctcgcgccgggtcaagcagcttgaagacgatggctacatcgcgcgccaggtcgcgctgctcgaccgcaagatgctcggcttgagcctcacggcctatgtgctgatcggcatggaccgtcatacacccgagcgtttcgaaaacttcgaagcggcgatccgcaccctgccgcaggtgctggaatgcagcttggtgaccgggatggacgctgactatcagctgaaggtggtggtgccggacatggatcactaccagaaactgctgctggggcatttgacccgtattgaaggcgtgaccagcgtgcgttcgagttttgtgctcaaccaggtattgaacagcaccgagctgccgctgacgcacctgcgtacctgatctcaagcacaaagaaaatccaatgtggaaactggcttgtgtgggagctggcaactcggactatcaggcagaccgaggtgacgctatcgcaggcaagccagctcccacattgaccccatcaagactcaggtcaatgctgcgcctggagccctgccttatacttcccgcctgccctgtcggaagaagctcatgaacaacatcgaccccgccctgttcgaagaatggatgatgaccggcctggtcaccatcctgatcatcttcatgggctttatcgtctgggacctggcgaagaaatccaaggccgggcgctttggctcgttcatcctgttcttcgtattgggcctgggcgtggccgcgttcatcatcaagagcgtagtgatcggcctgatcgagtccggcgccttataaacgcgctggcacttccttccattggccctggtccaggccatcaatcgaccagtcaccaatgcgcacgcgcaccagacgcaaggtcggcaagcccaccgcagcggtcatgcgccgcacctggcgattacgcccttcacgaatcaccagctccagccagtgcgtgggcacgcttttgcgaaaacgcacgggtgggttgcgcggccacagttcaggctcgtccaactggcgtgcctcggcgggcaaggtcatgccgtcgttaagctccacaccgtcgcgcaggcgttgcagttgctcctcggtgggctcgccttcgacttgcacccagtaggtttttgccagcttgtgcttggggtcggcaatccgcgcctgcaactggccatcgttggtcagcagcagcaggccttcgctgtcacggtccaggcgcccggccgggtagatgccggggatgtcgataaaatccttgagcgtcgcgcgcccgccttcgtcgctgaactgggtcagcacgtcgaagggtttattgaacaggatcaacttcggctcggccggtggcgccttggcgacgcgacgtgcagcggagtacggaggtttcacgccagggcggcgcgcatcgggacgggtgggacgggacatggcaaaggaacatctaacggtcaggaccgacaatgctagtggcctgaccgctaaatgaccatcccaaccgcttagcggaacggcggctcgtcgaagctgcgcagtttgcgcgagtgcagcgagttgagttcggtgcgcaacaggtcgaccgcctcgatgccgatcttcaagtgctggctgaccgcacgttcatagaacgcgttggccgaacccggcagcttgatttcactgtgcagcggtttgtccgacacgcatagcaacgtgccatacggcacccgcaggcggtaaccctgggcagcgatggtgccgctttccatgtccacggccacggcgcgggacaggttgatcagcggccgttcctgggcccagcgcagctcccagttgcggtcgtcgtaggtcagcacggtgccggtgcgcaggcgttttttcagctcttcgcctttctcgccggtgacgttggccgccgcttgttgcaaagccatctgcacttcggccagggccgggatcgggatgttcggcggcaccacgcggtcgagaatgccgtcgcggcgcatataggcgtgggccagtacgtagtcgccgatggtctgggattggcgcaggccgccgcagtgaccgatcatcagccagcaatgcgggcgcagcacggccaagtggtcggtgatgttcttggcgttggacgggccgacaccgatgttcaccagggtcacgccgtggccgtcgctggcttgcaggtggtacgccggcatctggtaacggtgccagaccacgcccgcagcaatcgccgaggcttcgccgtggtccatgctcttgtcgataatcacgttgcccggcaacaccatgcggataaaccgtgggtcgctgcgcaattgctccaggccatgcaggatgaactggtcgacatagcggtggtagttggtcagcaggatccacggctgcacatggcgccagtcgctgccggtgtaatgcaccaggcggcgcagggagaagtccacgcgggcggcatcgaacagcgccaggggcagcgggtcggtgttttcccagtcatagaggccatcggcaatgccgtcggtggccgcggacaggtcggtgctggggaacacgcgcgccagggtcgcggcggtgacgccggagccggccagttcatcgccctgctcgacgacgtacgggtacggaatgttctgttggctcacgccgacttcgaccgtgacggtgaagtcgtgcatcagcggcaccagttgttccagcaggtatttacggaatgctgcgggatgggtgacggtgacgctgtaggtgcccggcagttggaccttggcatacgcgcgggtggtctgtgggacttcgccgtggcagtggtaggtcaggcgcagttccgggtagcggaacagtgcgcgttgttcggcgtcgggctcgacgcggtccttgaggtattgcttgagggcttgattgagcgcgccggtagcacgctcatgaagagccgccagccgatccacggcttcttcggcggtttgaacgacaacaaaagcttcggtcacggtaagcatcctgtgttctgacttgcaggcctttatcttgcctgtatccctgtcagacgcaaactctgaattggagtgccctctcaagaggggtgcaatccctgtgggagccgggcttgcccgcgatggcggtgggtcattgatttatgtgggagccggcacaccgctatcgcaggcaagccagctcccacattttgaaccctggttactcagaaggattgggggttgagcgggcgacgatcgcctcaacatccacgccacgcggcaaggtgccatacacccggccggacgactcacccaagcggctggcaataaacccatcactgaccgccgcattcccggcctccagcaacagcttggcctgcagcgccacggcaatgtcctcggtcaattgccgcgcacggtattgaatatcctgggtatccataaacgccgacttgagctgctcgatatgccgcgccagttgcttgtcgccatgcccgtcgcccagttcgacaaacagcgtctccagcacgcccggctctttcgacagcgcccgcagcacgtccaggcactgcacattgccggaaccttcccacgtcgaatttaccggcgcctcacggtacaggcgcggcaggatactgtcttcgacatagccggcaccgcccatgcactcggcggcctcgttgatcatcgccggcgcgcgcttgcagatccaatacttgcccaccgccgtcaccagccgggcgaatttggcttcctgctcgttatcgaggtggtccagcgcgcgccccatgcgcatgctcaaggccagcgcggcctcgctttccagcgcgaggtcggccaacacgttttgcatcagcggctgttcgttgagaatgcggccaccgaccatacggtgcgcgcaatggtggctggcctgggtcaacgcctggcgcatcaaggcgctggagccgaccatgcagtcgaagcgggtcatggcgaccatttcaataatggtcggcacaccacggccctcttcgccgatcatccaggccagggcgccgcgaaactccacttcgctggaagcgttggagcaattgccgagtttgtttttcaagcgctggatgtagaactcgttgcgcgtgtcgtccgggcggtgccgaggcagcaggaaacaggtcaggcctttgtcggtctgcgccagggtgaggaatgcatcgcacatcggcgccgagcagaaccacttgtgccccaccaactcataggcttgcccggggccgcccgcgcccaccggatacgcacgggtggtgttggcgcgcacgtcggtgccgccctgcttttcggtcatggccatgccgatagtggcgccggccttgtgggcgatgccgatattgcgcgggtcgtattcggtattgagaattttcggcagccaggactgcgccaggtccggctgcaggcgcaaagcgggcacgcaggcgaaggtcatggtcagcgggcaaccggtgccggcttcagcctggctgtgcaggtaggtcatggcggcgcgggccacgtgggcgccggactgcggatgcgcccacggcagcgacggcaggccatgttcgacggcggtgcgcatcaactcgtgatacgccgggtgaaactccaccaggtcaatgcgatggccaaaacggtcatggctgttgaacaccggtttattctggttcgccaggaacccggcttccatcaacggcccgcctgccagcgcgccataggcatcgatacgcgcctcggcccagccggcgccgaagcagcgcgaccactcttgcaggggcaagtcgatgcggtacaggttggtgccgtccagggacggtggctggttggtgacgtcgtgggtttcggcgaacgggtgcaggttcatggcaggcctcctggaaaaaaggccacgtacagttgaggccagaatttcagttaagcaccgtcacagggcttaaaaaagtggcatacctgcctaatgttcggcgctttcgccctctaacgggcacagtaaacggcgctccagtacggcctgcaacgcgtcaaaacgcacgggtttggcgagccggtcggtgattccgatgccatggcagcgctcacggtccgacacattcagtgacgcactcagggcgatcaccggcagttcaccgcaaccgggcaaagcacgaatctgacaacacaacgagaaaccgccttcaggcacatccagcagtaccgcgtcgaaggttgcattctgcaagagcgccagcgcggagggtccgttgtccaccgttttcacccggtagcccaacttgagcagcatgccgcgcaccgccagttggcccacgctgttgtcgtctaccagcagcaccgtgcactcatggggcgcgcgttgcgtgagggggtcatggggctgcgcctttggctcgggcggcagcggattcacgctcacgtccaactgaaaacggctgcccttgcgtggctcggaatgatgagtcaggcgcccacccagcagctcgatcagttgtcggcaaatcgccaggccgatgcccaggccgccgtattcgcgagtcatcgagccgtccacttggaagaagcgctggtacagcgtggcctcgtcgaggaaagcgaaaccgataccgctgtcggtgacgataaagctcaggcgcaggctgccgtcgctgtgtggaacaccgaccacacgcacgcgtacggacccgtcatgggtgaacttgaaggcgttgtcgagcaggcagtcgaggcactggatcagttttccgtcgtcgccgatcacgcggtccggcagctcatccgcgacgtcgatggaaaattccaaccctttgctctgcgcgctggcgctgaactgctggcgcaaggtgtcgagggcgccgcgcaagctgaacacctgcggctgggcggtcaggcgcccggcttgcaattcggtcagggtgagaatgccgttgaccatgcgcatcatgtcccgcgccgagccggcggcggtttgctggtactgcgcgaggtcgtcgtccagcggcacggtttgcatcaactccagtgagccgatgacgccgttcatcggcgtgcgcaattcgtgggtcagggtggagaggaattcgtccttgaggcggttactgcgcgcgagttgctggttgagcacttcgagtttctggctggcgtcgaacaggatctgcgcctgctgctcacgcatgccattgatacggtctgccagggccagggacagcagcgccacttcgatggccgagccgagctggctggcgtacatggtgaggaacatattcggcagatagcccagcaccatcatcgtgttgaccaccccgcccaacaggaatgccgaccaggcgatgatgaaatagcgcgccatgcgctggccgcaataccaggctttgatcgcggcaacaaagatggtcacggtgaacaccagcgccaagccggtggccaggcgcagggccacggcatagctggtcagcagcgccagcaccatcaccactgcgccgcaggccgccagcgcaagcaagatgcggtcgagccaacggctgtgttgcgcggtgtgcaggaagctgcgcgcaaacaggctgccgaacagcgccgccgacccgatcaggaacggcaccgccgcattcgcccaccacgggttgttgggccagaagtactccacggccacgccattgacggatagctgataaaggccgaacgaggcgatatagaggatgtaatagaggtaactggtgtcgcgcacgctcaggtagatgaacaggttgtagaccagcatccccagcaacacgccatagatggcacccaacacatacaggcgcagcggttgttcttccaggtaagcagtgccggcccagagcgtcagcggcgcctggatcgagccttcgctttgcaggcgcaggtacaccgtttgttgttggtcgggcacaaagttgagcttgaacaggtagttgctctggcgcacttcccggctggcaaaaggcagtgcgctgccggtgcgcgtggtcagccggtaattaccggtgccgtcgttctggtacaggtcgaggcggttcagcggcgggtacgccaactccaggaaccaggtgcgcggggcgcgagggtccgtggcggtgtaatgcaggtcgaccttgagccagaacaccgagcgcgaatagccagcattgagggtggctttatcgtgggtcttgaactgggcggcgtaggcgggagaactgacttgggcaatggtgagggcgtcggtagggtcttcgagcacttgcatgacgcgacccagcggcaggcttcgagtgctctgattgaactcgacggcgccggcgagcatcggcagcccgcacaaaaataaaatcagcaaatagcgcatagagccccagcgtggcctgtccggttaggtcaaaagccccccattccttttgagtagacgtaaaccggcgatatcgtaagttgtttggatccactctagcatagccgctagaggccattagacaccattgataaaattttttgaaaggctctaggacgaggctttcagcgaattttcgaacaccgctccatgctagcaaaccgccacaatcccacgtaaacattgacgcaattgaacctgcgccagacggccacgcaaaaagcgtttggtggtaagctcgcgcaccatgaatatctacagctctcgccctgttgttctctgtctctccggccatgatcccagtggtggcgccggcttgcaggcagatatcgaagccctgctcgcccaaggctgtcatgcggctccggccgttaccgccctgaccgtgcagaacactgtcaatgtcagcgatttccgcgtgctcgaccgcgagtgggtactggcccaggccaatgccgtgctcagcgattccgaagtggcggcggtcaagctcggcatgctcggctctaccgcgatggtcgacaccgtggtcgagctgctgcaggcgcacccgcacctgccggtggtctgcgacccggtgctgcgcgccggtggtggcggcagcctgggcaaggacgaggtcggctacgcgatgcgcgagcggctgttgccgttgtcgctgatcgccacgcccaacctgcctgaagcgcgcatcctcgccgagttgcctgaaggcacggcggacgaatgcgccgagaagctgctgccgtttatcaagcacctgctgatcaccggcggccacggcgacgagcaccaagtgcacaatcgcctgtacagccgcgacggcacgtgccagacctttacctgccagcgcctgcccggcagctatcatggttcgggctgcacgctggcgagcgcactggccggtcgtatcgcccagggtgaaggcctggtcagcgcggtgcaaacggcgctcaactacacttggcgcacgttgcgtgacgccgaacaactcggccagggccagttcgtgccgcgccgtttgccgctggatttctgctcttaaagcaaaagaggcctgcccgatgaaactacgtggcctgtatgccattaccgacagccaactgttggccggcaaattcctcgcttacgtcgaagcggcgttggacggcggcgtgaccctgctgcagtaccgcgacaaaagcagcgacgaagcccgtcgcctgcgtgaagccgagaagctgcgagagctgtgctcgcgctacaagacccagctgattatcaacgacgacgccgaactggccgcgcgcctgggcgtcggcgtgcaccttgggcaaaccgacggcccgctgaccccggcccgtgcgttgctcggttccaaagcaatcatcggcgccacctgccacagccagatcgaactggccgaacaggccgccaaagagggcgccagctacgtcgctttcgggcgcttcttcaattccaacaccaagcccggcgcacccgccgccaccgttgaaatgctggcccaggcccgcgcgcgtttgcagctgccgatctgcgtgatcggcggcgtcaccctggagaacgccgaacccctggtggcccacggtgccgacctgctcgccgtggtgcacggcctgtttggtgccgacagcacccaggaagtcacgcgccgcgcccgcgccttcaacgatcttcttaaaatttcagtttagagagcccgaccatgtcccgttccgaaaccctgtttgccaatgcccaaaaacacattcccggcggtgtgaactcccccgtgcgtgcgttcaagagcgtgggcggcacaccgttgttcttcaagcatgccgaaggcgcctacgtcaccgacgaagatgacaagcgctacgtcgattacgtcggttcgtggggcccgatgatcctcggccatagccacccggacgtgctcgacgcggtgcgccagcagctgcaacacggtttgtcctacggcgccccgaccgctatggaaaccgagatggcggacctggtctgctcgatcgtgccgtcgatggaaatggtgcgcatggtcagctccggcaccgaagccaccatgagcgcgattcgcctggcccgtggtttcaccggccgcgacagcatcatcaagttcgaaggctgctaccacggccactccgacagcctgctggtgaaagccggttccggcgcgctgacccaaggcgtaccaagctcggctggtgtaccggcggccttcgccaagcacaccctgaccctgccgttcaacgacatcgccgccgtcgagcagatgctcagcgaagtgggccaggaagtagcgtgcatcatcgtcgagccggtcgccggcaacatgaactgcgtgccgccggcgccgggcttcctcgaaggcctgcgcgagcagtgcgacaagcacggcgtggtgttgatttttgatgaagtcatgaccggtttccgtgtcgccctcggcggcgcccaggctcactacggcgttacaccggacctgagcactttcggcaagatcatcggtggcggcatgccggtgggctgcttcggcggcaagcgcgaaatcatgcaacacatcgcgccactgggcccggtctaccaggcgggcaccttgtcgggtaacccgctggccatggctgccggtttgaccacgctgcgcctgatcagccgcccgggcttccacgccgagctgaccgactacaccactcgcctgctggatggcctgcaacagcgtgccgatgcggccggcatcccgttcgtgacgacccaggcgggcggtatgtttggcctgtacttcagcggtgccgacgacatcgtcaccttcgatgacgtgatgggcagcgatgccgacctgttcaagcgcttcttccacctgatgctggaaggcggtgtttacctggcaccgagcgctttcgaagccggttttacctcgatcgcccatggcgacgcagagctgaaactgaccctggatgctgccgagcgcgccttcgcggccctgaaataaacggccaatccgtctgacgttgcccttggtggcgtcagatttgctactttgcttacagagacttcctaagttttacgagaaattacctgcaattgggcagataacttgcccacgcagcagaaaaacgagtaaagactttgtaagcagaggcctgcttatttcataatgcgcgcttattggacccccgagggtccgcgcgccccgtcagaggtaagtcgattcccatgaaacgcaccggccgcaccctggttctgggctgcctgttgctccttcagccgctgctggcacatgcacaagcaggcggcaactcgttgttaatcccagcgatgggtcgttgcaccctcaatacccagccagacagccaggccgaagccctgagcgcgtgccagaaacaggccgatggcggggatgcgcaggcgcaatacgagttgggcgagtactaccacgacgacaaaaaccccgcccgcgacctcaacaaagccttgagctacttcgagaaagcttcgttgcagggccacgcccaggcgcaattccagctgggcaacatgttcttcaaaggcgaaggcgtgccggccaataacgtccaggcctacatcgtgctgaaaatggctgcggtcaacggcgccgaagacgcgctggacaccgccgacgaagtcgccgaacacatgcagcgcgatgagttggaagtggcgacccaggtgctgggccagatcttccgcaattacctgcaggaattgcagagtgccgatgggcgctcgccgttctcgcccctgccctgaatcttcagtgcctttgaaggcctcttcgcgagcaagcccgctcccacatttaattgcattccaaatttggaactcggtcgaatgtgggagcgggcttgctcgcgaagggagcgacgcggtctaacgccctacttctcaggcatcggcatcggaaacggcatcacattgctggtgccacgcgcttcactgatcttcggcgtgcccaggcgctcgacttcgtcgatgcgcacaatcgaatgcatcggcacaaagctgcgcaccacgccttcaaactgcgccttgagcttctcctcgcccggatcgacgaccaactgggtgcgctcgccaaagacgaattcttccacttccaggaaaccccacagatcactttgatagatctgcttggcgtacatttcgaacacctggccctggttaaggaaaatcaccttatagattggagcttcacgtttggtcatggtgggcggataacacatcggggatataaaagagggcgcgaactatagcatggcacccgatgcacaacgctaggaaccaatggacatgccccctataatgcgcggttctttaccaccagttgacgattcccatggccaagaagctttacatcgaaacccacggttgccagatgaacgagtacgacagctcgcgcatggtcgatctgctgggcgaacaccaggccctggaagtcaccgcccgcgccgaagatgccgacgtaatcctgctcaatacctgctcgattcgtgagcgggcccaggaccgtgtctactcgcagctgggccgctggcgtgaattgaaactggccaacccggacatggtaatcgccgtcggcggttgcgtggccagccaggaaggcgccgcgatccgcgaccgcgcgccctatgtcgacgtggtcttcggcccgcaaaccctgcaccgtctgccggaaatgatcgacgccgcgcgcatcaccaagctgccgcaggtggacgtgtcgttcccggaaatcgaaaaattcgaccatttgcccgagccgcgcatcgatggcccaagcgcttatgtgtcggtgatggaaggttgcagcaagtactgcacgttctgcgtggtgccctacacccgtggtgaagaagtcagccggccgtttgatgacgtgctgtcggaaatcatccacctggccgaaaacggtgtgcgcgaagtgacgctgctgggccagaacgtcaacggctaccgtgggcagacccacgacggtcgcctggctgacctggcggagttgattcgcgtggtggccgccgttgatggcatcgaacgcattcgctacaccacctcgcacccgctggagttctccgacagcctgatccaggcccacgccgaggtgccggagctggtcaaacacctgcacttgccggtgcaatcgggttcggaccgcattctgtcggcgatgaagcgcaaccacaccgccctggaatacaaatccaaactgcgcaaattgcgtgcggcggtgccgggtatctgcatcagctcggactttatcgtcggtttccctggcgagaccgagaaagacttcgaacagaccatgaagctgatcgaggacgtcggtttcgacttctcctactcgtttgtctacagccaacgcccaggcacgccggcagccgacctggcggatgacacgcccgaagcgctgaaaaaagagcgcctgaatgcactgcagcatcgtctgaaccagcaaggcttcgagatcagccgacaaatggtcggttcgatccagcgcatcctggtcaccgactattcgaaaaaagacccgggcgagctgcaaggccgtaccgagaacaaccggatcgtcaacttccgctgcgacacgcccaccctgatcggccaatttgccgatgtgcacattgatgcggcgcaaccgcactcgttgcgcgggtcgttggtcaactgatcgctctgacctgataaagatcaaaatgtgggagctggcttgcctgcgatagcggtgagtcagccaatacaactggcactgatacaccgctatcgcaggcaagccagctcccacagtggatcttcagggttcccgagatcgaaaccagcccatttaagtgctttcgcacctcggccactggcgttatcctctctttcacctcaacagccaaagggcggctaaaagcgaccttgaacgcacccatagaaccccatcgttttctcctcgagccgtttgaggctcgccgtttcgccaacctgtgcggacagttcgacgagcacctgcgcctgatcgaacaacgcctgagcatcgagatccgcaaccgcggcaatcagttcgagcttattggtgaaccccaacacaccacgtctgcagaaaacctgctccgccgcctctaccgcgaaaccaagggtagtgagctgtcgccggagaccgtacacctgtacctgcaggaatcggcggtggaagatttggccaacaacccggtggctgaagccagcgtggccctgcgtaccaaaaaaggcatgattcgcccacgcggcttgaatcagcagaagtacgtcaaggaaatcctcggtaacgacatcaacttcggtatcggccctgccggcaccggcaagacctacctggccgtggcctgtgcggtggacgccctggagcgcgagcaagtacgccgcatcctgttggtgcgcccggcggtcgaggccggtgagaagctcggcttcctgcccggcgacctggcccagaagatcgacccgtacctgcgcccgctctacgacgcgctgtacgagatgctcggctttgaatacgtggccaaattgatcgagcgccaggtgatcgagatcgccccgctggcctacatgcgtggccgtacgctgaacaacagcttcatcatcctcgacgaaagccagaacaccaccgtcgagcagatgaagatgttcctgacccgtatcggtttcggctccaccgccgtgatcactggtgacgtcacccaggtcgacctgcccaagggcaccaaatccgggctggcgcaggtgattgaagtgctcaaggacgtgccgggcatcagctttacgcacttcatgcccaaggacgtggtgcgccacccgctggtgcagcgcatcgtcgaggcctacgagcgtttcgatcacaaagacgacgcacccgccaaggacgttcgccgcgatgcttgagcttgacctgcagttggccaccgaagcgcccgcccccagcgaagctcagttccgtcaatggtgtgccctggccctgcgccagcgcaccgccgactcggagctgaccatccgtctggtggacgagcccgaaggccgtgaactgaatcacacctggcgccaaaaggattacgcgaccaacgtgctgtccttccccgccgacgtgccggatgagttactggatatcccgttgctgggcgatctggtcatctgtgtcgaagtggtggagcgcgaagccagggaacaaggcaaggaacttgaggcgcattgggcccatctagtcatccacggctgcttgcatctcttgggttacgaccatatagacgatgacgaagccctggaaatggaaacactggaacaaacgttgcttgctgaattgggtcaccgcgacccgtatgcagacgacgaaaactgaaactacaccttactgacacaacaaaggatttagagtaatcgctatgagcgaagaccgatcgagcaacgggcagaagtcatggctgggtaaactgacccaggcttttgcccacgagccgaaaaaccgccaggagctgcttgagctgctgcgcgaggcccatcaaaacaagttgctggacagcgaagcgctggccatcgtcgaaggcgccatccaggtggctgacctgcaagtccgggacatcatggtcccgcgttcgcagatgatcagcatcaaggcgacccagaccccacgggaattcctcccggccgtgatcgactcggcgcactcgcgctacccggtgatcggtgaaagccatgacgacgtcatgggtgtcctgctggccaaggacctgttgccactgatcctcaaggagaacggcgacaacttcaacatcaaggacctgctgcgcccggccactttcgtgcctgaatccaagcgcctgaatgtgctgctgcgcgaatttcgcgccaaccacaatcacatggccattgtgatcgacgaatacggcggcgtggccggtcttgtgaccatcgaagacgtgctggaacagatcgtcggcgacatcgaagacgagcacgacgtcgaagaagacagctacatcaagccgctgcccagcggtgatttcctggtcaaggcactgacgccgatcgagaacttcaacgagttcttcgacagcgaattctccgacgatgagttcgataccgtcggtggcctggtgatgagtgcgttcgggcacctgccaaaacgtaacgaaaccaccgagattggcgcgtatcgcttccgcatcctgaatgccgacagccgccgtattcacttgattcgcctgacacctattgcccgctaaggaaggggtgggtcatcagctatttcctgtgtcgcgttgccccttagagctggccaggcaaggcgcaggccgcaggaaatggcattcccttttcaaggcctgcaacgcagcatggcccgttctaaggagcaacccgaagggccgggcctgctgcgacacaggaaatagctgatgacccacccctacatgcgccgtttgatcgcacccggctggcccggtaacttgctggccgtggtggccggcgccatcaccaccctggcgctggcgccgttcgatctgtggccatttgcactggtggcggtcggattgttctatatcggcctgcgcgagctgaccccacgccaggccctgggccgtggctggtgtttcgggtttggcctgtttggcgccggcaccagctggatctactacagcatccaccatttcggcggcgcttcggtgctgctggctggcttcctgatgctgctgtttaccgccgccattgcctggttcttcgccttgcccgcctggctgtgggcgcgctggctgcgccgcaatgaagcgccgttggctgacgcgctgacatttgctgcgctatgggtcggccaagaggcatttcgcggctggttcctgaccggttttccgtggctctattccggctacagccaactcgacggcccactcactggcctcgcgccgctgggcgggatgtggctgatctcctttgccctggcgctgaccgctgccgtgctgtgcaacttgccgcgcctgttggcgagcaagcgcaacggctttatcggcgcagggctgttgctgctggttgcgccgtgggccatcggcctggcactcaagcatcacgcctggacctcgccctcgggcgccccactgacggtggcggcgatccagggcaacgtcgaacaaagcatgaagtgggaccctgaacagctcaatgcgcagctcgcgctgtaccgcgacatgagcttcagctccaagcctgtcgacttgctggtgtggccggaaacggccgtgccggtgctcaaggaatccgtcgagggctacttgggcatgatgggcaaatttgctgccgatcggcactcggcgctgatcaccggcgtgccgattcgccaggaagtgcaccaccagaagcgctacttcaatggcatcacggtggtcggcgaaggcgaaggcacttacctgaagcagaagctggtgccctttggcgaatacgtgccgctgcaagacatgctgcgcgggctgattgccttcttcgacttgccgatgtcggacttcgcccgtggccctgccgatcaggcgatgctgcaggccaagggctatcagattgcgccgttcatttgttatgaagtggtgtacccggaattcgctgctggcctgtcggcccagagcgacttgctgctgaccatcagcaatgacacctggttcggccgctccatcggcccgctgcagcacctgcaaatggcacagatgcgtgcgctggaggctggccgctggatgatccgcgccaccaacaacggcgttaccggcctgatcaacccgttcgggcagatcaccgcgcagatcccgcaattcgaacgcgggattctctacggtgaagtggtgccgatgcacaacctcacgccgtacctgcaatggcgctcgtggccgttgatcatcgtgtgcctgggcttgtttggctgggcgttgctggcggggcggatgtctaaaacggtctgactctgacagacactacatataggtaggagctggcttgcctgcgatagcggcgggccagctagaaactggccaactgacacgacgccatcgcaggcaagccagctcccacacttgatttgctgtgttttgagttaccggtaaaacacccgataccccacctgccccgcagcctcgttgatcaactgcccgctctgccacaccgacttgacctccggcatccagccacccagcggccgggcgttgtccacgcccaaaaagccgaccggcgctggcaccacggtgaaccccgccttttcaaagctccagactgcgcgcggcatgtgccaggcctgggtcaccaccaccacgcgcttgatgccttgcggcagcagaatctcagcactcatctgcgcattttcccaggtggtgcggctgcgttcttccttccagcgcacgctgacgccaaagtcatcgagcatcgacacggccatcaactcagcctcactgggcggcgtgccgtagtgcaatccaccactggtcaacaccggcaacccggacgccttggccaatcgcgcggcataacgctgacgctccagaccaatgccggtgggctgatcagtgccccacgccgggtcaccgcgttcacgcccggaacccagcaccacaatcgcatcggcgcgctgggccaatgttggccacgcttcacgggccaacggtggctcggtctccaacgcatgcgcgccccattgcaccatcaccggcaagctgatcagccacatcccgcccaaccccaaggcaaaacacagcccggccaggcgcgggcgacttttgcgaaaccaccaggcaaccgcgatcaacagcaaaaaaatgccgggcggcaacaacaattgtttaatgaaataacgaaaaggcatcgggcatctccaaagatgcccgaagcctaaatgcaacggggtttagcgacaatctttaccagcctgttcagagaaggctgccgaataacgcgtgtttcacttgtaccgcacggcccggtgtttttcgggaccgcgtccggcagccacatccttcagccagatcaccttggccgaacgcgagggctcctgggcaggcggggaagcctgcccctgagaggcgcggtggtgattcaattccaggtagcacttgatcagttcaagttctgcctggctcaagcctcgcaactccagctccagaggccgctcatcacacaatcggcctgcagttcttgcggcatccaatgctcgacccaaacggtcgatcagtccttcgtacaactgcggtttcgttaaagttcgctgcgattcaaccatcccctcacctcattgaagataagactcactccccaataaacagcgtagtccccgtggctgcgcctgcctggcgccgcgacagacggccctgcctgcgcaatcagggtttccctcgatagagtggggtcatgtatgctacggcgcttcctgtaactccacttcccgcagggtttgggcacggacgcgccgcttcttggtgtcgatcaacctgaacgttgcaccgaagaggattaggccacccctattcagttcaaaagtagccatgcacgaacactatcagccccgtgaaatagaaaatgccgcccaaaccttctgggacgagcaaaagtcctttgaagtcagtgaacagccaggcaaggagacttactactgcctatcgatgttcccttaccccagcggcaagctacacatggggcatgtgcgcaactacaccatcggtgacgtgatttcgcgctaccagcgcatgctcggcaagaacgtcctgcagcctatgggctgggacgccttcggcatgccggcggaaaacgccgcgatgaaaaacaacgtggcgcccgccaagtggacctacgaaaacatcgcctacatgaagacccagctgcgcagcctgggcctggcggtggactggtcgcgcgaagtgaccacctgcaagccggattactaccgctgggaacaatggctgttcactcgcctgttcgaaaaaggtgtgatctacaaaaaaagcggcaccgtgaactgggacccgatcgaccagaccgtactggccaacgagcaggttatcgacggtcgcggctggcgctccggcgcgctgatcgaaaagcgcgaaatcccgatgtactacttcaagatcaccgcctacgcggatgaactcttgtcgagcctcgacaacctgccgggctggcctgaacaggtcaagaccatgcagcgcaactggatcggcaagtccaagggcatggaagtgcagttcccttacaacgtcgattccatcggcgctgccggcgcactgaaagtcttcaccacccgcccggacaccctgatgggcgcgacctacgtcgccgtggccgccgaacacccgctggccacccaggccgcgcagaacaacccggagctttcggcgttcattgccgaatgcaaaggcggcagcgtggccgaagccgacgtcgccacccaggagaaaaaaggcctgccgaccggcctgttcgtcgagcacccgctgacgggcgagaaattgccggtgtgggtcgccaactacgtgctgatgcactacggcgatggcgcagtaatggctgtgccggcccacgacgagcgcgatttcgaattcgccaccaagtacaacttgccgatcaaatccgtggtgcgcaccagctccggcgacaccaacccggccccgtggcaagacgcctacggcgagcacggtgagctgatcaattccggcgagttcgacggcctggatttccagggcgctttcgacgccatcgaagtggcgctgatcaagaaaaacctcggtgcctcgcgcacccagttccgcctgcgcgactggggcatcagccgccagcgctactggggctgcccgatcccgatcatccactgcgaaagctgcggtgacgtgccggtgccggaagaccaattgccggtagtactgccggaagacgtggtgcccgacggcgccggttcgccactggcgcgcatgcccgagttctacgagtgcgcttgcccgaaatgcggccagcctgccaagcgtgaaaccgacaccatggacaccttcgtcgagtcctcgtggtattacgcccgctacgcctcgccacactatgaaggcggcctggtagaaaaatccgccgctgaccactggttgccggtggatcagtacatcggcggcatcgaacacgccattcttcacctgctgtacgcgcgcttcttccacaagctgatgcgtgacgaaggcctggtgagctcggatgagccgttcaagaacctgcttacccagggcatggtgatcgccgagacttactaccgtcgtgaagccaacggcgcctacacctggttcaacccggcggacgtcgagcttgagcgtgacagcaaagccaaagtgatcagcgccaagttgaaatccgacggcctgccggtggaaatcggcggcaccgagaagatggccaagtcgaagaacaatggcgtcgacccgcagtcgatgatcgaccagttcggcgccgacacctgccgcctgttcatgatgttcgcctcgccgcctgacatgagcgccgaatggtccgactccggcgtcgaaggttcgcaccgtttcctcaagcgcgtctggcgtttggcgcacgcccatatcagccagggtctgccgggcaaactggacgtggccggcttgaacgacgagcagaaagccattcgccgcagcacccacctggccatccgccaggccagccaggacgtgggccagaaccacaagttcaacaccgccatcgcccaggtgatgacgctgatgaacgtgctggaaaaagcaccgcaagccaccgaacaagaccgcgcactggtacaggaaggcctggaaacggtcgttctgctgctggcgccgatcacgccgcacatcagccacgacctgtggaaccgcttgggccacagcggcgcggtaatcgacgccagctggccggtacaggatgacagcgccctggtacaggacacgttgcaactggtgattcaggtcaacggtaaactgcgtggtcagatcgatatgccagccagcgccagccgcgaagacgtcgaggcggccgcccgcgtcaacgagaacgtgctgcgctttaccgaaggcctgacgatccgcaaagtgatcgtggtgcccggcaaactggtcaacatcgtcgctagctaatcggatcgggcgcagggcttgagccctgcgccgaacaaaacctccaaggcctcgataaggcccacatggtttcaaggggagcaacaaaatgatcaaacgcaatttgctggtgatgggccttgctgtgctgctgagcgcttgcggcttccagctgcgcggcaccggcaccaatgaactgtcgctcaaggaattggacctcagcgcccgcaacgcctacggcgacaccgtgactcagctgcgccataccctggaaagcagcggcgtacatgtctataacggcgcgacctacaagctgaacctggtcgacgaaagagaaacccagcgtaacctcagctacgcaagcgccggccgtgcgtcggacatcgaactgagcaccgaggttttcttcgaagtacaaggccgcgaacacctgacattgatgggtgacaaggtgcaggtacagaaagtcgtgagccacgacggcaacaacctggtgggctcggactcggaaatcatccaggttcgcaaagaaatgcgccgcgaagtgatccagcgcttgatggttcgcctgcaacagctgaccccggaaaagctgcaagccctgcagcaaactgccgacaacaaggccaaggctgacgccgacgccctgaaagctgcgcaagagtatgaagacaacacgccgaaacaatcgcctgttgaagttcctgctgagtaagccaaacggggcgccactggcgccccgttcgacccgcctatgaaactcgcccccgcccaactcgccaaacacctgcaaggtggccttgcgcctgtctatatcgtcagcggtgatgacccgctgctgtgccaggaagccgcagacgctatccgcagcgccgcgcgccagcaaggcttcgatgaacgccaggtgttcagcgccgacgccagtttcgactggggcacgctgctgcaagccggcgcgagcatgtcgctgttcgccgaaaaacgcctgctggaactgcgcctgccctcgggcaagcccggggacaagggcgcggcggccttgatggaatactgctcgcggcctgccgaagacacggtattgctgatcagcttgcccaagctcgacggcagcgcgcagaaaaccaaatggggcaaggcgctggtggaaggcccacagacccagttcatccagatctggccagtggacagcaaccagctgccgcagtggattcgccagcgcctgtcccaatccggcctgtcggcgacgcaagacgctgtggagctgatcgctgcccgggtcgaaggcaacctgcttgccgccgcccaggagatcgaaaagctcaagttgatggccgaagacgggcaaatcaccgtcgaaaccgtacaaggtgcggtggccgacagcgctcgctttgacgtgttcgggctggtggatgcgattcttaacggcgaacccgcccacgccttgcgtatgctcgaagggctgcgtggcgaaggcgtggaaccgccggtgattctttgggccctggcccgggagttgcgggtattggccaatatttccctgcagtacagccagggcacaccgctggacaagtgcttcagccaggcccggcctccggtctgggacaagcgcaaaccgctgatgagcaaagccctgcaacggcactcggcgcaacgctgggcgcagcttctgcttgaagcgcagcgcatcgatgcgcaaatcaaaggccaggcggcgggctcgccgtggatgagcctgagtcgtttgtcacttttgatgtctgggcagcgcctgtcattgccggctgaatagcgtccctcccaacaccccatattccctgtgggagctggcttgcccgcgatagcggtctatcagtgccagagatgcaagctgactcaccgcaatcgcaggcaagccagctcccacattaatcctgcccacttgatagagtaaaaccgcctacaccgcgccgggctttacagcagcgtcacttcggcagatgatttgcaccgcttcatcccacctctggagagtaccgacatgagcaaaaagccatccaagcatggccccaacaaggccaaatccatcatcgcccagccactgttccgcagccgtcaggaacgcgccggcaagggcaaaggcagctaccgccgcgaagccttccagtctaatagctgggaggcttcttactttctggctgcctgaaggcaagcgcccctctggcatgataaggtctgcacctgatttgtaatccctggacctgtgcatgccctctagtctttcccgtcgttggcaccttcgccaactgatcgctgcctccagcctcattctgcttgtcgcctgcgcggaaaaacccaccgccgcggacgcgcaacccctgccaaagctgcagaccgtgccggccgtagcgcctgccgtcgtcgccccactggcagtggacaacctcgatatccaaccgacccagacctttgccgaatggcaggcgggctttcgcgtggacgcactgaaggccgggattacacccgccgtgttcgatagcgcttttgctggcgtgacccccgatatggcggtgattcgcgccgaccgcagccaaccggaattttcccgccctgtttgggaatacctcgacggtgccctgtcaccgctgcgcgtgcgcaacggccaggcgttgctgatcaagtacgccgatatcctgcaaagcatcgagcaacgctatggcgtcgaccgccaggcgctggtgtcggtctggggcatggaaagtaacttcggccagttccagggcaataactcagtgatccgttccctggcgaccctcgcttacgaaggccgtcgcccggcttttgcccaggcgcaactgctggcggcgttgcagatcatccagcatggcgatatccaggccgaccagatgaaaggttcgtgggccggcgcgatgggccagacccaattcatcccgacgacctacaacacccacgccgtcgacttcgacggtgacggtcgccgcgacatctggaacagcccggccgacgccctcgcctccacggcgcactacctgcaaagctccggctggcagaaaggccagccgtggggctttgaggtaaatcggctaccggcaaacttcgactacgctctggcagacggcggcgtgcgcaagaccgttgccgactggttgaaactcggtatccaactgccgcccggcgcgagcatgccggcgaatgtcgaccaactgtccgccgccctgctgctgccggccggctaccgtggcccggcgttcctggtactggacaacttccgcgcgattctcaagtacaacaactcctcgtcctacgcactggcggttggcctgctgtcggaacggtttgctggcggcggggtgattcgtggtgattggccgaaagatgagctgcccctgagtcgctctcagcgcattgatttgcagaccgtgctcagcgccaaaggatatgacgcgggcaacgcagacgggattatcggcgccaatacgcgtaaagcgattcgagcagcgcagcagtcgctggggtggccggcggatgggtacccgacggtgaaactgctggagtcgttgcagagccgttaacagatcgttcccacgctccgcgtgggaatgccgccctggacgctctgcgtccgctcttgaaggcgtgacgcagagcgtcacaggatgcattcccacgcggagcgtgggaatgatcagtcagccgatcagcgcaaaacgacatcttgctccaacaccacccgctgctcccccgcatccaatctcaccctggcgcccatcggcagggtcaggttcgggtcacaatgcccgctgcgccagccggacagcaccggaatgcacaacggttcgaaagtctgcttaagcagccgctccagcgctgcgttatccacacccgccatatcccccaccagcacaccggcaatgtgcgcaagcttgcccgccagacgcaggtgcgtcagcaagcggtctatgcggtagagcggctcgttgacatcctcgataaacaaaatgatgccgtccgcatcgatttcatagtccgtgcccatcacggccgcgatcatcgacaggttgccacccagcaagggcccgcaggcgatgccaggttcaatcgtcgtcagcgggtaggccaccgggtgcgtcaacacgctgccagcgctcagttgaccgcgcaacatgctgaataacgacgactccgtaggctgttgcttatcgccaagcaaatcggcattcagcatcggcccgtgaaaggtcacgaagcctgcgtggcgggtaatcgccaggtgcaaggcggtgatatcgctgtaacccacgaacggcttggggttggctcgcagcaggttgaagtccaggctatcgagcaggcggggtgtgccgtagccgccgcgcaggcagaagatggcatcgatctcggggtcggcgaaggcggcgtgcaggtcgcgaaggcgcaccgcatcgctgcctgcgagatagccatcgcgttcgtatacacctggaaagatccgcagctcatggccacgggcacgcatccattggccggctttttcaacgtcgagtgtggcagggccggcgggggctatcaggccgatcacgccttcggggcgcaaggcaggaacagcgaccgcgagttgagtcatcatccatggttctccgtggttggattacccaggcactctagccagtgatggttgcaaacagaagagagaaagggaggggaattctgtaggagctggcttaccagctcccacagtagagcggcgtaacggcttacgaaaccaggctggccttgaccagcttggcctgctcgtcggcgtggtacgaggaacgtaccagcgggccggacgccacgttcttgaagcccatcttgtagccttcctcggcgaaccaggcgaaggtgtccgggtgtacgaaacgctgtaccggcaagtggctgcgcgatggctgcaggtactggcccagggtcagcatgtcgatgtcgtgttcgcgcatgcgcttcatgacttcgatgacttcttcgtcggtttcgcccaggcccagcatcaggccggatttggtcggaatgtgcggcatcatctgcttgaatttctgcagcagggtcagcgaccactggtaatccgaacccggacgcgcagccttgtacaggcgcggtacggtttccaggttgtggttgaacacatccggtggctcggccgcggtaatttccagcgcgacgtccatgcggccacggtagtccgggaccagggtctcgagcatcacgttcggcgacagcttgcggatttcacggatgcaatcggcaaagtgctgggcgccgccgtcacgcaggtcgtcgcggtctaccgaggtgatcaccacgtatttgagtttcaggtcggcgatggcgatggccaggctttccggctcgttgacgtccagaggcttcggtcggccgtggccaacgtcgcagaatgggcaacgacgggtgcagatgtcacccatgatcatgaaggtggcggtgccgccggagaagcactcgcccaggttcgggcaggacgcttcttcgcacacgctgtgcagcttgtgtttgcgcagcagggccttgatacggtcgacttccggcgaaaccgggatacgcacgcggatccagtcaggctttttcggcagttcggtggtcgggatgatcttgaccgggatgcgtgcaaccttctcggcgccgcgcagcttgacgccggcttccaccttggcacgcggggccggggccggacgctcggtgatgtccagcgtcgggatcatggtttgcactgcatcagtagtcataatcagtcgattccgcccgtaagggtcgtctgctcagcatagtcgaggtgtttgacgagctgcgcacgcagccgggcacttacctcggcaaatttaatcggtgtggcgtggtcgctcagctgggtcattgccaaccctgcgtacccgcacgggttgatccgcccgaagggcgccaggtccatgtccacgttcagggccaggccatgaaaggaacagccgtggcggatccgcaagccgagggaggcgattttcgcgccgtccacgtatacaccgggtgcatcgggcttggccgcggcgctcacgccgtaactggccaacagctcgatcaggcaagcctccatgcggctcaccaggtcacgtacgccaaacccgagtttgcgcacgtccagcagcagatacgccaccagctgacccggcccatggtaagtcacttgaccccctcggtcgacctgcaccaccggaatatcacccggcagcagcagatgctcggccttgccggcctggccctgggtgaacaccggcgggtgttccaccagccagatttcatccggggccgagctgccgcgttcattggtgaaccgctgcatggcgtgccagacaggctcgtaggccatctggccgagctcgcgaaagcccaggacctgagacatcacagcaccatgtgcacgaagccggtggcccgcagttcgctgttgatgtcgtagagctggtcttggccggtcgcaacgatgtgcaactggatcgtggtgtatttaccgttggagctcaaacgctcgtccacccggttgtcgttgatcgtcgcgtgtttacgcacgatttcgagaatcttgtctttgttgcccacaccggtatcgctgatcaccttgacgggatagtccacgttggggaattcgatctttggcgcctttacttctgcttctttatcggtcatggcgtaacggcctcgtaagcgtaagccgtggcgacgggcaaagccccgcgtcaggtcgacgcggggctttgcaggtgcacacttatcagttgaacaagctgtagaagaatagacggatgctatcccacacgcggcggaagataccaccttcgtcgacggcgtccagcgcgatcaggtcggcgctgtgcaccaccttgtcgtccagcttcacttcgaccttaccgatcacgtcacccttggcgattggcgcaaccaattgcggattcatggtcatgctggcggcgagctttttcagctggcctttaggcatggtcagggtcaggtcgtcagccaggccagctttgacttggtgagtagcgcctttccataccggggcttgagccagctcggcgcccttctggtagaaggtctgggtttcgaagaaacggaaaccgtaggtcagcagtttttgcgtctcggccgcacgggcctgctcgctgttagtaccgaagaccacggcgatcaaacgctggccgtcacgtacagcggacgacaccatgcagtagccggcttcgtcagtgtggccggttttcagaccgtcgacggtcttgtcgcgccacagcagcaggttgcggttaggctgtttgatgttgttccagaagaattccttctgggagtagatcgcgtagtgcaccgggtcgacgcgaatgatcgcgcgagccagcacggccatgtcgtgagccgacgagtagtgctccgggttcggcaggccggtcgggttcatgaagtggctgttggtcatgcccaggtcgccggcggtcttgttcatcaagtcggcgaaggcgtcttcactgccggcaatgtgctcggacagggccacgctggcgtcgttaccggactggatgatgatgccgtgcagcaggtcgctcacggtgacctgcgagcccaccttgatgaacatccgcgaaccgccggtgcgccaggcgttttcgctgacggtgaccgggtcgttttcgccgatctggccgcgacggatttccagggtcgcgatgtaggccgtcatcagcttggtcaagctggctgggggcaggcgctggtcaccgttgttctcgaccagcacgttgccgctggcggcatccatgaggacccaggccttggcggccagttgcggggaagccggcaccatttcaaccgcccaggcggccggggtgatgatcagcgaaagaagcaggcacgtgcgtttggctaaggtggtgatgttcatccgtctctcgaaattgcttatggaaacttgccctcgcgggcaaaactattcagacagcccgctgccagactgtcacgtgttcggttgcccgctcaccccttgcccctgggtttttattcttcaacgagccaacaaccaggacctagacccgcgtacgggcctgagccatcaatctttattattcggcggtgaccacgctgggttgccccaggttggccaggcgcacgctgttctgtacttgcgccacttcaccgggcgttccgatcggccccatgcgcacacggtgcagggtctgctggttacgcacgatggagctgatgaaaaccggcgcattgaccatgctgctgagcttggaccttaacagttctgccgcatccgggttggcgaaagcgcccacttgcaggtactggccacccactgtcgaggcgcccggtgctgcgtgaggcaccaccaccgtgtccggcgcgtgctgcgccggtggtggtgtccactgttcgatcttgccggccgatgcggtcacttgcggttgcggggtttgcggctcgttgagcatcaacggcgccggtttgccgcgctgggcccagtactgcgccgggtcgataccttccaccttgacgcgcgcggtgccgatttcggcgtaaccgagtttctttgcggcggcgtaggacaagtcgatgatgcggtccgaatagaacggcccacggtcgttgacccgcaggatcacggtgcggttgttgtccaggttggttacacgcacgtagctgggcagcggcaaggtcttgtgggccgcgctcatgccgtacaggtcatacacttcgccgttggcggtgttctggccatggaatttggtgccgtaccaggacgccgtgcccgtttgcgagtaggtcttggaatcctgcagcgggaagtaattcttgcccagcacggtgtacgggttggccttgtagggaccggtgtgcagggtcggcgtggcatccgggattttcgacacgtcgacatcccaccacggcgcgccgtctttgtgcgcgcggttgatgtccaggcccggctgggcgcggacaataccgccaccactcttctgcgccggggcgcgactggtggtggaggagcaactgacaaccagcaaggacaacgcggcaaacgccaccagcttgagcggtttattgaacggcgatgcccgcattacttgttgccccgtgcttggaccagcatgtctgacagctgatgcacggccatggcgtacatcacactgcggttataacgcgtgattgcgtaaaaattcttcaggcccatccagtattccgggccgttttcgccttccaggcggaacgccgtcaccggcatatcatcgcgtggcgcattctgactcgaccagcccagcgctcgcaactccccaacggtcttgaccggctcgattccctgggtcaggccttcgtcggctcgctccccagtcacctcggcacgaatcaccaccggctcgccgtacacccagccgtggcgcttgaagtagctggccacactgccaatggcgtcgtccgggttgctccagatattgatgtggccgtcgccgtcgaaatccaccgcgtaagcacggaagctgctcggcataaactgcggcaagcccatcgcaccggcgtatgagcccttgagggtcagcgggtcgacctgctcttcgcgggccagcagcaggaattcgcgcagttccttgcggaagaactcggcgcgcggcgggtaatcgaagcccagggtcgacaaggcgtcgatcacccggtaattgccggtgttgcgcccgtagaaggtttcaatgccaatgatcgcgacaatgacctgggccggcacgccgtattcctgctcggcgcgggccagcacggcttcgtgctggcgccagaagtccacgccccgcgccacacgggcgtcggtgagaaacatcgggcggtattctttccactgtttaacgcgctcggcgggacgcgagatcgcgtcgaggatcgcctgcttgcgctgggcttcacggaacacgcccatcagctgttcaccggcgaaaccgtagtcgcgggtcatttcaccgacaaactcggcaacctggggtgagccatcgtagtcaccggcctgcgcctcttgcgtcgcgcccagcagcccaatcaggctcatccaggacgcatgccgagtcgcccagccgcgcattacttgcattgacatcttcaccttattcaaacctgcgcgatccatttgcgatgcgtatgaatcgacatcaaaaccccaaacgctgacagcaatgtcaccagcgaagttccgccgtagctaatgaacggcaacggcaccccaaccaccggcaacaggccactgaccataccgatgttgacgaaaacgtaaacaaaaaaagtcatggtcaggctaccggcgagcaatttgccgaacagcgtctgtgcctgcgcggtaatcaccagcccgcgaccaatcaacagcaaataaatcagcaacagcgcgcaaatgcccaccaggccgaactcttcgcccaacaccgcaataatgaagtcggtgtggctttcgggcaaaaagtccaggtgcgactgggtgccgagtaaccagcctttaccaaatacgccgccagaaccgatggccgccttggactggatgatgttccagccggtgcccaacgggtcactttccgggtccaggaacgtaagaatccgctgcttctggtagtcgtgcataaagaagaaccacatggccacggccacgggtatcgcagcggccagcacgctgaggatccagcgccagcgcaggccgcccataaacagcacgaacgcaccgcccgcaaggatcagcagcgaggtgccgaggtcgggctggcgcacaatcaggataaatggcacgccgatcaggatcaggctgatgcccacgtgcttgagctgcggcggcaaggtgcgtttggacaggtaccaggcgatggtcgccggcatcaggatcttcatgaattccgacggctggaagcgaatcacccccggaatattgatccagcgcgtcgcgcccatggcgttgtggcccatgacgtccaccaccaccagcagcaacacgccggcgacatagcccagcggcacccagcgcgccatgaaacgcggctcgagttgggcgatcaccaccatcgacaacaggcccagcccgaacgacgaggcctgcttgatcagcaggtcccagttcttgccgctggccgaatacagcacgaacaggctgccggccgccaaggtcagcagcaggatcagcaacgggccatcaatgtgcatacgttgcagcaacgtcgcacggcgacgcatcacatcctcgctggagaggatgcggtcaaaattactcttcacgggccgtaacctcggtgcttgaaggggggccgccatattcgggcttgagcctgccgtcgtcggccaacagccaggcgtccatcacttggcgcaccacgggcgctgcgacgccggagccggactcaccgttttcaaccatcaccgccacgacgattttcgggtcgtcggccggggcaaagccaacaaacaaggcgtggtcacggtggcgctcttgaaccttggagcggtcatatttctcgccctgcttgatcgcgaccacctgcgccgtaccgctcttgccggcaatgcggtattgcgcgccgaccgccgccttgcgcgcagtaccacgggcgccgtgcatcacttgctgcatgccgtggttaaccttggtccagtcggacgggtcgcgcagcacaatgtcggcaatcgggttttcatccacaggccgctcgccttcaaccgtcttggccaggtgcggacggttccagacgcctttgttggccaccagcgccgtggcctgggctagctgcagaggcgtggcctgcatataaccctggccgatgccgagaatcagggtttcgcccgggaaccacgcctggcgacgggtcgcgcgcttccactcccgcgaaggcatcaggccgggggactcttcgaacatgtccagagagactttctgaccgaggccgaacttgcccatataggcagacagccggtcgatccccagcttgtgggccaggtcataaaaataggtgtcgttggagcgcatgatcgcggtgtccaggtcgacatagccgtcaccggtgcggttccagttgcggtatttgtgatcgtagttgggcagcatgtagtagccggggtcgaacacacggctcgacgcggtgaccacgcccgaatccaggccggcaatcgccaccgccggcttgatggtcgagcccggcgggtacagcccgcgcaatacgcggttgaacaacggccggtcgatggaatcacgcagttcggcgtaggccttgaagctgatcccggtcacgaacaggttggggtcgaaactcggctggctgaccatcgccagcacttcgccggtcttcgggtccagtgccaccaccgcgccgcgccgaccgcccagtgccatctcggccgcttcctgcagcttgatgtccaggctcagcacgatgtccttgcccggcaccgggtcggtgcgcttgagcacccgcagcacgcggccgcgggcgttggtctcgacttcttcgtaacccacctggccgtgcagctcgggctcgtagaagcgctcgatgccggttttgccaatgtggtgggtgccgctgtaattcaccggatcgaggcttttcagctctttctcgttgatgcgccccatgtagcctacggagtgggcaaagtgcggcccttgcgggtaatgccgcactaactgcgccaccacttccacaccgggcaggcggaactggttcaccgcaatgcgggcgatctgctcttcggtcagctcaaacagaatcggcaccggctcgaatggccggcgcccctgcttcatgcgtttctcgaagatcacccgatcttccggcgtcagctgcagcacctcgacaatcacatcgaggatctgctgccagtcgccggaacgctcgcgggtcatgctcaggctgaagctgggccggttatccgcgaccactacgccattgcggtcgaaaatcaacccacgggtcggcggaatcggctgcacgtgcacccggttgttttccgacagcgtggagtgatagtcgtactggatcacctgcaggaaatacaggcgcgcaatcagcacaccaatcagccccaccaccagaaaagcgccgaacacgacccgcgcgcgtaccagacgtgcgtctttctcgtggtccttgatgcggatcggctgggtcatcggcaggggcgcagattatttgtggtaagggtgcccggacagaactgtccaggcgcgatacagctgttcaccgatcagaatccttaccaacgggtgcggcagcgtcaacgccgacaacgaccagcgctggtccgcccgcgcacagacttccggcgccagcccttcggggccaccgaccatgaagttgaccgtacgtgaatccaggcgccagcgatccagttccaccgccaactgctcggtgctccagggcttgccgtgcacctcaagggtgacgatgcgctcgttggggccgaccttggccaacatggcttcgccttcctgacggataaagcgcgccacgtcggcattcttgccccgggtgttgagcggtatttccaccagttccagcgacagctcagcgggcagacgcttggcatactcgtgccagccttcttccacccacttgggcatgcgtgaaccgacagcgatcagacgcaggcgcacagccgttccttattcctggtctttgttgagcttgtcgaagtgcgcgtggcccacttccgggctgtggtgcttgccatcagcggcacggctctgctcggcgcctttccacagacgctccaggtcgtaaaactgacgggcgttggaggtcatcatgtgaacgatcacgtcgtccatgtccagcagcacccagtcgctgtcgcccttgccttcttcacccagcggcttgacgccttgggctttgacggcttcgcgaaccttgtcgagcatcgcgccgatctgacggttggaagtaccggtggcgatgatcatgaaatcggtgatgctctgcttgtcgcgcacgtccagaacctggatgtcctgtgccttcacgtcttccagagcggcaacggccacttttaccagctcttcgccagccagctcagggccggtgtgcgcttcaactggcagcggggcgcttttgaacgtgcctttgcgcttaactttgcttacgtctttgttggtcatataaaactcgttttgctcgtatgttcgggcgctcgctgcacgactgtgcgtagcgacaagcgcgccttttcagttcgacgcacggtaaagcccgtgcgcatcgatgtaggccaggaccgcgtcaggcaccaggaaacgtaccgacttcccgctggccagcagttgacggatctgggtggcagacaccgcaagcggggtctgccagacgaatgcaatattcccgttcggcccggtcagggccaaggggtcacttaccgaccgcgcggccagcaggttgcgcaaggcatccggcggttcgctgtcggcatccgggcgttgcaaaaccaggatgtggcaatgctggaggagttcctcccagcgatgccaagagggcaggccgcaaaatgcgtcccagcccaaaagcagaaacaactggtcatccgcggccatttcggcgcgcatcacttccagggtatcgacagtgtaggacggtttatcgcgcttgagctcgtggtcgtccaccaccagcggcgctatgccctccaccgccaggcgcaccatttccaggcgttgctgcgctgacacctgcggcgtatcgcgatgcggcggccgcgcgttgggcatcacccgcagctcatccagcgcgagggcatccgcgacttccagggcactgcgcaaatggccgatgtgcacggggtcgaaggtgccgccgagcagcccgatgcgtttagccatcaagtgcgcacatgaccgtcgccgaacaccacgtacttctcgctggtcaggccttccaggccaaccgggccgcgtgcgtggagcttgtcggtggaaatgccgatttccgcccccaggccatactcgaagccgtcggcaaagcgcgtcgaggcgttgaccatcaccgaggcggaatccacttcgttgaggaaacgccgggcatcgctgaaatgctcggaaacaatggcgtcggtgtgcttggagccgtatttattgatgtgttcgatggcctggtccaggtcgtcgacgatgcggatcgacaggatcggcgccgtgtattcggtgtaccagtcttgttcggtggcttcgatcacgtccgcgcccagcagcgcgcgggtacgctcacaaccacgcaattccacacccttgtcacggtaaatggcagccagcggcggcagcacgcgatcggcaatgccgacgtgcaccaacagggtttccatggtgttgcacggggcgtagcggtgggtcttggcgttgtcggcgatgcggatcgccttgtcgatgtcggcggcgacgtcgatgaacacgtggcagacgccgtccaggtgcttgatcaccggcaccttggcatcgcggctgacgcgctcgatcaggctcttgccaccgcgcggcacgatcacgtcgacgaactccggcatggtgatcagcgcgccaacggcggcgcggtcggtggtttccaccacttgcaccacttcggccggcaactcggccacggccaggccttgctgaatgcaggcggcgatggcgcggttggaattgatcgcctcggaaccgccacgcaggatggtggcgttacccgacttgaggcacaggctcgcggcgtcaatggttacgttggggcgcgactcataaatgatgccgataacgcccaggggcacgcgcatcttgccgacctggatgccggacggcaggtagcgcatatcgcggatttcaccgatggggtcaggcagcttggccacctgacgcaggccttcgatcatgtcgtcgatacgtgccggggtcagcgccaggcggtccagcagtgccggctccaggccattggcgcggccgctggccaggtccagttcgttggcggcagccagctcggagcgcgcagcatccagagcatcggcggcggccagcagggcacggttcttctgcgcagtgctcgcacgggcgatcaaacgcgaggcctgacgggcagcgcgacccaggcgggtcatgtagtcaagaacggactcagtcatggtcagggagtcttggcaaagaggaaagcggcagattatagctgcgacgccgcccgactgacagcggtgaggggcggatggtcgaaatgaactgtaaaaacttggggttcagcggtaattaaggtgggagttgttattattccgtcacatttagccgtattaaccttgccgccatgtccagttttgccccgcaacgccccgccagcgccctgcccgacagcttcttcgaccgtgacgcgcaagtgctcgcgcgcgaattactcggaaaagtcatacgccatcgcgtcggcgaaacctggctttcagcacgaattattgaaaccgaagcctattacgtggccgaaaaaggcagccacgcctcactcggctacacagaaaagcgtaaggctttgtttctggatggcggacacatctacatgtactacgcccgtggcggtgattcgctgaacttcagcgcccacggcccgggcaatgccgtgctgatcaaatcgggctatccctgggtagacggcatgtccggcccggcgagcctggcgcagatgctgctgaacaacccggacgccaacggccaccctcgcccctcgcaaaagctctgcgccggtcaaaccctgctgtgcaaagccctgggactgaaagtgccgatgtgggatgccaagcgttttgatcaggagcagctctacgtagaggacgtgggccaagtgccgacgcagattatccagaccacccgcctgggcatccccagcgggcgcgatgaacatttgatgtaccgctttgtggatgcgggctatgcgccttattgcaccaggaacccgctgcgccggggccaggtcgaagggcgcgattattttttgatttgaattgattgaacgttgaaacccgcagcacagcaattccaatgtgggagctggcttgcctgcgatagcggtgggccaggcgactcgatgttcgccttgaggccgccatcgcaggcaagccagctcccacagttgatcatcagtgtctcgagttatgtattacatacatggagtgaagttttatgggccaatggctcgatagcattaccggctggctgaccctcaacccagaatggctggccgtggcggtgtttatcgtcgcgtgcgtggaatgcctggccatcgccgggctgatcgtgccgggcacggtgttgctgtttgccattgccgcactggccggcagcggcgcgctgtcattgagcgaaaccctgctgctgggcttcctcggcggcttgctcggcgacggggtttcctactacctgggccgacatttccaccaaaacatccggcgcctgcccggcttgcgtcaccaccctgaatggatgaacggcgctgaaacctacttccataaatacggcatcgccagcctgctggtaggacgtttcatcggcccactgcgcccgatgctgcccatggtggccggcatgtgcgacatgccgttcccacgctttgccgctgtcagcatcgtcgccgccgccggttggtcggtcgcgtatctgttgccgggctgggcgaccggcgccgcgttccgcctgccgttgccggaaggtttctggctggaagccgggatcgtcgccgggtgtatcgccgtgctgctggggctgagcttgaacagcagcctgcgtggccatcgtcgcgccacgctgtgggtcggttgcgccagcctgacactgttgatcgccctgtttatcggctacccccatctcaatgacttcgatcagggcttgagcgcgctggtgcaggaacaccgcagcccgtggctggacgaggtgatggtgcggattacccagttgggtgagttcaggaagatgtttatcgccagcgcgattttcaccggcttgctgttagtcgcgcggcaatggcgccacgcggtgtttgtcggcgccaccttggccggttcggcggtgatcaacaccgccaccaagctgtttttcgcccgtggccggccagaaatcctgaccgatccactgaccagtttcagcatgcccagcggccacgcctccggcgcctttgcgtttttcctggcactggcggtgctggccggtcgcgggcaacccacgcggctgcgcctgacctggatgctgctgggctgtattcctgccgcgtttattgcgctgtcgcgggtttacctgggtgcgcactggccgacggacattctggccggcacgctgctggcaatgacggtgtgcgcgttcagcctggctgtgagtcagtaccgcagcccgctgccgccaatgccacaaaagacctggtggtggttgctgccgatgttggtcggcgtgctcggtttcatcgcgctcaccggcacttcccacgcgatgctgcgctacgcctattgagtgaagagttcgccctgcaactcgtcgagcaacatctggatcgcatccagacgttgctgcgggtcgtcgagttgcagcaggtcgatcttgtcggcctcggtgaacggcaacagatacgccagctgattacccagggcttgctggccatcagcgtgggtgcccatgtcgagcgaggcgaccatcgggtgttcggccaaggcctgaagcaacgccagcaggtcggcgtcctcttcttccagcggttggtccggcagctcttcaagccactgcacctcggcgaccagcaactggtccttctgcacatcagcatcaagcacacggaagcggcgcccaccctcgacacgaatccccagcaggccgttgtcctgctgcttgaagtcgcgaatcagcgcttcgcagccgatcagcgcatagccttgcgtggccatgcccacttccctgccgccgagggtgcacaccacaccgaagctttcgccctttttcatgcagcggctgatcatgtccaggtagcgcgcctcgaacagttgcaaatcgagggtgcagccagggaacaacacggtattgagcgggaacagcgccagactcataaaggtttccttaaacccgatttaaacaatcaccgacacggccagcggcaggaacaccgccgtagccacgcccatcagactcatggccagcgccgcaaaggcgccgcactcttcgctttcctgcagggccaccgaggtgccgacggcgtgggcggtcatgcccaaggccatgccgcgcgcctcggggctgtgcacacccaggcgcgacaggtacgccgggccgatcatcgcgccgattaccccggtgatcagcacaaacaccgccgccaatgcggccacgccgccgatctgctcggccaccagcatcgcaatcggcgaggtgaccgacttgggcgccatggtcatcagcatcatgtgttcggcgccgaaccaccagcccagcagcacgcacaggccggtggccagcacgccgcctatcaccagcgtagtaaaaatcggccagaacaattggcgaatccgccgcaagttcaagaacagcggcaccgccagcgccacggtcgcagggccgagcagaatacccatgatctcggtgctcttgcggtactcgacgtaggtcaggccgcaactgagcaagacgccgatcaccagcagcatggacaccagcaccggctgcaggaagatccagcgggttttctcgaacgccgccagcaccagttgataagcacccagggtgataccgataccaaacagtgggtgatgaatgaccgccgtccaggcgccctgccagtcgaagatcattgatccttctccttgcgcttgaccatctgctgcatcagcacgccgacaaagcccatggcaatcaccagcgacaacaccagcgcgccgacgatggcccagaagtcagcggcgatgtctttggcgtacaccatcacgcctacggcaggcggcaccagcagcagcggcaaataacgcaacaggctgctggcggccaggctcaggggttcgccgacttcgccacgccagatcagaaagccgagcatcagcagcaagccaatgatcggccccggcagcaccggcagcagcaaatggttgatcgcggtgccgatcaactgaaacagcaccagccatgtcaggccacgtaacagcatccgttctcccccctaaaagactcgcccgcattataagcacgccggctctatgctccggcattcgccaaaagcatggtgggttgaccgactgggttgcccatgatgatctaacatggatttcgcatacctataaaaaccgatgaaccaaggagagtcgtaatgccctatgtacctgtagcgcagctcaaagattatgtcggcaaggaactgggacgttccgaatggctcaccatcgaccaggcacgtatcaacctgttcgcagaagccactggcgatcatcagttcatccacgtcgacccggtcaaggccgcccagacgccgttcggcagcaccatcgcccacggtttcctgtcgctgtcgctgatgcccaagctgatggaagacatcctgatcatgcccgaagggctgaaaatggccgtcaactacggcctggacagcgtgcgctttatccagccggtgaaggtcgactccaaggtgcgcctgaacgtgacgctgaccgacgtcaccgagaaaaaacctggccaatggctatttaaggccaccgccaccctggaaatcgaaggccaggaaaaacccgcttacatcgccgagtcgttgtcactctgcttcgtgtaaggcctcgcctgtggtgaggtgataaaccttgccacagtgtatgtaaatttatgtatgaatcctgcggctgcggcatactcggtgctcaattatccggatcccgctatgcgcccactcgctccccttgcccttgccctgttgctcaccgcttgcggagacggcgaatcgctgttgccgcccgatgcgcgcctgcccgacggcggccgctaccggggtgatgtggtcaatggcttgctgcaaggccagggccgggtggactaccccaacggcagttggtacgccggccagttcgacaaaggccagtggcacggccagggcgaatggcatggcagcaacggcgaggtctataaaggccagttcaagcaaggcctgttcgatggccagggcagcctgaccacggcgggcagcagctacgtcggcggtttcaagaacggtcgacgcaatggcgaaggcaccctcaaagaggggcagatgacctatcgcggcgaattcaaggacgaccagtattccggcctcggccgcctggagctggccgacggcagccagtaccagggccagtttgcccacggcaagccgaatggcgaaggccaacgcaacgacgacagtggcaaccagttcagcggccattttgtcgatggccagctcgaaggcaatggcaccttcaacagcgccgacggcgacatctatgtcggccagttcaaacagaaccagctcaacggcaagggccgctatgaaaacgccgacggcgacgtgtggatcggccagttcaaggaaggcgcgctcagtggcaagggcgagctgatcggcgtcgatggcagccactatgtcggctacttcagcgattggcgcttcaccggcgagggccgcctgaacctcaccgatggcagcttctatatcggtggtttcgacagtgacagctaccaaggcaaaggcacgctggtgctcaccgacggcaccgtccaggccggcacctgggtcaacggtatgcgcgtgcgcgatgccgacggcaagttgttgcccgacccgctggaaatcggcgtactggcccagggccgcttgctcgatgccgcgctcgccgccgtgccgccctcgacgcctgccgtggagctgtacagcctggccgtggcgggcgatggcaagcaaagcgtgttcctgcgcgaagccgattatgtgagcaacatgctcgccacccgtttcggcgcgcgcgggcagatccgcctggtcaaccaccgcgaccatatcgccgaccgcccgctggccacccgcgaaagcctgcgccgcgcggtgcaaaccctggctgagcgcaccggcccggaagacctggtgtttatctacatgaccagccacggcacccacgaacatgaactggtgctcgaccaaccgcgcatggagctggccgacctgcccgccgacgaactggccgccgtgctcgcaccgctgaaaaaccgcgacaagatcatcgtgatttccgcctgttattccggcgggtttatcccggcgctgaaagatgagcgcaccctgatcatgaccgcctcgcgcgctgatcgcgtgtctttcggctgttccgaggaagcggacttcacctacttcggcgatgcccttttcgcgcaggccttcaaccagaccgacgatttactgcaggccttcaaattggcacaactccatgtggccgagcgcgaacaggcggacaatttcgaagcctccgaaccgcagatctgggcccccaaaggtgtgatcgcccattggcaattattacgcaagcagcaggcacgaaaggcgctcgaaagcgtctcaatgaatagcaaggaagccaaaggcaactaagctgtaacgtgtaacaagggggaaacaccatgtacctgacacctcaacatatcctgctcgccggcgcctcgggcctgaccggcgaacacctgctcgaccgcctgctcaacgaacccaccgttacccgcgtactggcgccgagccgcaagccgctggccgaacacccgcacctggaaaacccggtgggcgacccgccggcgctgttgccgcacttgagtggccaggtcgatatcgccttctgttgcctgggcaccaccatcaagcaggccggctccgaagcggccttccgcgcggtcgacctggacatggtcgtggccttcgccaagcgtgcacgggaaatgggcgcgcggcacctgatcgtgatcagtgcgattggcgccgacccgaaatcctcgatcttctacaaccgggtcaaaggcgaaatggaactggcgctcaaagcccaggactggccgcaactgaccatcgtgcggccttcgctgctgctgggggaacgcttggagccacgcctggccgagcagttggccgggccgttgtcgcggttgattccgggcaagtaccgcggcattgaagtctgcgaactggcccgcgccatgtggcgtctggcgctggaagagcaggatggtgtgcgggtggtggagtcggatgagttgcgtaagctcggcaaataattatgcagtgattgatcgggcctcatcgcaggcaagccagctcccacaggggaatgcattccaaggtgggagctggcttgcctgcgatggggccggccccggcactgtgaatctacagcccgcctgttgcgttaaaccccacccccaacaccgtcaacaccgacagcggcaacagcagcgtgtcgagcaacgcactggccggcaggtcgacatgcgggtaactcggcgcctctgcgccaaaccgatccttggcgcaacagccgccgttaatcgcatacaaatccaggcgcgtgccggcatataccaccggcgcgccaggttgcgcggcatccagggtgcgcgcggtggcgcagccggtcagttgcagcgccaatagcaccagcagggccttattcatcgttgctcaaatggtgctcgccccaacgcggcagcatgtcctgaggaatgttcagcaggttaagaatccgcgctaccacaaaatccaccaggtcatcgatggtctgcggctggtgataaaaaccgggtgacgccggcaagatggtcacgcccatgttcgacaacttgagcatgtgctccaggtgaatactcgaatacggcgcctcgcgtggcaccagaatcaactggcgacgctccttcaaggtcacgtccgccgcgcgttcgatcaggttgttgcacgcccccgtcgcaatcgccgacaaggtgccggtggaacacggcaccaccaccatcgccgccggcgcgccggagccggaagccacgggcgacatccagtcctctttgccgtaaaccttgatctgccccgccgccgcaccggtgtattcggtgaggaaggcctgcatcatctgcactttgggcggcaacgcaacatcggtctctgtggccagcaccagttgcgcggccttggagatcaaaaagtgcacctcacggtcctcacgcaccaggcagtcgagcaagcgcaggccatagggcgcgccggaagcgccggtcatcgccagggtgacgcgttccggcccgctcatttcaacgcctcggccagtttgccgtgcaggccgccgaagccgccgttgctcatcaccaccacatgggtgccgggcttggcctgatgtttgacgtgttcaatgatgccctcaatcgagtcgcacacaatcgatggcaccgtgcacagcgcggcgatggccggcaggtcccaaccgaggttggccggcgcgtaccacaccacctgatcggcgtcgttgacgctttccggcaaaccgtcgcggtgtgcgccgagcttcatggagttggagcgcggctcgacaatcgcaatgatgttggcgtcaccgacacgtttgcgcaggccgtccagcgtggtcgcgattgcggtcgggtggtgggcgaagtcgtcgtagatggtgatcccattcacgtcggcgactttttccatgcggcgcttcacgcttttgaacgcactcaatgcggcgatgcccatggacggcaccacgcccacatgccgcgcagccgccagcgtcaccagcgcgttggcgacgttgtgctggccggtcatgtcccactcaacgatgccttgggcttcaccttcgaacagcacttcaaatttggagccgtcttcactgagcaacttgacctgccactgcccgcctgcgccggtggtttgcaccggggtccagcagcccatgtcgatcacgcgctgcaaagcgggctcggtggtcggatggatgaccaggccttcactggggatggtacgcaccagatggtggaactggcgctcgatggccggcagatcggggaagatgtcggcgtgatcgaattcgaggttgttcaggatcgccgtgcgcggacggtagtggacgaacttggagcgcttgtcgaagaacgcactgtcgtattcgtccgcttcgatcacgaagaacggcgtttcgcccaggcgcgccgacaccgagaagttttgcggtacaccgccgatcaaaaagcccgggctcatgcccgcatgttccaacacccaggccagcatgctgctggtggtggtcttgccatgggtgccggcgacggctaatacccagcggccctgcagcacgtggtccgccagccactgtgggccagaaacatacggcaaccccttattgagcacgtattcaaccgccgggttgccacgcaccatggcattgccaatcaccaccagatccgggacagggtcgaattgcgacgggtcgtagccctgggtcaactcgataccctgggcttgtaattgcgtgctcatgggcgggtaaacgttggcgtcggagccagtgacatgatggcccagctctttggccagaaccgccatcgagcccataaaggtgccgcaaataccgagaatatgaatgtgcatggttgacctcttgaacatcggggcaggttagcgcagggagggggaaatcgcaccttttatgcggccgggcggctgagcgattcaagtgtgtgtgctttgctcagccgtgtatttttcaggcctgcggtagcttacgtggctacgcgccaggccccgccactcacgcagccttgtcgcgctgcgccttcatcttccgtagcgccgcgctcaccaccgccaaccgtttctctatggcattgaatcgctcgcgggccgtatagctgtccgcagggtcaagaggggccggtatgtggcgatcaaataacacattgaacacacgcgcttgttcctggacgcggtcctcgaacacatcaagttcggcttcgatttgatcaaggttgctaataatgtcggtcgccctgccttcggacgcgtgatcaatgtcttgtacctcgccacctgccagcgccgtcaggtccttactggcctgcttgagctcccgccaaagtgtctgcacgcgggcgagccgtgtttgatcggcaagccggtcaacgctgtcggcggtgttctgtagcgcggactcgttttgcgcctgggtttggcgttgaagtgggtgcagcatcaactgcggctgtcgggcggccttcaacgcttggtcgataccaaagttcacgccggcatcgataattgcgctaacggtcgcttgcgctacttgcctggcaaacccgacaccgggcgtgaaacctttcaacggagcgccgtaaggcaattgggtcttgggatcacaggcgtaccacttgccattacattcaaccgcaacgacatttacaggtgccgtattcccgcccagaggccggtaaaccccctcggcaatggcacctttcttcccgggcttgggtatgttccaactgccactgcgaccgcgtatgtgacgcaatttataaaacgcggaaaagtcggtcccccccaaccttctgatcccggatttgcccagctggtatacgcccttccccgcatcataaatgcacccgagcgggttagcagccaacacgccagctttggcgaaaccctttagaaatctgaaccctgtgctgagcaccttgacgcccgcactcgcggcactgataccgcctttaagggcgggtatgaccaacccaataagctcgagcattccataaataatcgcttcgcccgtcttgccttcaacgatgcttttaacgaagtcatagaagggaatgaggcccagcatgaacctgtggaaggcctttctttgagcctgttccctttcctgtttggtttcccctttggccgatgcttttgccgtattgaactctcgcgtataaaaagagcccaccgcatcgcccaacgcagcactccttgctgaaggcgctgctgtcgccaccgagtccaaatgctttttgtccaattcgagcatttttaaatcgtagtcagccacttttcggctaaaggcaggcgagtcattcctgccccttggactgccgaacagctcggcaggcacgggcataccgtaatcattaaagggctcaacctgcttgaagattttcccttgggttggcgaataccaataacgaaccttcttaccctcaagctccgcgccaatgacaacgccgccctcttttatacaacgcaacattggcgtatcgatcgccttcgattcgtcgaaccccatcagaggcttcaggtgtaagactgtaagttttccgcgttccagcatctgctgatcttcatccggcagttgcgtcaattgatacttgaagttcacgcccactgcgttgcctacgccggctgtgtagtggtggaacgcttggtcaaatttttcttcgatatccggcaggtggagaatatcagccgcaaattcacccacagaaaactcactgccatcaggaacacggaagcgcgacttcaactcacctgacatataaagatccagcagagaatatctattcgtactgtgcttcgtctggctggcgcttttgaacatttccagctcaaagaggtgcgctttttctttgccgtatacccgtgtcaactcaaccagtgccagctcgcggcgagtcggcattgggcctgtcattgtcttgacggcttcaactacctcaccgacttgcttctccatcgcagcggctgctcgttcaatggtctcagcgctgtagtccccctcactattttcatcaataaccttattggctataccccagtcgatcaccgactgcaggcccgcaagctcagactggtactggcccgcctcggtcacgggttccagcgcatcgtattgcatgatctgagcatagctttgcccagccgtagagccgggggtgtcctgctcgcggcgcgacaccgccgcgctgaacgatgcccattgcggtgaaccgtaaaccagtgtgggaggaaaatccttgaccaaaaactccggggcagacatggccaacagctgataggccaccactttcgccatctctttcccgactcggccttccaagtgcctctcaaaaagccagacgatgtcctctggcgtccgcttccagttgtcttgctggcgcaaattatacccagccaaattattgcgctgccgccctccctcagggtcggcctccaaccctaacgcggtaagcagtgcctcctggccactggtttgactgggcactgcgtcaatcgcctcttgcaattgtttacccaatgcctgggcgttaggggtattgatcaatgcgctgagatacgcaccgggatttgagttggccagcgcacgctgtgccggtgtcagcgaacgcttcaggtagtccaaaagcgtctggacctggccggaggaagtcagcggcacctgtgtttgaagcgctttccaggcgccgacggtgtcgaatatttttttctggctgtcttcgctcaacggcacgtctttgcttaacagcccaccgtaatcagccacactgggtgcagttaatggcggtgcggccagcacgcgcgccaggttggcaactgcgtccggtgtggtgggcacttgcaagccataggccttgagcacctgcttgaggttcatggtgatcggttgcggttgctcctcgtcccagagcaaggaatgcggcgcgatctgtaccctaatgaattccaaatccacctgggcgccgggtgccgcactctgcgtcttcaacacgtcgagcatgttattcagcatccgggcttcgccggtcttgcgcaaaatctccagacgcgcgttgttgtcacccgccacgctaatagactcgttatctggcacgagacgacgtttgctcgtcttgggcgatgcagcctcggtattaatacttgataggcgagcatccgtgccagtaacgccaatacgctccgagttaacagcgggaaccgtcatacctcacctctaagatgatcggattaagcggtgttacgtacacgaaaaattaacagcgctcacacggacgcttgaattaataaagccataaaaaagtctggcgcccttgttaatacaagagctccagactgagtgaacgcgtaagagacgtgcggtacaccaggcaccaaggctaccgacaccttgatttatgtgcaccacttcaaggggtgatgttcaacccacgtgcaagtttttcttctatctcttttcgcgacttcatcacgacatcaagccgatcttccagtgtcttggtccgtgtttcgagcccttcgaggccagggggcgcctctatcggcggcaacttatcagtatagcaagctacattatgttccttagccaggtctttcatgtcctcctcaagtttatccatccgcacttccagctcatccataatcgctatcggctctaccggccattgatcacccggccgcatctccttatcaactttgccataggttaatttcagcaccgcgttcatggtctcgaatatattgacctgggcattttccatacgcacgcgaagcgcagccggcagtttattttctgcttcagtgttggccttatccgcttcaggggattgattcgtccctggcgctggcgcggtagccgggggcgtaggcggtgtatgcagaaattttttcttgatttcttctgccgttatggtcgtaaggacagtttcccctattttgatgggtatcgctgccaacgtacctgctgactctgagacggcaccgttaattgcagttctacccaaatctggacgtgaggggattgcccccgattcaagcaacttgttggtccagctcgcatttttggctgcgtcttcagtggtgggttgcggtgcagggggcttcgcagcctgttgagaatgaatgctgccaggccctctgagcggtttcggaacgtcatcggtctgcttatgaggttcattattacccttcactgcagttgccatagaccttgccacttttccgtctttgtccagaggcctgtcgtaagcatcaacccgatagccctctttgttaactcggttgccgtccttatcgataaattctcttttctcattaacgagccgcccctcccgattgatcaggcgaccttgtgggtctattgtgcggttcctgtggtctttagcgaccccttgagtatcaatacgctggttatattgattgatcttataaccgtgcttgtctatcgcatgaccgttaacatctacgcgttgatttgagctgttcaacggccagccttcggcgtccgtcttctgaccgggctttttctcgggcttgataattttattattggcatcatgggtagcacggggcgtgtcatgcgtgtcatgagtgtctttgttgtctttgttgtctttattggatttatgtgaagttcctgtactggactctgtcgtggttcctgtatcacctgaatgtcttcttctaccgctactaccgttacgacctgcccccctaggctcccgactatggtccaacgcatcaggggcactgtcggaaacaggatccagaggaggaacaaaaacgtttactgaaggaatatttagcatcgttagaaaacctatatcaaacatatcattaaataatgagatgccctccttgctctctaccctatgtgtgatcctgcccccttgatcggttccacagcaagtcatgtccaaacgaaactttgcacgctgtaaaaaacccttcatcatgcaatatgtaacatcctcataagcgtctaactttcccagtaagaaaaatctgctatcgttactcaatgcgtaacattaccagtgacccccttcatactttcttaacttccggtagcggatgccaagtgtttaagcggtatgggtcataggccagcgctgctgcgcaggggtgcccaacagcgctgttcactggacctcgtatcacagtgaaacgtccgctgaggtgatgggcgcatcaacgtgtggcagcgcgattcaacggcccgtttgaactcgccctccctgcggtgacgatcaaaatacccacctcattgatcgtcaccctcatgcagctcgggttgtcttaccagtgcctacggggctgccttcggctgaattggctgctggggcggtgtcgggcccgatgcgttttcctgaaactctcctgccgtctcagcatgatcattaccatcctttacagaagtacctgtgtcataacgaagatcacgcaactctttcactttaatgggcgtgaagcctggcaactgagggccgtagtgttccagcgtctggtgatcaaaggcgtaccagttgttgccttgcttcacggcaacgacgggaaccttggcaccgttttcacccagcggctgataagtgccttcggcgatggtctgtttgtaacctccgtgtgggatgtcccaactacgccctgggatgcgaagtttgctcgaaaacgaggacaagttgacaggcggcgccgcattcaaagcggtcttgcacactttgaataaaccactcccggagtcataaaacgcccctaccgggttagcagccttaacccctgccttaaccgcccctttgaaaaaagcaacggctgaacctacccctttggcgccgactttaacaccctggaagccgcctttagcgcccggtataaacaagccgacaaagtcaaaaaccccgctgacaaccgcctcatgcttatcgccttcgattatattttttataaggtcgtggaaaggaaggaggctcaacatgaagtttttgaacatcttcgttcgagctcttcttttttcggagtcgctcataccgttagccgcgtctttaagatcatcgaccgcttttttataaagttcacttacctgcccggccaaaacgccgacccttggcgatggcgtattcctcggcttaagaatatgcggcggtggcagttcttcagcaccgccatacttccaaataggttttaagttgtaacgcttccccgcaacattcaaactgaagaaaggtgcggtgcgactggaatctacactccacccctcagggacgccaggcagaggatcaccattcttgataatcttgcctaactgtggtgagtaaatatactcaacctttttaccctccaataccgtagtgatgagaaacgcaccacttccgaacatctgaaataacgcattactctcactgtctttaggaaaattagaacccgcgggttggctcaaatgcctcatttccattttgccaaactcaaatctcttcagatcttcatccgggagctgcgacacttgatacgcgaacatctcacctgcagccttgctgaagctgtcggtgtactcatcaaatttttcaacgaattctttcttgatatcaggcagctttttaatgcctgcgtgtaaaacggcagtcgtaagggttgaatccgtagaactccagctggccgtgagctcacccgacataaaaagattcaacaaggtgtcttttttcagattcagccccatggggcgggtgagtatttttttctcaaacaggtgtgcattttcttcgccgtatatctgcgttaatgccgccagcgccaaatcccggcgagtcggcagtggcgctaaaacacctttcagagcagtcgccatacggttggcctcctcttccagggcagccgttacactggcgatggtttcagcgctatagccttcactgttttccttaatgatgcctttggccagaccccagtcgaccactgcctgcagtgcagcagctttcgtctgagactcctgttccagggtaacgggctccagatccgcttgcgccctgatctgaacatagctctggcccgccgacgatccgggggtgctctgttcgcggcgatatacttcagcgctgaacatgacccattgcggggagccaaacgttaccgactctggcacatccgtgaccaaaaactccggagccgacatcgccagcaattggtaggcggctactttcgccatctcggggccgacgatacctgccatatgggtttcaaaacgcttgacgatttcggctgccgtacgccccacattatctggttggcgcaagttatagccggccaaattatcgcgttccaaccccgctgacgatttgttggcttccaaccccaatgccgtaagcagtgcttcctggccactggtagcggtaggcaatgcgccaatcgcttcctgcagttgcttacctaatgcacgggcttgaggggtgtcgatcaaggctttgagaaacgcctctggatgggtgtcggccagggcattcgaagactctggaaccgcacgcttgaggtactcgaaaagactgggagccttaccctctgcgtccagcggaacctgagtttgaagcgccttccaggcactcacggtttcgattatctttttctgagcatcctcgcccagcggcacacttttagtcagcaacccaccataattaccttcacgtggcgcacttaacggcggtgtgaacaatacgcgctccaagttggcaagtgcctccagtgtggttggaacttgcaaaccgtaggcggccatcaattgcttgaggttcatcgtgatcggctgcggctggtcttcacgccaaaaagcggagtgcggtgcgatctctacgacgatggattccaggtccggcttcgcgccgggcgcctcaatctgttttttcaaagcggcgagcaggttatgctgggtttcggcttcgcccgtcttgtttaaaatagtcgcaggcacgtgatcatcagccattgagttcgactttgggtcatcaataaattgacgaataaagttcgaatcgaccgtgtacgtgctgtgccctaattcttcgattttaaaaacatcgccacgcctaaaggtgctgtcaggcgccagctttttagcgatgatcatcaagttgtcaaacaacgctttaccgcccggaatagcgtcaagttcaggcgagtctctatttatttttctatgcccgccgtcaaaccagatctcacctttactgtgatcaatgtgagtaaacgcaccacgcgcaccctccagttgcgtgaacgcagaagagttggtcgcaaacctcagcgcttcaagccatccccccaaggtcgactccggtggaaccggcaggcgcgatccggctgattgctgcttcaaactatcttgcttgagacacgcatccgccgccgctcgtgaagtttcagtgctacccgccgacgtgttctcatgcgtcgtggacggggcactactcgcgccagggctgaactgaggaacatcattctttggcgagccaagaggcgcaatatttatattatgcacagtcataagtaatctctttgacggttttgatgaacggctcacaaacgcacctgaatcaatagcgcaattcgcgaacacattgtataaagccggccaagtttaacgcccacttaatgagcgctaactttcagagtcaaccgttcgaacagccccacactggcgagctgttttaaatccctataacatgagcgcagaccaactgatcagcaaagctaacctgccagtacttgacattgaacagaggctctctcggccctcagttattaagtggccctcaccacccaatcagttccagaacaactaagacaggcagcggttatatcgattgaatataactaacaaccctatagatctaccctatgaactaacactcgcacgtgagcctactcctctttacccccctaatcattgcgcttggacaccaccacgccatgtttgcgcaatttgcggtagagcgtattacggctaacggccagttgctcagcggtacgggttatatgccaacgttgctgttcaagcgcagtcaatagggtttttcgctccgcctcatccagcagcgacgtgctcaaaggcgcaacgcttggggtgcgcacgttcacaggtaaatcggcctccacaacacggccgttctccgccaacgccaccagcgtgcgcaacaccatgcgtaattgccgcacattgccaggccaggcgtaagcaagcagcgcctctcgtgtcgccctgtctactgtgaccgcctgccctgctgactcctggtcgagaatgaaatccagcaattgagccttgtcagtgcgctcacgcagtgccggcagcgccacctccaaaccattgagccggtaatacaagtcctcccgaaaactgccggcctcgactcgctcactcaaatcacggtgggtagcactgatgatgcgcacgtccactgcctgcgcagccccgccgataggcaccaccatgcgatcttccaacaccctcaacaggcgggtttgcaaagcgaagggcatatcgccgatctcgtcgagaaacaacgttccgccatcggcttcttgcagcttgccgcgcataccctctttaagggccccggtaaaactgccgccgcgatagccgaacaactcgctctcaatcaggttctcggggatggcggcgcagttgatggcgacgaaaggcttgcgggtgcgcaggctggcgtggtgcacagccttggcaaaggcctctttgccgcaaccggtttcgccgcggatcagcaacggcacgtcgcgctcgaacaccttcaacgccttgcgaaaatcattctgcagggccggagcacccaagcagatgccgggtaaccgtggcgcctcgggcttggccagtggcaacggcacactgcgcggctgcccacgcaatgcggcgaacaaacgccggccatcacgggttcgcagcggccaactggccgtggcagtggcgcaggcgcggccgagcagttcgtcgagggaacagtcgaacaacgcctccaccggctgacccagtaaaccaccgcgcacctggccgagcagattcagcgcactctgattgaccgcgcagacgcgcccttcgccatcaaacgccagcaacccttcactgaacagccccacggactccgcctgcaggtgaaaacgcagcagccagtggttttcaaagtggcgcaggaagtaacagctctcgatcatcttcgccgacagattcaccagcgccatggtgtggaactggctctggcgcgacaccgcctcacgcgccgaggacacgtccagcaccgccaataattcgccatgagggtcaaacaccgggctcgccgaacaggtcaagccggtgtggcggccacgaaagtgctcatcgcggtgaatcgtcagcgattggcgctccaccaggcaggtgccgatgccattggtgccttcgcacgcctcgctccagtcggcgccgagccacaggccggcgcgctcgaaaatcttgcgctccgacggtgcggtgacgcagttgaggatgaccccgcgcgcgtcggtgagcagtaccgcatggccggcgccggaaagctgttggtgcaagctgttcatctcggtgccggcaatatgcaggacctgttgcagacgctcgcggctttccagcaagcggccgtgttcgagcacggtgggggcgatgctcagcgcggggtcgaggtggtagtcctcgatgcaccgcagccaggagcgcgcgatggacgggtcgctggcggggccgtgcgcaaggtcttgcccgcgcgtaaccgtaaggacttgctgggcatggcgactgaaatgatcgttttgcatgttcttattattctctctgcgggagaacagccagcatcccccagcctcccgaccattgcaatcccgggcaggcccacccgtcacaggctgtaccgtttatggcacaaactgtcacccggcctgtaccaaccctgtcacagcaacgccttgcgacaaaccctatccccttgatttacctggcctgcacagcagtggcccgacctttgctctacgctttatcaagcgcaagaccgctgtactccaataaacataaaagcaggagataaccaccatgcgttacgcacatcccggtactgacggcgcgatcgtttcattcaaggccaagtacggtaactacatcggcggcgaattcgttgcgccggtggatggcaactacttcaccaacacctcgccggtcaacggcaagcccatcgccgaattcccgcgctccacggccaaagacatcgacaaagccctcgacgctgcccatgccgccgctgatgcctggggtaaaacctcagcccaggaccgctcgctggtgctgctgaaaatcgccgaccgcatcgaacagaacctcgaactgctggccatcaccgaaacctgggacaacggcaaggccgtgcgtgaaaccctcaacgccgacatcccgctggccgccgaccatttccgctacttcgccggttgcatccgcgcccaggaaggcaccagcgccgaaatcaacgaactcaccgcgtcgtatcacttccacgaaccgctgggtgtggtcggccagatcatcccgtggaacttcccgctgctgatggctgcgtggaaactcgccccggccctggcggccggtaactgcgtggtgctcaaacccgccgagcaaaccccgctgggcatcaacgtgctgatggagctgatcggcgacctgttgccgcccggcgtgctcaacgtggtgcacggtttcggcaaagaagccggcgaggccctggccaccagcaagcgtatcgccaagatcgccttcaccggttccacaccggtgggttcgcacatcatgcacgcggcggccgaaaacattattccgtccaccgttgagctgggcggcaagtcgccgaacatcttcttcgccgacatcatgaaagccgaaccatcgtttatcgaaaaagccgccgaaggcctggtgctggccttcttcaaccagggcgaggtgtgcacctgcccatcgcgcgcactggtggaagagtcgatctacgacgacttcatgaaagtggtgatgaagaaaatcgagcagatcaaacgcggcgacccgctggacaccgacaccatggtcggcgcccaggcgtccgagcagcagttcgacaagatcctgtcctacctggaaatcgccaaaggcgaaggcgcgcaactgctgacgggcggcaaggtcgagcagctcaccggcgacatggccggcggttattacatccagccgaccctgctcaagggcaccaatgaaatgcgcgtgttccaggaagaaatcttcggcccggtggtgagcatcaccaccttcaaggacgaagccgaagccctggcaattgccaacgacaccgaattcggcctgggcgccggcgtgtggacccgcgacatcaaccgcgcctaccgcatgggccgcgcgatcaaggccggtcgtgtgtggaccaactgctaccacctgtacccggcgcatgccgcgttcggcggttacaagaagtcgggcgtaggccgtgagacgcacaagatgatgttggaccattaccagcagaccaagaacttgctggtgagctacgacattaatccgttgggctttttctaacccatccatagctgacagttggctccccacttgaaatgcaatcaagtgtgggagctggcttgcctgcgatggcggtgtgtcaactaagcatgtggtggctgacacactgctttcgcaggcaagccagctcccacagttgaacttcgcaaagtagttgctacctcattcggcacaaagaggccgagttaaaacaataagaatggacggtactttcccatgcctagcgaacccactggctcttccgtcgactttgaaaaagtcgactcccactacttccaacaacgcgaactgaaaaaaggcgccgccggctgggtgctgttggttggccttggcgttgcctatgtgatctccggcgactacgccggttggaacttcggcctggcccaaggcggctggggcggcatgttcctcgccaccttgctcatggccaccatgtacctgtgcatgtgtttctccctggccgaactgtcttccatgatccccaccgccggcggcggctacggctttgcccgcagcgcctttggcccctggggcgggttcctgaccggcaccgccatcctgatcgaatacgccatcgcccccgccgccatcgcggtgtttatcggcgcttattgcgagtcgctgttcggcattggcggctggatgatttacctggcgttctacatcatctttatcggcatccacatcttcggcgtcggtgaagccttgaagctgatgtttgtgattaccgccatcgcagcgattgccttgggcgtgttcctggtgtcgatggtgccgcacttcaacgtcgccaacttgctggatattccagtcaccgaggccaagggcgcgagcaccttcctgccgtttggctacgtcggcgtgtgggcggcgattccctacgcaatctggtttttcctcgccgtcgagggagtgccgttggccgccgaagaaaccaaaaaccccaagcgtgacctgccccgtggcctgatcggcgccattgtggtgctgaccagttttgccctgctgattctggtcatcgcaccgggcggcgcgggtacttacgcactgatcaagtcgggcaacccgctggttgaagcgctggcactgtcttacggcggttcgacctggatgggcagcttcgtcaacctcgtcggcctggccgggctgatcgcgagctttttctcgattatctatgcgtattcgcggcagatctttgcgctgtcgcgcgccggctacctgccgcgcaagctgtcgcaaaccaacaaaagcaaggcgcccgtgctggccttggtgatccccggcatcatcggtttcggcctgtcgctgaccggccagggcgatttgctgattctggtggcggtgttcggcgcgaccatttcctacgtgctgatgatggccgcgcacatcaccttgcgcatccgtcgccccaaaatggaccgcccttaccgcacgccgggcggcattttcacttccggcgtcgccttggtgctggcctgcgtggccgtggtggcgggctttctggtggatccacgggtggtgattggcgccgcgatcatctatggagtattaattgcttactttgctttctacagccggcatcacttggtagcaggcacgcccgaagaagaattcgcggcgatccaggccgcagaggccgccttgcactaactgccgtaaacctcgacgcgggcgctctctcattctgcccgcgtcgccaaggagacactgtatggcaagcttttcccacgcggtgggtgcacagacctaccgcttcgacagcctcaaggacgtgatggccaaggccagcccggcgcgctccggggacttcctcgccggcgtcgccgcgcagaacgacggcgagcgcgtggccgcgcagatggcgctggcgaatatcccgttgaaacacttcctcgaagaagtgctgattccctacgagcgcgacgaagttacccggctgatcatcgacactcacgataaacaggcgtttagcgtggtcagccacctgaccgtcggcggcctgcgcgactggctgctcagcgacgcagccgatgaacattccctacgcgccctggcgccagggctgacgccggaaatggccgccgccgtgtccaaaatcatgcgcgtgcaggacctggtgctggtcgcgcagaagatccgcgtggtcacccagtttcgcggcaccatgggcctgcgcgggcgcctgtcgacgcgcctgcaacccaaccaccccaccgacgaaccggccggcattgccgcgagcattctcgacggcctgctttacggcaacggcgacgccatgatcggcatcaacccggccaccgacagcatcgcctcgatctgcgccatgctggaaatgctcgatgcgatcatccagcgctacgaaatccccacccaggcttgcgtgctcacccacgtcaccacctccatcgaagccatcaaccgtggcgtgccgctggacctggtgtttcagtcgattgccggcaccgaggccgccaacgccagtttcggcatcagcctgagcgtgctgcaggaaggttatgacgcgggcttgagcctgaatcgcggcaccttgggccagaacctgatgtatttcgaaaccggccagggcagcgccttgtcggccaatgcgcactttggcgtcgaccagcaaacctgtgaaacccgtgcctacgccgtggcgcggcacttcaagccgtttttggtcaacaccgttgtaggctttatcggccccgagtacctgtacaacggcaagcagatcatccgcgccggcctcgaagaccacttctgcggcaagctgcttggcgtgccgatgggctgcgacatctgctacaccaaccacgccgaagccgaccaggacgacatggacaccctgctgaccctgctgggcgtggccgggatcaatttcatcatgggcatccccggctccgacgacatcatgctcaactaccagaccacctcgttccacgacgccttatacgcccgccaaacactgggtttaaaaccggcgccggagtttgaacagtggctggcgaaaatgggcatcttcacgcaagccgacggcaaggtgcacttcggcaacagcctgccaccggcatttcgccacgccttgaagcaattgggatgaaggagccgcctgtgcaactcgacctgcctgacaacccgtggctggaactgcgccgcctcacgccggcgcgcatcgcgctgggccgcaccggcaccagcatccccaccagcgcgcagctggattttcaattcgcccacgctcaagcgcgtgatgccgtgcacctgcctttcgaccatgagggcctgagcaaccaaatggccgagcgcggccgtgacagcctgctgctgcacagcgccgccgttgaccggcatatgtatttgcaacgcccggacctgggacggcgcttgagtgacgaatcggcgcagcgcctgcgcgagtatgctgccgccaaccctggcggcgtggacctcgccgtggtggtggccgacgggctgtcggcgctggccgtgcataaacatacgctgccgtttcttacacgcatggaggaacagacccacgctgaaggctggtcgttgtcgccggtgatcctggtggaacagggccgtgtggcggtggcggatgaagtcggccagttgctgggggccaagatggtggtgattttaatcggcgagcggccggggctcagttcgccggacagcctggggctgtatttcacttacaaccccaaggtcgggctcaccgacgcctaccgcaactgcatctccaatgtgcgcctggaaggtctgagctacggcatggccgcgcaccgcctgctttacttgatgaaagaggcgtgtcgtcggcagctgtcgggggtcaatctcaaggacgaggcgcaggttcagaccatcgaatcggatgatcctgacctgatgaaaggcaatttcctgctcagcccgccggaatgactgatcgctgcacgattgcgcttttttgcgtcattaggcagcatccggtcacggccgcttgtgtggtcataccccctttggaagttgaggcctggcatgcggattactcaagcgacccttgaacacctggacctattgacgccgctgttcgtcaaataccgcgagttttatggggcgctgccgttcccggactcgtcgcgggcctttctggaaaaacgcctgcgccgcaaggagtcagtgatttacctggccctggccgacgatgacgacaagcgcctgctggggttttgccagctgtacccgagctattcgtcgctgtcgcttaaacgcgtgtggatcctcaatgacatctacgtcgcagaagatgcgcgtcgacaattggtggcggacaacctgatgcgcacggcgaagaaaatggccaaggagacgcatgcggtgcggctgcgggtatcgaccagcagtgacaatgaagtggcgcagaaaacgtacgagtcgattgggtttcgtgaagatacggagttcaagaactacgtgttgccgatcagtgaagactgacttccaaacaccactcgtcttctgtgggtgctggcttgcctgcgatagcggtaggccagtcagcccaatgttgactgacactcagctatcgcaggcaagccagctcccacaattagatctccagtgacctgaagcgcaaacatgcccggaataaccacgacatcccccgctacaaaaccagcacgcttttcacctctcaatacgtataatgcggacctttcagggttgtaagaaatacggcatgcctttgtagccttacttacccgagcttccgcacaggcctgctgagccgggccattcacacaggtgccacccatggatttcaacccgctcgaccttatcctgcatctcgacgtctacctcgacatgctggtgagaaactacggagtgtggatctacgccattctgttcctggttatcttttgcgaaaccggtctggtggtcatgccattcctgcctggcgattccttgctgtttatcgccggcgccatcgccgcaggcggcggcatggacccaatcctcttgggcggcttgctgatgctggcagcgatcctcggtgacagcaccaactatgtcatcgggcgaacagtgggagaacgcttgttcagcaacccgaactcgaaaatcttccgccgcgactacctgcaaaaaacccacgatttctacgacaagcacggcggcaaaaccgtgaccctggcgcgcttcctgccgatcctgcgcaccttcgcgccgttcgtggccggcatcgccaaaatgccttacccgcgcttcttcggtttcagtgtgttcggcaccatcctgtgggttggcggcctggtgaccctgggttacttcttcggcaacgtgccgtttatcaagaagaacctgtcactgctggtagtgtttatcatcctgctgtcgctggtgccgatgatcatcggggtgttccgcagccgcttcggtcgcagttcttccgaagccaagccgcagtaaccagcgatgtggtccctcagcgcctggcgtcgccggcgcctgctggccaagcacccgattgccgatgacacgtggcagcgggtgcgccagcatcttagcttcctcgacggcattactgccgagcaagaccaatggctacgtgaagcctgcgtggtgttcctcgccgaaaaacacctcaccgccctgcccggcgtcgagctgcaccaggagcaacgcctgctgctcgccgcccaggcgcagttgccgttgatgaacctaggcgacctcgactggtatcagggtttccacgaaatcgtgctgtaccccgacgacttcatcagcccccagcgccatcgcgatgccagcggcgtcgagcacgagtgggacggcgaacacagcggcgaagcctggcaacaaggcccggtgatcctcgcctggcccggcgtgctggccagcggcaactgggaaggctacaacctggtcatccacgagttggcgcacaagctggacatgctcaacggcgacgccaacggcctgcctccgctgcaccacgacatgcgcgtgcaggaatgggccagcgtgatgcaaagcgcgtttgatgacctcaaccgtcagctggacgccaacccggacgtcgacaccgaaatagacccctacgccgccgaaaacccggcggagttttttgccgtcaccagcgaatactttttcagtgccccggatttactggtcaacagttatccacaggtgtacgcacaactgagcgccttttatcgccaggacccgcttgcccgcctgcaccaactgcaagccggcgatgcgcgctaccagacggaacgccaagcgccgtacgacgtctgacgcatggcatcggcgtcagaatatgcctataatcgccgccacttttaggccaatccggccatgtttcatggccaactacgggggcatcgcccaatgagctacagcaagattccggctggcaaagacctgccgaacgacatctacgtcgccatcgaaattccggccaaccacgcgccgatcaaatacgaaatcgacaaagacagcgactgcctgttcgttgaccgtttcatggccaccccgatgttctacccggccaactacggtttcatcccgaacaccctggctgacgacggtgaccccctcgacgtgctggttgtaaccccttacccggttacaccaggctcggttatccgcgcgcgcccagtcggcatcctgaacatgaccgacgacggcggcggcgatgccaaagttatcgcggtgccacacgacaagctgtcccagctgtacgtggacgtgaaggaatacaccgacctgccgccactgctgctggaacagatcaagcacttcttcgagaactacaaagacctcgaaaaaggcaaatgggttaagatcgacggttggggcaacgcagacgccgcccgcgccgagatcctgaagtcggtagctgcctacaaaggctgatacccgctcctcattgccccggcaatcaaaaaagccccgacgattcggggctttttttgtgggaaaaattaaaccccaagttcaatgtttaatgcgcagcgtttaataaagttaaaatattgaaatatcggcctacaactaagcaaatccctacacgcgacattcaacgcatagtttatttgatgtatttttccggccagtaaactctgcgtttatgaatacatcaggtgatcgactaaaagcgttattacgggaagttcatctttccgcctccgacttcgccaagaaccgcggtgtcacgcctcaacacgtgaacaactggttcaaacgcggcgtgcccatgggccgactcaacgagatcgcagaactgctctgcgtctccagccgttggctacgcaccggcgaaggcctcaaacacccaccggccaacttcctgctggaaggcccggacaccgccaaaggactgcgtacccgcgaagaaagcggcaaatacctcacaggccccgcctgcctcccggaaaaaatcgacgtggagatcgccctccaccccaccttcacctccaacgaacgcatccgcgtcaccctgcacaccctcaaagccctcaacgtcaaccccgaccgcgccataggcgcctacatggtcgacaacagcatgatcgacatcatccaacaaggcgccaccctcgccatcgaccgtggccgcagccaaatcacagacggcgaaatctacgccgtcgaacacgacggcatgctacgcatcaaatacctctacaaccgccccggcggcggcctgcgcatgcgcagccacaacgccagcgaacaccccgacgaatacctcacctacgagcaacgcttcgaacagaacttccagatcgtgggctgggtgttctggtggtccaccctcaacaaccgccgccccgtgcccctggacgaacacctgctgggctgggaaggctctaaatcggacccggaggtaggcatttgaggtgaatgtgagtatcatccgccgcacatttggcagggggtggcttaaagctattcaccctgctcggcgatgcggaggagttcccgcggatgcccctactattcagcccgacatgatgtgggctgagcgatttgaaggctggtgaggtttgtcaaaaacaagctgaagcagtccccgagaagccggccacaagccggctttttaatgtctggaattccccgatcagcacggcctgctaaatcaaatagcctcacgcctaacaccattctccaatgcctgaatggcgtccaaaaaaactgaccttacgctcagactgcaaaaagctcacacccagaacgaattctcttacaatccctgtctagttttccaaatccacttacggatgcgataacgattggcgatcaagaggcgagcctgtgagcaaagtaggtagcacatccgagcacctggtgaacgttgaaaatctttctgcttcattgcagcgctttgctgatgatcgtgactggcgacaatttcattctccgaaaaaccttctcttggcactgacgggtgaagtgggcgaactctgcgaaattttccagtggatgagtgaggccgagtcaatggacgcagcaaaacgccccgaaacagcccaagccgtaaaagacgaactcgcagacgtcctcatgtacttggtccgcttggctagcgtgctggacgtcgacctcaacgaagccaccaaaagcaaactcgcacttaacggtttgaagtaccccgtcgataaagccaaaagctccagcaaaaaatacgaccaactctgacatacaacgcgctaaggatttctcgtgatcgtttacgctgcgaccaaacagcaattcctaaaagacaacgataacgacgacatcgaagaggtcattctcaggcactacaaagaagccacgggcaaacgcgttggggcatcggagataaaatcctggcagggctcgctgacgtatatggcgaaggtgcttcgagacgaggggctaccgaatgacgctgggttggctattgaactgcacatcccccaatcctcgaagcgtatcgattttttgatgactggcagggatgcaaatcagggtaaaaatgccgttctgattgagttaaaacagtggagcaaatcgacagcgaccaccaaggacgcaatcgtcaaaaccgccttgggtggcggcatagtggaaaccatccacccgtcttatcaagtctggtcatacgccgcattgctggagggattcaacgaggctgtctatgacaagagcattgatgtccgtccctgtgcctaccttcacaactatgtcagtgatggggtcataaattcagcgcattacgaggcgtacatcagcaaagctccgctgttcctaaagggaccggatgagctggaaaagctgcgcacttttctcaagacacacatcctttacggcgataacaaggaaatactctatgagctttccaatggcaaaattcgcccgtcgaaggctttggctgacgcacttaaaggactactaaaaggccagccagaatttatattgatcgatgatcaaaaagcgacgtttgaatccacacttgcagcggcgagtaccgcttctgaggctgcgccgaaggtgattatcatcgagggcggcccagggactggcaaaacagtcctggcaatcaatttgctcgtgaggcttacaagccttgggttactgggcaaatatgtttcgaaaaatgctgcgccgcgaaaagtgtatgagagcaaattggtaggtacggtcaaacgcagtcacttttccaatctattctccggctcaggcgccttcatcgataccgaacccaacacgtttgatgcactaatcgtcgacgaagcccaccgcctaaacgaaaaaagcgggctctacgctaatttgggtgagaaccaaatcaaggagttgatcgagtcggcgaagtgcacggtctttttcatcgatgaagaccaacgagtcaccttgaatgacattggtagcaaacaagccatacgagcttttgctaacgcaaaaggagcagagattgaggaatacacgctgtcatcgcagtttcggtgcagtgggtccgacggctatctggcttggctagacgacgtgttggatatccgtacaaccgccaaccaactgcttgataacagcgagtatgaattcaaaatattcgacacgcctcacgccatgcatacggcgatcgagcagaagaatcacggtaacaaagctcgggttgtagccggttactgctggccatggcgaagcaagaaagatgctcgagagtccgacatcgtcataggcagcgactacgaacgccaatggaatctggatcaggacggcagtttgtggatcatcgcagagaactcggttgatcaggtcgggtgtatccatacctgccagggtctggaggtcgattacatcggcgtgattatcggaccggatctcatcgtacgggatggacgcgttctcacctcagctctagagcgagataaaaacgacaagtctattcggggctggaaaaagatgatgaaagagcaacccgaccgggccaaacgggaaacagacttgatcatcaaaaacacctaccggaccttgatgactcgaggcatgaaaggctgctacctgtactgcacagatcctgaaacagctcaatactttgcggctcggcttacaaaccaaatccacgattgatagttcatgggcgcttgcctcgattacacgaagcaagcgcctcgcatcacctcggctgcaaacactccacagcccgatctgccaccatcttcgccatctccaccaaatgcatcaccgcccgatgcggcgcccccagcgggtcacccagcgcctgcgacgtagccaccgcacattgcagcaactccgccacacgcacccaggcatcctcaaagctcagctcttcattaacagtgaatggctcagtcgcagccgataacagcgaatccgaaacaacatcatccatagcaaaactccaatcgataatttggagctgccacgacccgcgactaaacgaaaggcggcagctgtacgcaggttagtcgaccggtcgattggaaacccggcgcacccggaggtgccctgcgcacagccaccataagatgcaggcgaagggatgcctgactcatgaagtgcttatgcgccaatcgaatccgggcgactaaacccgatcactgaaaattgcagtgacggtccgcagcctagtcccgcgattttgctggcgcaagccgctcggattctctaggaaacgtcctgcaaatgaaagggaccggtactgctggccctccaaccactgtcacttctgagttgacagtattacccctcccacccgatttatccctcaccacccacccattaatctatgcccatgttgaacgcaacgcccaacccaacctaaccaaaaaaggatttcaaccatgagcactccaaccctcagccgcttgaacaaagacgacgccgtagttctgctggtcgaccaccaaaccggcctgatctctttggtccaggacttctcccccaacgagttcaagaacaacgtgctggccctggccgacctggccaagttcttcaacctgccgaccatcctcaccaccagtttcgagcaaggccctaacggcccgttggtgccggagttgaaggagatttttccggaggcgccgtatatcgctcgtcctggtcagattaatgcgtgggataacgaggatttcgtcaaggcggtcaaggcgactgggcgtaagcagatcatcattgcgggtgtggtgacggatgtgtgtgtggcgttcccgacgttgtcggcgctggcggaggggtttgaggtgtttgtggtgacggatgcgtcgggcacgtttaataccacggtgcagcaggcggcgtggaaccggatgacgcaggccggggcgcagttgatgaattggttttcggtggcgtgtgagttgcagggcgactggcgcaatgacatggaagggttggggaatctgttgtctcagcgtatccctaactatcgcaacctgatgaacggttatgcggcactgacggcccgccaaaactaagccctggccgctctacgataagcctgccttgaacggtgggcttttttgtgtgcgtttgtcttactgcataaatgttcccaaatagccttggcgttgtgaattgttgtgaaggcgttgcgaattgagcaaaagtccgtgctaagttccgtgacgttgcaattcacagcattcatgcacagcggcctgccaactaagaccgccctcttgttattcaataaacagcctcgggtagttaaccaggaagttgtgcggccctgcgcgctttaaaagtggccggcgcaaacattagatcaggagaagcaccatggtagcgaaggtagaaacgaccccaaaggacgccgcggtcacccctaaaagctccgtcgctgcctgggaaaaatcggtcaaaaaagccgctgcgccgaaggatgagttgggtaaaggccagaagcgccctgaaggtgatacgcgctcggcccagcaaattattgatgacacgccgctgctggccaagctcggtaatcagagtggggtgaaggacaacctcaagaagcaggtcggcgattttgagaaggacgcggatgcggcttaccgcgcctccaaggtgctggagcatgtcgaatatatcgacgaagacggcaagctgaccgatggcaaggacgtcggcaacagcagcatcgacggcttcaccaaggatggcgaggcgcggcatggcactgaggcgggccgcctgcaggattttggcaagtatggctattcgagcctgcgcggcgaggtggtgaagtcggatttgggcgatcagcagaagcgccccgacggtgatacgcgctcggccaaagagattatcgacgccacaccgctgctgaaaaaccttggcaaccagagcgatgtgaaggacaacctcaagaagcaggtgggtgacttcgagaacgacgccgacgccgcgtaccgcgccactcaggtgctggaacacgtggtgagcctcgatgaaaacggcaacttgctgaccggtatcgacgccagaaataaagacaacgacagcattgatggcttcaccaaagacaaggaagcccgccacggcaccgaggccggccgcttgcaggatttcggcaagtacggctactcgagcctcaaaggcgacctgatgcatgtcaaagacgccacccattccgacaaggccgcgccgcccgatgagccgcaagacgtgcaggccctgcgcgacaagtacaacatcccgaccttcggcgccgaaggcctgatggacatggagttgcccaacgacaagaccgtgggcggccagacggccgagaactttgtgcagggcatccgcgatgacatcaagagcggcaagctggccgaagactcggatgaagccaggatcgtcaagctgatggacgcgcaagccgcgctggacagtggctatgacctgtacggctacgcggaaagtatcaacctgggcagcggcacttaccgtgagacggataaaacgccgactaagttgaatggcaaagatgtgaaggaaatggtcgacgaggacaaactcgccaaggaaatttccacactgatgggcaaggaaggcattaaggaccgttacgacgctgaactaaagaaaagtgtcggtagtttgtcgcaagaccgtttgagtgaagtgcgcgaacaagtgttcccggcactcttcaaggatggcacgcgtgatgccaacttgaactttgaagactatgtcattgccatgaacgactcgggtgacccgaaaaaatctgaaacggctgagttggatgtggaccgctatttcgagtcgctgcgcattctggaacccgacagctacaccgcgcgccgtcagacgtttgaccagaacatgatgacgcaccagctcaacacctacatggaaaaccccgacaaggtctcgccggaaaatgccgaaagtggcctgaaggcttcgttcacgatgatcaagggcggtatcaatgccgccttgggtggcctggacaagggcgacaaagcctacgacatgtacaaaaagatgaaggatgagatcgacatcctcgacggccatatcaaaggcctgaccccggcagaaaacaaacagatcgccgcggccattcgcctcgctgccgccagcggcgacccgaaagccatcgacaaagtggtcgacacccagttgaagggcctgggcgccaatcgcgaggcggccgccggctccttgaagaccatgctgcacaccgccagctccaccggcgggctgagtgccatggccggcacgatgaacctggtcagcggcgccctgcagctggccaacggcggcggcaacatgaccgacgaccagaaaatcgccgccgcgaaagacctggtgtccggtttgagctttaccaacgactttctcaagttcggttcgaacatcgtagaaaccctgggcggcactaaaacctatgacccggccgtggacaaagacggcaaaggcccgccgaaaatcaaggccactgaatggcttggcctgatcgatgagaacctgccggatatctggggcaagaaaaccacggaaaaatctgacgcattggccgcatccatcagtacccgcgtcaaagaatcttccgaaaccctgaagaaactcgatgtgggcaacctgtcggccgatgaggtcaaggaatacgacaacgccgccaaatcccttggcgagcagatgggcgtcaaggacatccccggcaaaggcacccccgcgtcaaaatccgaaatcgccatcgcctccgggcgctcgttcctgcgctttatgggcggtgccggcctggacctgaccggcggcgtgatggacatcgtttccggcgcgcgcaaactgaaaaatgccaagaccgcactggaaaaaactgacgcggccttcaccctgggcggtggcgcgtccggcaccggtatggcgatcgccaataccatcgcgatgttcgcccccaaaggtgctcacctggctgggaaactggccggcgacgttgccgcaaccgtggtccgcgggctcgccatcggcgcccgcattgcagggccggttttcgccgtggccggtgtgattttcggggtagcaggcacgctgattgccgaagcggtcgagcacgccaaaatgcaaaagctcaccgactcccaaggcaagttcttcaaggacctcgccgacgccggcgtgaccaaggacgactggggcgacaagctcgaatacgcgcgttatgccacctacatgtacggcggccgcgatacaccggacgacaaatcgatgttcgagtaccagtcggacgagtggaaacacttcaaggaaaccgaagacaaaaaaggcagctccctggcgcgtctggcgccgtacctgcacaaagacagcgaccccgacagcaagaacctgtgggaaaaattcctggcgggcggcaccagctccagcggtccgcacggcagtgaacggcacaccgatgactggcggccgtggggcagcacggacatggagacgggcaaaaaggaaagggcctgattttatccattcaacggttacagcctggcctgaacggcaggctgtaaccgttatacgcacctagcctgccagctcccgctcaatctgctcaatgcttggcaaacttgtttgcagctctgccggtaacgattccaccaactgatattccgccacgccgatcggccggttgttgtcgcgcaatgcgtattcagccaccacttcatttttgctcttgcataacaacaggccgatggtgggcccgtcctgcgggtgtttaagctgggcatccactgccgacaggtaaaaactcagcttgccgaggtgttcaggcttgaatttgcctgtcttgagttcgatcactacgtagcagcgcagcttcaggtgatagaacaacaggtcgacgaagaactcatccccgccaacatccaacaacacctgctggccgacaaaggcgaaaccggcgcccaattcaagcaggaagtcggtgacgtgcttgattaacgcgttttctatatcgcgctcctgtgcatccaaagccaggctgaggaagtcgaagcgataaggatccttgagcgattcgcgcgccaggtcggattggggtttgggcaaatggtgttcaaaattgctgacggccttgccactgcgctccagcaggcgatgctcgatttgcatcacgagggtgttacgtgaccagttgtgttcaattgcctgggcgatgtaccaccggcgcgtttcggggccggggagtttgtctagaagcaccacattgtggccccacggcaattgtgcagcagcctgttgcacaaattcggcattcggccacgcctcggcaaaagcgcgcatgtatttgaggttgcgcggcgaaaagcccttcatcttggggaaggccgcgcgcaagtcttgggcaaggcgatcaaccaccttgctgccccaaccctgcgcggcctgacgggtcagaatatcgtggccgatctgccagtaaagcagcaccagttcgcggttcaccgccagcgtcgcccgctgctgggccgtatggatgcgcagtttaaggtcgctcagccagtcgctgtagcccacaggaggcgtgatcaagccaatggagatttcgctcatacccatttcactcttgactggaggggcagaagctagtcagtggtttttactgtcacaaggggctgcgaacggttcaggaagggccttgcacagatcacagaaacgtcctgctggcctttgcaaatcggcgcattgcggcgccgtgccttgactctcccctatacagcacaccctaccctgaaaggcccactttcaggcttcggcaccatgactcagcgcatcttgctcattctcggccacccctccagcaccagtttctgctcagccgttgctgacacctacattcacgcggcgaaaatcgccggccacgaggtccgcgtcctgcgcctgggcggactggctttcgacccggtcctgcataacggctacacccagccccaagccttggagcccgatttgctcagcgcccaagccgatattctctgggcgactcatctggcgtgggttttcccgatctggtggggtggcatcccggcattgatgaaaggcttcatcgaccgcattttcctacccggctttgccttcaaataccgtaagggcaaggcattcccggataagctgctgcagggccgcaccgcccatttattggtgaccctggacacgccgccgtggtattaccgctgggtctatcgcatgccgggcattcatcaggtgcgcagcacggccctggccttttgcggcatcaagccgacccagacgctgatgttcggaccggtactgggatcaacagcgacgcagcgcgaaaagtggctgaaacaggtcggcgcactatttgaaaaagggagttttcatgtacatcggcaaagccgcgcagttgtcgggcaccaccatcaaggcgattcgtcactatgaggcgattggactgctgccagcgccagagcgtgcggggcgttaccgggtttactcggcgcagagtgtcgagttgctgaggctgatcaaatgcgcccagcagctggggttcaagctcaaggagttgcaggggatattgcacgagcacgagggcgatgcgttgtcttgggaacgggcagaccaggccatcgccagcaagaagcaggaactggccgggcagattgccgggttgcagcggatgcaggcgcagttgctggcgtttgaagcgcagctcaacgatacgcaggggcagtgttcgagtgggcgctgagccgaataaaaggcctaatcggctcacaatatgagccgaataagcattttactcggctcaacaaaggatgactgacgccccactcatttgcccagaatccgcatgtctgctagtgtcgcgccggtttaccgtctaccggaatagccgccatggcccgcaaaaaagtagcactcgatttcgaacaatccctcgccgacctgcaaaccctggtcgagcgtctggagaacggcgagttgtcgctggaagactcgctgacggcgtttgagcaaggcatcggcctgactcgcgactgccagagcgcgttggcgcaggcggagcagaaggtccaggtgttgctggaacgtgacggggagttggccgaagaacctttcgatgcggaacagcccgaatgatcgacgcgtatcaggccagtagccaagcccgggtgaatgcggcgctcgagcccttgtttgttgcgccaagccccgaaatgaatcgcctctatgaggccatgcgctacagcgtgatgaatggcggcaagcgtgtgcgcccgttgctggcgtatgcggcgtgtgaagccctgggcgcccccgccgagctggccaatggcgcggcgtgtgcggtggagctgattcacgcctactccctggtgcatgacgatttgccggcgatggacgacgacgatttgcgtcgcggccagccgaccacccacaaagcctttgatgaagcctatgcgatcctggcgggtgacggcttgcagagcctggcgttcagcgcgttgctggacccgcgcttgaacagcgtcaacgccgagatcagcctgcgcatggtgacggcattggccctggccgcaggcccggccggcatggtcggtgggcaagcaatcgacatgggttcggtcagcctcaagctggatcaacatgccctcgaacatatgcatcgccacaagaccggcgcgctgatcgaggccgctgtgcacttgggcgctctggccagtggccgcgctgaagcgacacaattggcggcactgcaaacctattcgcgggccgtcggcctggcattccaggtgcaggacgacattcttgacgtagaaagtgacaccgcgaccctgggcaaacgccaaggggcggatgccgcccgcgataaaccgacctatccggcgctgcttgggctcgacgcggccaaggcgtatgccctggaactgcgcgaccaggccctggatgccctgcgacctttcgacgcggcggccgagccactgcgtgacttggcgcggtatatcgtcgaacgccgccactgataagtgcggccattgcagccgcatatcggccaagttcggcgctctgcgtgggcagtttgcaccgcttgaggtaaactgccgcctcttctatacctataacgattcgcctgatgcccacgacgtttcaagagattccccgcaagcgcccgtccacgcccctgctcgaccgtgctgccacgccggacggcctgcgtcgactgggtgaagccgagctggaaaccctggccgatgagttgcgcctggaattgctctacacggtcggtcagaccggtgggcattttggtgccggcttgggcgtcatcgagctgactatcgccctgcattacgtgttcgacaccccggatgaccggttggtgtgggacgtgggccatcaggcgtatccgcataaaatcctcaccggccgtcgcgagcgcatgggcaccctgcgccagaaggacggcctggctgccttcccgcgccgctccgaaagcgagtacgacaccttcggcgtcggccactccagcacctccatcagtgcagcgctgggcatggcgattgccgcccgcctgcaaggcagcgagcgcaaagcgattgcggtgatcggggatggcgcgctgaccgccggcatggcgttcgaggcgctgaaccatgcgccggaagtggacgccaatatgctggtgatcctcaacgacaacgacatgtcgatttcgcgcaatgtcggcggcctgtcgaattacctggcaaaaattctttccagccgcacctacgccagcatgcgcgaaggcagcaaaaaagtgctctcgcgcctgcccggtgcgtgggaaattgcccgccgtactgaagaatatgccaaaggcatgctggtgcccggcacgctgttcgaagaactgggctggaactacatcggcccgatcgacggccatgacctgcccaccctgatcgccacgctgcgcaacatgcgtgacctcaagggcccgcagttcctgcatatcgtcaccaaaaaaggcaaaggcttcgccccggcggaagtcgacccgattggttaccacgcgatcaccaagctcgaacctgtggacgcccccgccgccgcgccgaaaaaggccagcgggccgaagtattccggtgtgtttggcgaatggctgtgcgacatggctgccgccgacccgcgcctggtgggcgttaccccggcgatgaaggaaggctccgacctggtggcgttcagcgagcgtttcccactgcgctatttcgacgtagcgattgccgagcagcacgcggtgacgttcgctgccggcatggcctgtgaaggcgccaagccggtcgtggcgatctactcgaccttcctgcagcgcggttatgaccagttggtgcatgacgtggcggtgcagaacctcgacgtgctgttcgccatcgaccgcgccggtctggtcggcgaggacggcccgacacacgccggcagctttgacttgtcctacttgcgctgcatccccggcatgctggtgatgacgccgagcgacgagaacgaactgcgcaagatgctcagcaccggccacctgtacaacggcccggccgctgtacgttacccacgcggtaacggcccgaatgcagtgatcgagaaagaccttgagccgattgaaatcggtaagggcatcgtgcgtcgccaaggcagcaaaacggcgttcctggtgttcggcgtgcaattagccgaggcgctgaaagtcgccgagaagattgacgctaccgtggtcgacatgcgcttcgtcaaaccgctggacgaagcccttgtgcgcgacatcgccgccagccatgagctgctggtgactgttgaagaaaacgccatcatgggcggcgccggtgcggcggtcagcgagttcctggcgcgggagaacatcctcaagtcggtgctgcacctgggcttgccggatgtgtacgttgaacacgccaagccggcgcagatgctcgcggagtgcgggctggatgaagccgggattgaggcgtcggtgcacgagcgcatggcgctgctgggtctgtagaaaccggctcaaaaatgtgggagctggcttgcctgcgatgcagccacctcggtcttactgacaaaccgaggtggctgcatcgcaggcaagccagctcccacattggttttgtattgctgataaatgctatggacagcccatgaaccgccttcgctttgccctgcccttgctgctgctccccgcccccgacctgctggccgattcgttcgagcgcgacgacgcgttgaaactccccgatgtggtcatcagcgccaaccgccaggtgcaggcgcgcaacgacagcagcgccgccaacacagtcttcacccgcgacgacatcgaccgcctgcaacccaccagcgtgaccgatctgctcagccgcgtacccggcgtgcaagtagcgcccaccggtggccgcggcagtttgccggggatcttcattcgcggcaccaaggccgcacaaagcctggtgctggtcgacggccagcgcatcgccaataccacctctggcgacagcggcctgcaatacctgaacgtcgaccaaattgaacgcgtggaagtcctgcgcggctcgcgctcggtgatctacggcagcgatgcaattggcggagtgatccagatatttacccgacgcaatgccgaacagggcctgcatccccgcgtgaaactcgggtttggcagccgccagacctgggaacgcagccttggcctttccggcggggatgagcacacgcgtttcaacttgggcgcgagcctggatgacacggcggggatcaacgccacgcacgagtcgtttcccagcgatggcgaccatgatgcctaccgcaaccaatccgtcagcctgaacctcagccatgcgttcagcgatgagctggaaatgggctttaacctattggataaccgcggcaagtcggaatacgacaacagtttcggtcgcgacgactcagcgactcagcagacggtcgggcaaaagccttacaccgactacgccgtcagcagcgccagcggttatgtcgacgccaggctcaacgaacactggcaatcgcgcctggagctgggccacagcgaaaaccgtgataccaagcgcgataagctcagtgacgatttcagcgtgttcaatacctatcgcgactcggtcaactggcagaacgacctgacgctcaacgaccagaacggcctgattctcggcggcgactggtacgaagatcgcttacacggctccaacacctttaccgaaaacagccgctggaaccgcgccgcctttgtgcagcaccgcttccacggcgagtggttctctaccgaactgggcctgcgccgcgaccagaaccagcaattcggcggccagaacagttggagcggcaccctcaccgtgccgatcaaccccaacaatgacgtgctgctgagctacagcgaaggcttccgcgcgccgaccttcaacgacctttattacccgctgacacagtacagcaaccccaacctgcagccggagacttcaaagagctacgagctgcaatggcgtagccagttgagtgagagcacgcgcctggaagcctcgctgtatcgcaccgacttaagcgacgcgattgttctggacagcaacagcaagccacagaatgtggcgtcggcgcgtatcaacggctttgaagccgcgctcaagcaggagctgttcggctggcagggtaacctgggcatcgcgttcatcgacccgcgcgaccgcgataccggccacaccctggcccgccgtgcgcgtcgcacgttgaacctggacctggatcgccagttcgacaagttaagcgtaggcgccagttggcaagccatcagcagcagctatgacgctgaagacaatcgccagcgcctcggcggttatgccttgctggggctgcgcagcagttgggcagtcactcatgaagtcagcgtttcgctgaaggtcgacaacctgttggatcgccaatacgcgcgtgcgcgctacaactacaacgcccccgacttctccaataaccaggactaccgcgaagaaggccagacctggatgctgggcctgacgtggacgccacagctgtagtgcgaacccttagtaaagctggcgggcaggctcgttggagttcagatacccggccttgattgcctcggcgcagtttatgaacccgtaggcgttaactgctccggtatcggtaaacccgatgtataagtcctttttcttgcctttgttttcaagcacatagtcatagcactgtgagctgccattacgaacctgagtgatgccctggggttgttggatcgcaagaatgtcctgctttgtggccccgccctcggcggctttggctgccacggggtgggcactgaaattcatcaacgttgagataccttccagtgtgttgcagccggtcagcaacatggcggcagaaataccaatgatcaaacggcgcatggccacctcctgtatgtgaacaagtgccatgcaatacgcatcgcgagcggcagagtaaaaccctgccgcgggaatcaccccgcggacgcatcttaataacaggtaggaaaacactgagccttcaggctagcgctgtggagcaattaactcgcacagcttcgccactgcctcgaccatctggccgctgggtcgctccaggcctttgtcgggaaccaccaccaagcgcccgtgcgccacagccgctaggtgcggccaggctttccaggcatcgacctgggcctggtcgcctgccaggatcatttcgggatcacgctgcaacaccgactcgatgctgacctgcggcgcgggcagcttcaggtcatcgaacacattgcgcgcgccgcacacactcagcgcatcgctgatgatctgcccaccgcccacggtgtacagcggctggttccacacctgataaaacacccgcaacggctcggcacgctggtagcgttggcgcagttcggccaggcgctggcgtagctgtgcggccagttgccggccagcgtcggcgcggcccaattgctcggcgatgctctgaacctgggtgctcagctgttcgaggctatggggttcggcgacatacacggggatgttcaggcgctgtaattgctcacgctgagccgggccgacactgccgggccacagcagaatcaagtcgggtttgaggctgagcaggcgctccatgttcagttgcccgtactgcccaaccgacggcacttgcgccaatgccgctgggcgctcgccaccgtcgagcacgcccaccagcaggtcggcggcgcccagttcaaccacgatttcagagagagaaggtgccaggctgaccacgcgctcgaccgccatcgcctgggcactgaatgccagcagcataaccgccagccaatggcgcctcatcccagttgacgggggatgcggtagaggtaaaacagcaccagggtcgacagcgccagcaaaaacagcggcaccgcttccaggccaacgaacaccgccagcgcaccgatccaggccggaacggcggcaaccagcagagcggtgcgacgacgggccgcgagcgtgatccaggcagccggttcttcaggcgtatcgagggcttttgcggtggcgatcagcgcgtgtttatagccatgaaaataacgcaggctcagaaacatcgaggccacaccggcgataaagaacggcatggccagcacgggaagcagggattgggcctggccaaacaccaggttgagcacgaacaacgggagcagtgccagggccaggtactgccaccagttaaaggacagtcgccgcttcacctggccacgggtcacgcgcggtcaacctcgccctgatgctcgttgcccatcatgtggtcgagcttgctggctttggtcgccaggtagagtttgttgtgcgggttttgcccggtgtgcagcggcacgcgctcggccacggtgatgcccatctcggtcaaggctttgaccttgcgcgggttattggtcatcaggcgcagggatttcacccccagatgctcaagcatcggcaggcagatcgcatagtcgcgctggtcggcggcaaagcccaggcgctcgttggcttcaaccgtgtcggcgccgccgtcttgcagttcgtaggcgcggatcttattcatcaagccaatgccacggccttcctgacgcaagtacagcaacacgccacggccttcacgggcgatggcgcgcatggcggcttccagttgcgaaccgcagtcgcagcgctggctgaacagcgcgtcgccggtcaggcactcggagtgcacgcggcccagtaccggcgcgccgtcggcgatgtcacccaggctgagcacaacgtgctcgcggccggtggcttcttcgagaaagccgttcatggtgaacgtggcaaaaggggtaggcagcttggaagcggcgacgaaaacgacgggcaccgtgtgctcctgatttcagatttcacagagggcgtcattgtaacagcaggttcctacagacgcttaagctgaattatcgctgataaagatcaataggttcgattggccttcatcccggttctatgcaggtcagaacgggtacggctgtttccagcgctcgaaaatcggtttcagttcgccgctcttgaccagtgcgggcatacgctggtcatacacagccatcaacgcccgcccgcgctcggtgtcggcgaagcctatgtagagcggcagttcggcgatgtgggtgagcttgaattgcgccgtgtcatccgcctggctgagcacatacttggcctcggtgagggcgtcgatgtagaggtctgcgcgggcatgctgcagcatgggcaggatgccgtcgcggcgttcgatctggttgaagcgctgcacgttcggcaagtattcctcgtacttgtagccgcgtacccaggccaggcggtaattgcccagcgtggcgatgctcggtgtcggcgtggttgccaggctaagggcgtagatatggtcggcgtcgaaattccagtgcgggtacaacacgccactggcttcatcacgataggcgccgacccagccgtctacctcgccgcgttgggccaggccgaccgagcgcgtgtagggcacgctgcgggtttgcacggtaacgcccgccggctcgaagacctgacgcaagacatcccaggccaggccgctgccatccttgttggtgtagtcgttccattcctcactggccagcatgatcttgccaggcaccggggcatcctccgcctgcaccagcgccgcgacggcacacagcagaatcagcagccagcggcgcacatccatggtgacaacctcctacaccgagataaccgtatagagggtagcgcaggtggcgggcttacggcgtttcgcgaaaatgctgatagccgcgcacggccggggtgatgttttggcccttggcgtcaagcaaggtgacgccctgcccggcctcaacccggccgatcacgtggatcggccagccactggccaacaaaggcgcaagctcagcgggcggcagggtaaacgccagtacgtagtcgtcgcccccactcaacgcggcgactcgcgcctcgtcatcgccgacaaacgccagcagagccctggataacggcaggcgctggcgctcgatcaacaggctgacagccgacgccttggcgatatgcccacaatcggccagtagcccgtcggagatatccatggcagacgtagccttgccacgcagcgccaggcccagcgccaattgcggctgtggcgaccagtaatgcgccagcagcggctcggcgatggcggcgtcagccgtgcgttgccccaacactaacggcaaagcaccggcagcattgcccaactcaccgcctacgcacagcaagttaccgggttgcgcgccgctgcgcgtcaacgcctgccccgccggcacacggccaaacacggtcagggtcaggctcagcggtccacgcgtggtgtcgccgcctaccaggcccacgccgcagctttgcgccatggcgttcaaaccctgggcatagcgttgcagccaatcggcatcgacggtcggcgtggtcagggcaagggtaaaggcaagaggatgggcgcccatggcggccaggtcgctgactgccacggccaacgagcgctggccgagcaggaacgggtcacacgggtcggcaaagtgcacgccggccactaaggtgtcggtggagattgccagctgctccccggcggggagcgccagcagggcgcagtcgtcgccgatcccaagagcaatgccttcgccgccctgcgcacagggcgcggcggcgaagtagttgcggatcagctcgaactcacccattgggaaggtcagcgcgacttagcgcttgtgttccttcacttcggcttcacgcaggcgcggggccagcttgtcgagcacgccattgacgaacttgtggccgtcggtcgaaccgtagactttcgccagctcgataccttcgttgatcaccacgcggtacggcacgtcgacgcgcttgagcagttcccaggtggacaggcgcagtacgcacagctcaaccgggtcgagttcttcgatggtcaggtccaggcatggagccaaggccgtatcgatctcggtcaagttggcatgcacaccgtgcaggatgtcgtggaagtagctctggtcggcgaacgtgaagtcgttatcgacgcggaactgcgcttcgatttcgttcagcgaagcgttggccatcaagcgctggtacagcgcctgggtcgcgagttgacgcgccttacggcgtttttcacttttggacggcttgccggcatccgcagggcgtgggtcctgggggttgaactgatcgctctcgtcggaaatcacttggcctccaactgcgacagcaggctgaccatttccagcgcggacaaggcagcttcagcgcctttgttgccggctttggtgccggaacgctcgatggcttgctcgatggaatctacggtcagtacgccgaaggcaaccggcacgccgaactccatggacacctgggccaggcccttggtgcattcgccggccacgtattcgaagtgcggggtgccgccacgaataactgcgcccagggcgatgattgccgcgtattcaccctgttgagcaactttttgcgcaaccagtggaatttcgaaggcgccaggggcacggataagggtgatatcgctctcgctcacaccgtggcgaaccagggcgtcaacggcaccgctcaccaggctttcaaccacgaagctgttgaagcggccaaccaccagggcgtagcggcctttgggggcgatgaaggtaccttcgatggtcttcagggtcattcgacaaatctcttaaagagccgggacgcgaaaagtgcgtccctcagtgatgatttaaccgcgaacaaggggcaaaaacagccggcctttattcggagggcacgtattctacaacttccaggtcgaaaccggatatcgcattaaatttcattggtgcgctcatcaggcgcattttgcgcacaccgaggtcgcgcaggatctgcgaaccggcaccgacgatgctgtaggtggtcggttttttcaccggcacgtgatcggccgtttcacggatatgcgccagcaacacatcgccatccaccgggttgcccagcagcaacaccacaccgctgccggcctcggaaaccgcggccatggcggcccgcaggctccagcggcccggctgcttgaccatcagcaggtcgcgcagcgggtccatgttgtgcacgcgcaccagggtcggctcttcggcgcaaatgttccccaacgtcagggccatgtgcacgtcgccttccactgaatcacggtaggtcaccaaattgaattggcccagttcgctgtccagcggctgctcggcaatccgctgaacggtacgttcgtggatcatgcggtagtgaatcaggtcggcaatcgtgccgatcttgaggttgtgctcggcggcaaaggcttcaagttcagtacgacgggccatggtgccgtcgtcgttcatcacttcgcagatcaccccgctcggctcgaaaccggccatgcgcgccaggtcgcaggcggcttcggtgtggccggcacgcgcgagggtgccgcccggttgggccatcagcgggaagatgtggcctgggctgacgatgtcttcggccttggcgtctttggcggcggcggcttgcaccgtgcgtgcgcggtctgcggcagaaatgccggtggtgacgccggtggtcgcttcaatggacacggtgaacttggtgccgaaacccgagccgttgcgcggcgccatcaacggcagcttgagcagttcgcagcgctcgcggctcatgggcatgcagatcagcccacgggcgtgcttggccatgaagttgatgtgctcggccttgcaggcctcggcggccatgatgatgtcgccttcgttctcacggtcttcgtcatccatcaggatgaccatcttgccttggcggatgtcttcaaccagttcttcgatgctattgagcgccacgcggcacccccttggtcaggatttcaggtagccgttagcggccaaaaaactttcggtgatgttactgctggttggctctgcggctttgtcgcccaacaacaggcgctccaggtaacgggcaagcaagtcgacttccaggttcacccggcgacctggctggtaagaagccatgatggtttcgctgagggtgtggggaatgatggtcagttcaaattcggcgccattcacggcgttcacggtcaggctggtgccgtcgaccgtgattgagcctttgtgggcgatgtacttggccagctctttgggcgcgcgaatgcggaattccacggcacgcgcattttcgctgcgagcaaccacttcgccgacgccgtcgacatggccgctgaccaaatggccgcccaggcgggtggtcggggtcagggctttttccaggttgaccgggctgccggccttgaggtcgttcatcgcggtgcaatccagggtttcccggctgacgtcggcggcaaagccgttgcccggcagctcgatgacggtcaggcacacgccgctgacggcgatgctgtcgcccagcttgacgtcgccgaggtcgagcttgccggtttcaaccagcaggcgtacgtcgccgcctttgggggtcatggcgcggatgctgccgatggattcgataatgccggtgaacatggccttctcctggaaaacgggacgggcacttgagcgcccggtcagaattatacgctcgctggtggtagcgggatggcagtgactcgccagtcgtcgcccacagcgcgcatttcagtgatcttgatttggggggcgtcggccagtttatcaagcggccagtccagcaaaggccgggcggcggagccgaggaatttgccggcgacgaatatcacgtattcgtcgaccaagccctgctgggcaaacgcacccgcgaggctcgggccggcttctaccaacacgtcgttgacgccacgggccgccagggcgaccaacgccgaacgcaggtcgacctggccgtcaacgccaggcacaaccaggcattcggggccacgcggaaactggttttccggcgtcacgcaggtgatcaccaacgccgggccggccttgaagaatggcgcgttgagcggcacccgcaggcggccgtcgatcaatacgcgcaacggcgggcgcgacatggcgagggccgtggtggcttcatccaggcccaattcggcggcgcgcacggtcaagcgggcgccgtcggccaagaccgtgtcagcgccggtcaacaccacactggcctcggcgcgcaggcgctgcacggcggcgcgggcagccgggccggtgatccattggctttcgccgctggccatcgccgtgcggccgtccaggctcatcgccagcttgacccgcacaaagggcaggccgtgttccatgcgtttgaggaaacccgggttgagcgcgcgcgcttccttttccagcacgccgctgtgggtttcgataccggcctgcgccagacgctgcaggccgcgcccggccacttccgggttcgggtcctgcatgccggcgacgacccgcgccacaccagccgtgaccagtgcatcagcacacggcggcgtgcgcccgtgatggctgcacggttcgagggtcacgtacaccgtggcgccacgcgccttgtcgccagcggcgcgcaaggcgttcggctcggcatgtggctcgccggtgcgttcgtgccagccttcgccgacaatctgtccatcgcgcacgatcacacagcccacacgcggattcgggtgggtggtgtacacacccttgcgcgccaattcgagggcacgggccatgtaatgggcgtcgaggacggcttgctcagcagacggtgggttcatttcttgaccggctcacgggccaggcggtcgatctcttcgcggaactcattgaggtcctggaagcgtcgatacaccgaggcaaaacggatataggcgacttcgtcgagcttttgcagctcgcccatcaccaactctccaaccaccagggatttgacctcgcgctcgccggtggcacgcaacttgtgcttgatatgcaccagcgccgcctccagccgctcgacgctcaccgggcgtttttccagggcgcgctgcataccggcgcgcagtttgtcttcgtcgaaaggctggcggctgccgtcggacttgatcagacgtggcaataccagttcggcggtttcgaaggtggtgaaacgttcaccgcagccagaggccaggcattcgcgccggcgacgtacctggtcgccctcggcgaccagacgcgagtcaatgaccttggtgtcgttggcaccgcagaagggacagtgcatggtggcaggcaacaaaaaaagggagggccatggtagcgcatccccgtggcaagacaagccatagcctttacggtatataggctgactattatgtttcttaatcttcaagccacggattttgccctttctggagccgtacatgcagttacgaccacttgttttactcgccctgttcagtgttctggtcgcctgcagcagcgaagcccccaagccttcggcgcctcaaccaacgcccgcccaagagaaaaaagtcccaggcatcgaagacctcgggccattgccggcttaccagcgtgaaatcaacggcaccctcaacggcgtgccggccaacgctgaagtcgaactggccttgctggtgatcgacgagcgcaaccgcccgcaacaactgctcgccagcagcgtgctgaccggcaacggcaagccactggccttccgcctgcgcttcaacccggaagccttccccgccggtgcgcgggttgaactgcgcggccgcgccagccagtccggccagttgatcctgcacctgcccgccgtgcaaatcacccaggcgatcacccaaaccaccggccccctgcaactcgtcaaggcaccatgacgccaccgctggacctgcaacgcgccctgagcgagctgatcggcgacgcgcaactggtgccctgcccgctgccgggcaccgagctgtcgttgtggctgctggacgccgacaacatggaccgcgccttcagccccgaggaaacccggcgcatcctgcatgaaccgccgtactggagtttttgctgggccagcggcctggcgctggcacgctacctggcggcgcaccccgaatgggtcgccggcaagcgtgtgctggattttggcgccggctccggcgtggccgggattgccgccgtcaaggcgggcgcgctcgaagtggtggcctgcgacctcgatccgctggcgctggccgcctgccgggcgaatgccgagctcaacggtgcggcgctgaattattcagccgactttttcgccgaagccgaccgcttcgacctgatcctggtggccgacgtgctctacgaccgcgccaacctgcctttgcttgatcacttcctcacccgcggccgcgaagctttggtggcggactcacgcgtacgcgactttcagcacccggcttatcagcgcctggaaatcctcgacgcgctgacgttgccggatttggccgagccttgggagtttcggaaggtgagcctgtaccattcgcggcgctaggcctacgcgttacaaatttccggcaatagattggctgagacaggtgatggcagggcatggaaaatgccgttccttcgcacgcggcctggacaatcgacctgcatgcctttcaagacaatttcacttatagctggcccatcaaacgccttgcaaaaagcctggcatctgcctaaccttttgcgcaacacacccgccatgcctctggttacgtcagtaatcaagcacaaattgtgcgggttttttatgcccggtactttttgggtatgaggtcattcagcaaacctgccatcgacgttcctgcccaactggaactgctcaagttgcgcggactgattattcacgatgagcctcgcgctgagtgtttcttgcaatcagtcagcttctttcgactcagcccttatatgcggcctttccaacagtcggaagatatcggccatcactttcgtaacggcagccagtttcgtcaattgacccgcctctacgactttgatcggcaacttcgtctactcacggtggatgccattgagcgagttgaaatagcatcacgcgcagtcatcagcaaccacatggggcctgcccatggcagtcactggtatatcaacccaggcatgtttcaccctacgtttgatcaccagcgcttactgacagcgctgtccaacaaacaagccaccgcaatgcgtgactaccagcgcgattgcgagcgcatcgatagatcccatgccagcgaaaagagaaaaaatcttcttaaacgtcaaagggcgaaagaaagctacgcccggcactaccccgtgacttacgcccacccggccctgatgccaggctgggcgatgctggaagaactgacgctgggtgacctctcccacctgtacaagggtttggccagggacgccgacaagaaggctattgccaggcgcctgatgctcccggcgccactcatgcagtcctggcttcacacactgaccaccatccgaaacatttgcgctcatcattcgcgaatgtggaaccgcgaattggggattcgtcccgagctgccgaagaaagccagttttctgtggccggaatacctatctcaacaagggccgcatagccgaatattctcggccctctgcattctgaatcacctgatgcatcaggtgagcccgcacacggcatggggccatagtttgcgccagctgatcggcgagttccccgacgtcagcctgaaggcgatggggtttcctcctgactggtatcaggacccgttttggcactcgccccgcgcctgaataccgtgctgcttccggtcaacctcgccagcccttatagttgccccattcccgctttattcgagacgccccatgagtgagcccacgccgtacatcttcgacgttaccaccgccaacttcgaccaggcggtgattcagaactctttcgaaaaacccgtactggtggacttctgggccgagtggtgcgcaccgtgcaaggcgttgatgccgctgctggcgcagattgccgagagttatcagggcgagttgctgctggccaaggtcgattgcgaagccgagcaggatatcgttgcgcgttttggcattcgcagcttgccgaccgtggtgctgttcaaggatggccagccggtggatggctttgccggggcgcagccggagtcggcggtgcgggcgatgctggagccgcatgtgcagatgccgccacccgctgcagctgacccgctggaacaggctcaggcgctgtttgccgaagggcgtatcagcgacgccgaagcggtgctggtcgcgctgctgggcgaagacaacaccaacgccggcgcgctgattctgtacgcacgctgcctggccgaacgcggtgaattgggcgaagcccaaaccgtgctcgatgcggtaaaaagcgacgatcacaaagccgcccttgccggggccaaggcgcaaatcactttcctgcgccaggctgccgacctgccggacgccgccgacttgaaaagccgactggcgcaaaacccgcaggacgatgaagcggcctatcagttggccattcagcaactggcgcgccagcaatacgatgcggcgctggaaggcttgctcaagttgtttatccgcaaccgcagctacagcgaaggcctgccgcacaagaccttgctgcaggtgttcgagctgctcggcaatgaccatccgctggtcaccgtgtaccgccgcaagttgttcgctgcgctgtattaatcgccgacccagctgtacagcggcgtatccccgccgctggccactttcacctgggcgctatggcgcaggcgcaccagcaggcgtttgccggaagcggcatcgccggccaagccttccaattgatcgagcaactcaagcccgttgagttgcccggccttgcgcagcaggtcctgagcgttctgccatagatcatcgttgtgtttgactggcgccgcagccggcgcgctcggcgtcggcgccgcctgcaactgcgcgcccaaccgcgcccaatcgccgtcgtccagctccagggtcaagtccaccggcacgtcgccgacggttccacgaattcgcaacatcgtccttactcctgcacttttctgacaggcatgctcccacgcggcttgcgcaacgccaagcgggcggtcaaactctggcactattgttataagatcacataacaaaactttcatgttctggagccttcacatgcgccgtctgctgcttgctttgccgtttgccctgttgccactggctatcgcccacgctggcgatgagcacgatcatgagcatgaacacgccagcctcggcgctcatgaacacggcgtcggccgcctcaacgcggttctcgacggccagacgcttgagctggaattcggcagccctgccatgaaccttgtgggttttgagcaccaggcaactacaccggccgacaaagccaaagtcgccgccgcccgcaagcagttggaaaacccgctggcgctgttcaacctgcccaagtctgccggttgcgtgatcagcacccaggaactcaacagcccgttgttcggcgacaagccggaagccgatcatgatgacgacgatgacgcccacgccaccgacggcaaaggtgcggcggcccacgaacatcatcacgatcacagcgaaatccacgctcactaccaattcacctgcgccacgccgacggccttgagcaacctcgacctgacccaagtgttcaaaaccttccccgccacccagaagattcaagtacaactgatcggcccaagcggtcagcaaggtgttgaagcgacggccaccgcagccaccctgaaattctgatttgataaaccaatcactgtgggagctggcttgcctgcgatagcggtaaaacagacacatcaatatttaatgtgccgccgtcatcgcaggcaagccagctcccacaattgatcggtgtcatcatccaaatcaaaccaggccactgatttcctatgacccaagcactgattgaactgtctgacctgggcttcaactggcccggccacccacagttgctggacatccccgcgttccgcctggaagccggggaaaccctgtttctcaaaggcccgagcggcagtggcaaaaccaccctgctcggtttgctcggcggcgtgcagaaacccagccagggcagcattcgcctgctcggccaggagctgaccgaactgtcggccggcgcccgcgaccgcttccgcgtcgaccacaccggctacatctttcagcagttcaacttgctgccgttcctgtcggtgcgcgaaaacgtcgagctgccttgtcacttttccaagctgcgcgcgcaacgggcggttcaacgccacggcagcgtcgaccaggccgccgcgaccttgttggcgcacttgggtttgaaagataaaaacctgctggagcgccgcgccgactcgctgtccatcggccaacaacagcgcgtggccgccgcccgcgcattgattggccaaccggaactggtgatcgccgacgaacccacctcggccctggactacgacgctcgcgaagccttcattcaattgttgttcgccgaatgccgcgatgccggcgccagcctgttgtttgtcagccatgaccagagcctcgcgccgctgttcgaccgtcacctgtcgctggccgaactcaatcgcgccgccacgcccgcagaggtttgagatgtatttgtttcgtctagccatggccagcctggctaaccgccgctttaccgcgatcctcaccgccttcgccatcgcgctttccgtctgcttgctgctcgcggtagaacgcgtgcgcgttgaagcgcgcaacagttttgccagcaccatcagcggcaccgacctgatcgttggtgcccgctccggctcggtcaacttgctgctgtactcagtattccgcatcggcaacgccaccaacaacatccgttgggacagctacgagcacttcgccgccagcccgcaggtgaaatgggcgatcccgatttccctcggcgactcccatcgcggctaccgcgtgatgggcaccaacgaatcctacttcgagcactaccaatacggccgcaaacagaacctcgaactggccagcggccgcgccttcgccaccgacccgtttgaagtggtgctcggtgccgaagtcgccgatgcgctgcattacaagctcggcgacaagctggtgttggcccatggcgtggcagtggtcagcctggtcaagcacgatgacaagccgttcaccgtggtcggcattctgaaacgcaccggcacgccggtggaccgcacgctgcatatcagcctcggcggcatggaggcgatccatatcgactggcacaacggcgtgccggcccagggcaaaggccgtatcagcgccgatcaggcgcgcaatatggacctgaccccgcaagccatcaccgcgtttatgctcgggctgaataacaagatttccacctttgctttgcagcgcgaaatcaacgaattccgtggcgagccgatgctggcgatcctgcccggcgtggcgctgcaagagttgtggagcatgatgggcaccgccgaaaaagcgttgttcgtgatctcgctgtttgtggtgctgaccggtttgatcggcatgctcacagccatcctcaccagcctcaatgaacgccgccgcgagatggcgatcctgcgctcggtgggcgcacggccttggcatatcgcgacattgctgatcttcgaagccttcgccctggcgctgtctggcgtggtggcgggcgttggtctgttgtacgtgtgcatcgccgcgtcgcgtgggtatttgcaggccaactacggcctggacttgccgatgtcatggcccagcgaatatgaatggacgctgctcgccggcatcctcgcggcggcgctgttgatgggcagcgtgcccgcgtggcgcgcctatcgacaatccctggccgatggcctgtccatacgtttatgaggaaggcttcgatgcgtcgtgccctgtttgcattgttgctgttggtggcgctgcccgcgtgggcggaagaccagcccaaggacttgtcctggcaggaaatgatcccgccggatgcgccgccggaaatccccaatatgaagccgctgcacgacctgtcgaacatggccgatgcgttgtcggtggagtcggcgccggccgccaagcaggacttgcccaacgcgccggtggtgcaaagcctcgatggccagcacatccgcctgccgggttatatcgtgccgctggaagtcagcgaagaaggccgcaccaccgaatttttgctggtgccgtatttcggcgcgtgcatccacgtaccgccaccgccgtcgaaccagatcgtgcatgtgaaaagcgaagtcggggtgaaactcgatgagctgtatcagccgtattggatcgaaggttcgatgcaggtcaagccgtcttcgagtgagctggcagatgccggttaccagatggatgccgagaagatttatgtctacgagctgcaggaataaggcctgatcgccctttcattgagctgagtcaaaggatcgaacggaacgatctttaccattggacgtacaacttttaacgtccttttggagctcccatgaacaagtctctgctcggcgcgtccctcttcgcgctcgccctcgccgccccggtcgcacacgctcacgaagcgggcgacattctgattcgcgccggtgcaattaccgtgaatccgaaggctgacagcggcagcgtcaaagttgaccagggccccttggccggcgccaacctgggcggcaaggcgaccatgagcagcgacacccaactgggcttgaacttcgcctacatgcttaccaaccacgtcgggatcgagctgctggccgccacgccgttcgagcatgatgtgaagatcaagaacaccgccctcggcgcagccaacggcaagctcggcaccctgaaacacctgccgccaaccctgagcgtcgtgtactacccgctggacaacaaatccgccttccaaccgtacgtgggcgccggtatcaactacacctggatctacgacgagcacgtcggcagccgcgccgagcaggccggtttcagcaacttcaaggctgaaaactcctggggttgggctgcgcagatcggcgccgactacatgatcaacgacaagtggatgatcaacgcccaggcgcgctacatcgacatcagcaccaaggccaccgtggacaacaacgcgttgggccaaggcacacgcgccaaggtcaatgtggacgttgacccgatggtttacatggtgggtattggttacaagttctaagcgatatttcaccaacaccacaacaccaatgtgggagcgggcttgctcgcgaaagcggtgggtccgtcgactaatctgttgactgacactccgccttcgcgagcaagcccgctcccacatttggttttgtagggtgtcagctcctacacaaaaccggctcccacatttggttttgtgtgacgctcagctatgccggtaaaaccgatccagcaacgccggcaaccccgcccgccacgcccgtggcttgataccaaaagtgtgcaggatcttcttgcaggccagcactgcatgctgcggttcatccgccgcatccggccgggccgcgtgggcctgggcggttggcgattcaatcgccaacgggtggaaattacgcgcttcggtgaggatcgcctggcccagcgccaacggcgtggtcgcttcgtgcccggcgtagtgataggtgccccacaaaggcgccgcgcaatcgagttgcttgagcaccgagatgatcacccgcgcggcatcgtccaccggcgtcgggttgccacgccggtcatcggccatcagcaattcatccggcttctcggcccgggccagaaagcgcccgagggtgccgtcgacgctgtcatccagcaaccagccaaaacgtagcagcacatgttgcgggcaggtcgcgcgcacgctctgttcaatacgccacaacgcctggccgcgcaggccaagcggcaccggctcgtctttttcgctgtaggccgtggcacgggagccatcgaacacgcggtagctggaaggctgcagcaaggtgatgctgtggtgctgacacaactcagccaggcgttcgatggcgaattcctgggcagccaagcgggtttcgctgacggcttcggcctggaaccagtcgaaatagtaggcgaggttgatcaacgcatcgggacgggtgtcgtcgagcaattgggtgaggctcgcggcatcccagccgtcttggggcggtttgggtgcgaggaaaccgatgtcttcctctgcaccgaggcgaatcagcgcctgcccgagggcattcccgccgcccagtaacataaggcgcattcgcatagattgagcaggcccggtctgtttggaacgatggttattatcggcaggcctgtgggccttaccgttggtggttgccagaatcgttgcattttgcgggtttgtagcgcaaccgtcacttataaagtgcgggcttgcaacttatgggagacggccgcataactccctgcatgaaccttcatgaatccacgggcacggtattgaacggcttccaccccgccgtcagcgcctggttccgcagcagcttcccgtcggtgaccggcgcccaggcccaggcgtggccgctgatccgccaacggcgctcgacgctgattgccgcgcctaccggctccggtaaaaccttgacggcgttcctggccgtgctggatgacctggttcaccaaggcctggccaacggcgggcaactgccggatgagacgctcgtggtctacgtctcgccgctcaaggcgctgtccaacgacatccagatcaacctgcaaaacccgctggccggcatcaccgaacagttgcaggccatgggcttgccgcccttggtgatccgcaccgccgtgcgcagcggcgacaccccgcaaaaagaccgcgcgctgatgcgcaagcgcccgccgcatatcctggtgaccactccggaatcgctctacgtgctgctgggctcggactccggcaggcggatgctcgccagcacgcgcacggtgattgtcgacgaaatccacgccatcgccgccagcaaacgcggcagccacatggccttgagcctggagcgtctgcaagccttgtgtgccgagccgctgacccgcgttggcctgtcggccacacaaaaacccatcgaggcggtatcgcgctttctggtcggcacaggccgtgattgcgcgattgtcgatatcggccacgcgcgcccgcgcgacctggatatcgaagtgccgccggtgccgctctcggcggtgatggccaatgacgtgtgggagctggtctacgaccgcctcgccgcgttggcgcgcgaacaccgcaccacgctgattttcgtcaacacccggcgcctggccgagcgcctggcgcggcacttgagcgaacgcctgggcaagaccgctgtggccgcccaccacggcagcctcgccaaagaactgcgcctggacgccgaacagcggctcaaggccggcgagctgcaagtgctgatcgccaccgcgtccctagagctggggattgatatcggcgacgttgacctggtgtgccagatcggctcgcccgggtcgatcaacggctttctgcaaagggtgggccgctccggccaccaggtcggcggcacgcccaaggggcgcctgttcgccaccacccgcgatgacttgatcgaatgcgccgccctgctcgactgcgtgcgccggggcgaactcgacaccttgcagatcccggtcgcgccgctggacgtgctggcccagcagatcatcgccgaagtcagcgcccaggaatggtcggaacaggcattgctcgaccttatccgccgcgcctcaccttacgcggcgttggacgaacgccattaccaggcgctgctgcagatgctttccgacggctataacggtcgccagggcatccgcagcgcctacctgcaccgcgacgccgtaacccacaccctgcgcggccgccgtggcgccaagctgaccgccgtgaccagcggcggcaccatccccgacaacgccgactacagcgtgttgctggagccgcagagcctgaatatcggcagcgtcaacgaggacttcgcggtggaaagtattgccggggatatcttccagctcggtaacacgtcctacagaattttgcgggtcgaagccggcaaggtacgcgtcgaagatgcgcacggccaaccgccgaccattccgttctggctcggcgaagcgccggggcgcagtaacgagttgtcggcggccgtggcgcgctttcaggggcaggtggacgcgttgctcagcgccacgcccggcgacttgcaagccgcacaagactggctcaccggcaccctcggcctgaaccgcgccagcgccgaacagatcctcgattacctggcccgcacgcgcctggcgctcagcgcgttgccgtcgcaggacacgttgatcatggagcggtttttcgacgcgtccggcggcactcaattaatcattcacacgccgttcggcagccgcgtcaatcgcgcctggggcctggctctgcgcaagcgtttttgccgcacgttcaatttcgaattgcaggcggcggcgagtgaaaatgcaattgtgctgtcgctgtcccccagccacagcttcgagctggacgaagtctggcgctacctcaacagcaacagcgccgagcacgtcctgattcaggccgtgctcgacgcgccgctgttcggcgtgcgctggcgctggaacgcgggggtggccctggcgttgccgcgttttaccggcgggcgcaaagtggcgccgcagatccagcgcatgaaaagcgaagacctgatcgccagcgtgtttcccgaccagatcgcctgcctggaaaacctcgccggcgagcgtgaagtgcccgagcacccattggtagaacagaccctcgacgactgcctgcacgaagccatggacagcactgcctggctggcgctgttgcgacgcatggaaagcggcgaagtacgcctgatcagccgcgacctgccggcgccctcgcccatggccgccgaaattctcagcgcgcgcccgtacacctttctcgacgatgcgcccctggaagagcgccgcacccaggccgtgctcaaccggcgctggagcgacccgcaaagcaccgacgacctcggcgcgctggatgccgacgccatcgccggcgtgcgcgaagaggcctggccggcgccccatggtttggacgaaatgcatgaggcgttgatgagcctggcctgtatcgccgccagcgaagtcacgccgcaatgggccgagtggctgcgcgccctggccaaaggtgggcgcgcctatcagctgaaaaatggcttgtgggtggccgttgaacgcttgagttgtgtacaggcgatctatcccaacaacttgccgctgctgccgggcttcgatgagccatggactgttgatgaggcgctggcggaagtattgcgcgcacgcctcggcggcttcggcccgctgaccttgatcgagattgccgcgccgctggccctgccggtggcggacgtgacccaggcactggcgcgcctggagcaggaaggctacgtactgcgcggccgcttcagccctggcgccacgcaagagcaatggtgcgagcggcatttgctcgcgcgtattcatcgctacacggtcaagcgcctgcgccgggaaatcgagccggtggcgttgcaggacttcatgcgttttctgttcgattggcagcacctcgccgagggcacacgtggccagggcagcgccatgttgccgcagatcgtcgcgcagttcgaaggctacgccgccgccacctcggcctgggacactgacctgctgagcgcgcggctcaaggattactcatctacttggctcgacgatttgtgccgcagcggcaagctggtgtggacgcggctgagcaacaaggccagcgcgatggcgctgcgcagtacgccagtggtgctgctgccgcgtagccaggtgccgctgtggagtgggctcaccgaactgaccgacagcaccacgctgtcgcccaaggcgcagaaagtccacctggccttacgcgagcatggcgcgttgttttttgatgagctggtgcacgaagcccatctgctgcgcagtgaattggaaagcgccttgcaggaactggtcggcgccggcctggtgaatgccgacagcttcgccggcctgcgcgccctgaccacgcccgccagcaaacgccaggcgcgcagcagccggcgtgggcgcggggcatttgttggcggcatggacgacgccgggcgctgggccttggtgcgccgctcgccaagcgctgccggggcgcattcggccgagactctggaacatgtggcgatgaccttgctgcgccgctatggcgtggtgttctggcggctgctggaacgtgaggcggactggttgccgagctggcgcgaattgctgcgcacgttccatcggctggaggcgcgtggggagattcgcggcgggcggtttgtcagcggcctggcgggcgagcagtttgcgttaccggaggcgattccgctgttgcgcgaagtcaggcgcaggccacatgacggcagcttgattgcggtgtgtggcgcggacccgctgaacctggtgggcacgttgttgccgggcaataaggtgccggcggtgagtggtaatcggattgtgtatcgggatggcgtgccggcggcggtgatggtcgcgggcaagcagcaggtgttggtggatagtgatcagcaggcggtgcaggaaaaactgatcaggcattgaggtggagtgactttgaaggcctcttcgcgagcaagcccgctcccacattttgaccgtattccaaagatgtactcggtcgaatgtgggagcgggcttgctcgcgaaggcgtcagctcagacgctataaatcactgggttcgcggctgctcggtcaacaccaccgcagccggcacctcttcatccggctcatccacctgcgccgtgcgcttgggcagccaaacctgctgtggataagtttgcgcgaagtgcacctcatcacagttatccacaagctttttcaagcgctggttaaacgcacgactcaccgcatattgcccgcccgacacggtacggaactgcgccgtgagcaccacgccgttgaggtccatcttgtcgacgccaaacacctccagcggcccttgcaggttgtacttgaggaacacgtcgtcgcggatcgattgccctgcctcgcgaatcagttccacggccttgtccacatcggtgtcgtaggtgaattgcaccgagaagaatgcgtaggcgaattgccgcgactggttggtgaccgccttgatctgcccgaacggcaccgagtgcacaaaacccttgccgtcgcgcaggcgcagggtgcggatggtcaggccttcgacggtgccggcgtggccggagtcgagcaccacccaatcgccgatcgacagcgtgtcttcgatgatgatgaacaggccggtgatcacatcctgcaccaattgctgcgagccgaaaccgatggccaggccgaccacaccggcacccgccagcaacggtgcgacgttgatgcccaggttggccatggtggtgatcgcgcagatcaccaccaggatgatcttcaccgcgttgcgcagcagcggcaggatggttttgacccgtgtactcggctggcgactggagcgtttattcaccggtggtttcagcgcttcctggatcgcggtgtcgagcaccacccagaacagccaggtcatcagcaggatcaggccgatgctgctgagggaatcgctgatcgcccggcccacggagttgcgctgggcaaattcgaacagcgatatgccccagatacgcccgaggatttcgataaaggcgacggccatgacaatgcgcaagatcgcgtgcagcaggctcaggaagcgctccttgtaggcgctgctgcgctggatcgtcacttggctgcgggacttgaacaggtgttgcagcaccgtgctgagaaacaccgtgccgattagcaaaatcgtggtgaacagcgcgcaacgcagggctttctggttgtcgtcgccagcgccgatcaggttgatggccgagaccagcaccatcaacagaatcggccagtaccacaacccggaaaacactcgcagcgattgctgcagcgccggatgtttaaggcgctgggccagcggccgattgcggatcagatgcgccaccgggcgacgcaggcgcaccaccagcacaccgaaaatcaccgccgcaaacaggccggtgaacaccgcgatgctgctggtgatattgccgcccaattggcgagcgatttgcgggctggtcagcgcgtcgctgagggcggcgaggaagccgatcaggaacagcggcttggggcagtagtcacgaataatctgcacggccgggcgtttgtggccgacgttgaacatgacgatgacgcacaacagcatcgaagtggaaaagatgccgctgctggtggcgtaggcaaaacatagcgccagcgcacgccctaccgatgtgggtaaaaaatggctgacgtaaagggtcaatggcagacagataacggccggaatcgtgtagggcaccacatagcccagcacggcttgcaggcgtttgcgctgtgcgacgaaatgccggcgactcaagcgctgcacgataaagcgccccagcaacgtcaatatcgcaaacgcgcccacccatacacccgacagcagcaggaagtcgccggtcacgctccatggcgaacgttcggcggtctggtcgaccaggcgccctacttcgtccgccgcgcgatcggcgcgcaaacgccaggcgtcgatcaggttctggttgaggtcgagtttgtcttgtacatcgtcgatgctggaactgatggcgccgagcaggccgccttccaccaataactccggcttggccggcgcggcaggttcagccggcgctggggttgcggcttgcaatgcgccattgccacacaacagcagcgcaccaagcagtaatgcagtctttagattcagcaaaacgccgggcctccatcagcagggtctgtaaggaactgacgggtttaaacgctgatcgttcccatgctctgcgtgggaatgcctccggtgacgctccgcgtcacgctttttaatgcagacgcagagcgcccaaggctgcattcccacgcagagcgtgggaacgatctgtccagtgtgggatggcggcccaccgctgtcacaggcaagccagctcccacacttctgaccgtgtaccgtctgtaggaacggcgaaactttccggcaaaaaccgcagtcatcccaaaacggaggtcacccgaccctatatccacgggagcaagcatggcggcgattcatatgggcatttccgactggcgcggggggttgtcatgacccacccggaattgatccccgtcacgcccaccacggccatcacgcggttcaccgtgttgacggtgaatatccacaagggcttcaccgcgctgaatcggcgtttcatcctgcccgagctgcgtgaagcggtgcgcagtgtgggcgccgacatggtgttcctgcaggaaatccacggcacccacgaacgccatccccagcgctacagcgactggccgaagatgccgcaatacgaattcctcgccgacagcatctggccgcagttcgcctatgggcgcaacgcggtctacccgcatggcgaccacggcaatgcgttgctgtcgaaattccagatcgtgcgctacgacaacctcgatatctcgcagagcggccatgaaagccgtggcttgctgcattgtgtgttgcgcctgccgggcagcggccaggaggtgcatgcgatctgcatgcacttgggcctgcgcgaggtgcatcgccagcaacaattgcgtttgctggagcagcgtatcagcgagattcctgccgacgcgccgctggtggtggctggtgatttcaacgactggcgccagaaggccgacctgagccgcagcggcctcaaggaagtcttcgtcgaggcccacggcaagcccgcacgcacgttcccggcgcgtctgccgctgctgccgctggaccgcatctacgtgcgcaacctgaagattcataaccccaaggtgctgacgactcggccctggtcgcacctgtccgaccatgtgccgctgtcggtggagatcgagttatgactgtcgcagtagagcacatcgccactgaccagccgccggacgaagccaaggcgcgggatgtcgattacggctggcagagcggcaaccaagtggagctgctggagaacggcgaggcgtactttccccaggtgtttgaggccctgcgtggggcgcagcgggagattctgctggagacctttattctgttcgaagacaaggtcggccatgaactcaaaggcatcttgatcgaagcggcgcagcgcggcgtgaaggtggtggtcagccttgatggctttggctgcggcgagctgagctcggcttttcttggcgagctggcggaggctggcgtgctggtgcagatgttcgacccagcgtcgaaaaggttggggattcgcaccaactggtttcgtcgcctgcaccgcaagattgtggtggtggacgccacggtggcgtttattggcgggattaacttttcggctgatcacctcggcgatttcggcgccgaagccaagcaggattacgccgtgcaaatcatcggcccggcggtggcggacttgcaccatttcgccctcgcccaaagtggacgccaggttcgcacccggcgcggctggcgacggcgccagcaacggccctcgctgtggacgaccgcaaacgacgacggcctggtgcgcctgatctatcgcgacaacgtgcagcaccgcgacgacatcgaagaggcgtacatccatgcgttgagcaaagcgcaaaaacgcgcggtgattgccaacgcctacttcttccccggctaccgcctgctgcgcgagatccgtaatgccgcgcggcgtggcgtgcacgtgcaactgatcatgcaaggccagcccgatgtgctgctggccaagctggcggcgcgcatgctctacgattatttgctcaaggatggcgtggtgattcacgagtattgccagcgcccgctgcacggcaaagtcgcgttggtggatgacgattggagcacggtgggctcaagcaacctggacccgctgagtttgtcgctgaacctcgaagccaacgtgctgattcgcgaccgcgggttcaatcagcagctctacgagcgcctggaaatgctcgccaaaaaccactgccagaccatgccggaaaaccgcaagccgcgcctgtggttatggcgtttgaccgtgggcttcctggtgtttcatgtgatgcgccatttccccgcgctgaccggctggctgcccgcgcacaagccgcgcttgaaacccttcgagagccaggcccatgaccgctgaagccggcagttcacgattcaagcgctggaagaaaccgctgaccgtcgccttcttccttttgttgattgtgctgttcaccttgctcgcgcggcgcatcgactggagcgaagtgctgcagacgctgggcgacttcaagctgcgcacgctgttgatcgccggggcgctgaccctgtgcagttttctggtgtacgccagcttcgatctgatcggccgcacctacattcgccagccgctgcgctggaagcagattctgccggtggggatcatcagctatgcgttcaacctgaacctcagcgcgtgggtcggcgggattgccatgcgttatcgcctgtattcgcggctcggcgtgagcaccagcaacatcgccaagattcttgggctgagcttggcgaccaattggttcggctacatggcgctggccggcgtggtgttcagcagcggcctggtgacgatgccgcccggctggaaagtcagcaccttggcgttgcagggcattggtgtggtgctggtgttggccagcctcggctacttggcggcgtgccggttctcgaagaagcgtgcgtggtcgatcaagggcatcgagatcaatctgccgtcgttgcgcatggcgtgtttgcagttggccctgggcgcgttgaattggtcattgatggcggcggtgatctttaccttgttgccggccaagttggactatccgctggtgttgggggtgttgctgatcagcgcgattgccggcgtggtgacgcatattccagccgggcttggggtgttggaggcggtgtttattggcttgctgcagcatgaggcgtcgcgtgggagtttgctggcgggattgattgcctatcgggcggtgtactttattttgccgttggtgattgcgctggtgatgtacctcgcggtggaggctaaggctaaggcgttgcgggtgaagaagacagcggcttgatgcagtgttggcaggaccggcgccatcgcgggcaagcccgctcccacatttggaacgcattccactgtgggagccgggcttgcccgggatggcgcttgagagggcaatgctttatcgggcctggatgatgctcaaccgctcgcccaccaccatctcggtaatccagtccaccaggattgaggtataggcctgctgcgacaccgggtcgctcaacgagtggtcggcgccgtcgatgatgcggtgggtcagggagtgagtctgctggcacgccgcgcggtaactcatgatggtggcgtggggcacgtggtcatcggtttccgactcgacaatcagcacatcgccggtgaatttcgcgcaggcatgcagagcgcggttggtttcggcgtgcaccagggtgctgcggtagtccatcaggtcggccttgtccaagtcgcgcttgggcttgagccattcctgatcgcggtacaacgccggcacgcgcagcgccagccagcgcaccgggcgcaatgaagtgagaatcgccgccaggtagccgccgtagctggtgcccactaccgccacggcggaggtgtcgatggctgggtgcgacagcaagcggtcgtacgccgccagcaggtcgcgcaggttgtcttcacgggtgacgtgggacaacggaataccggtgccggcatggccgcgcaggtcgaaggtcaggcatacgcagcctaacccggcgatgcctttggcgcgctcaagatcgcgctcctggctaccgccccaaccgtgcacaaacaacacgccagggactttggatttggggctcaggaaggtgccgctcatctgttcgtcgtcgatgtcgatcgcaatgctttcgcttctagccgtcataagatttaaccgtcacgtacttgagaagaaagtcgctgttttctgcggggccgcgatacacctcaatggcgtctgccggcagcggttggtccacgtaggtttccaccgatgaaacgcgaatagcgcgcaggccgggtttgttgataaagctctgcaacgccgcgacttccgcgctgctggccccgcccatgcgccaggattgttcgagcacgccgctacggcgttggccttcactgtccaggccttgggcgatgtcgtagttgcgccgtgaggcgtagaaaccagggtaggcctcatcggccgccgtgtcgaaaacctgggcttgctcaatggcctcacgtacgtcgtcgggcaggtcgagcttcaacaggtcttcgtagtagccgggcaccaccagcaggttggaaccgccgtagacgtcttcgccctgcccgtcctgcgtaaggtattgctcgccgcagtagctgaacacgtgatcgccgataaaactctggcccacgctgtgggtgaccacctcgtgcaggtcttgctccagcaccacgccttcggcgaacaattgctgcgcttcgggccgcgccagtaacgcctcgaattcgtcgagactgtggataacttcttgcccgcggccagcgcaggcatgcacaggtttcaggcggatcggcccgctgtagagcaagcgcgtggcggcgggcagtgcgtctttcagcgcgaacacactcaggccgtcgagcacgactttgcgcacacgctcgcagaacaacggcgaccagccttcgggcgccgtggattcagggccgagcacgccatgggtaatggctttggtgcagatgaaatcgtggtcgacataaccgccccacaggtcgtgcgggcctgtgacgttgagcttgagcgcctgggcggcgccgaccagggtttgcgtgggcaacagatacagctcacggtcggcgtgtttctgcgggtcgtagctgccgccgaacttgagccccaggatctgcgccagccagcgcgccagagcgaggttggtgccgacttcgtgctgcggtgcgcccgctcgtgttgagtgagcgaccaccagtttcttgcgttgagtcggggtcatgcgtcccccttggctatcctgccatgtgtgtgaaaatactgttgcagggatcaagtgcagggatcaagccaaggcacgactgaaaaggatggttgttaaatcaaccagttactgaaaaagtagtggcagtaggcctgtttgattctgcacgacacgaggttaaacacgcggcgttctgcacgattcacacggccctcgcctggccccagctaagctgctggaagccagcccaccgaccacgaggcatcacgcatggccaagcaagcgctcatcctgatcgacatccagaacgactatttcccccaaggcaagtggccactcgacggcgtggaagcggcggcagacaaggccgcgcaggtgctggctgcctttcgacaggccggtgatgccgtgattcatgtgcgccatgagttcaccgccgacgatgcaccgttcttcacgccgggctccgagggcgcgcatctgcatgccaaggtgctgaatgaagcggatgagccggtggtgcttaaacacttcgtgaatgcgtttcgcgggactgatctgcgggcgttgctggaaaaacgcgccatcaccgaggtagtcgtggtgggcagcatgagccatatgtgcatcgacggcgtggtgcgggccgctgcggacctgggctacaaggttacggtgctgcatgatgcgtgcgccacgcgggatctggaattcaatgggcaggtgatcccggcggcgcaggtgcatggggcctttatggcttcattggcctttggttatgcgggtgtggtgtcgacggatgaatacttgaaggcccaagcggcggcatgaccgccacttgtctgccagggttcagcgggtagcgatgatgaacaggcgggggaatggcagcaacaccgtgccatcgcccagggctgggtaagcctgggtaatacgcgcctggtattcctgtaggaaagcggctttttcactgtcgctcaacggcgcaagaaagggccgcaacgccgacgccttgaaccactccaccaccgccgcggaatccgccaagggatgctgataggtggtgcgccatacgtcgatggtgctgcaatgtttgctcagcagctcgtagtaataactcgcggtgtggcgctcattgtgtttcaccgcgccgatcttcgccgcccatgggccctcggccgccacatcacgggccaggcggtgggcaggttcgtcgaggttgtccggggtttgcacggccagcgtgccgccaggtgccagttggttgaccaagtgcggataaagcgtggcgtgatccggcagccattgcagggaggcgttggccagaatcacgtcgaatttttgtgcggggctccaggcaccgatatccgccaattcaaagctcagcgccggtagccgcttgcgcgcatccaccagcatgtcgtcggagctgtccaggccggtgacgtgtgcctgtggaaaacgctcggccagcacctcggtggagttgccagggccgcagcccaggtcgacggcgctacgcacatcggtagtgggaatggccgcgaccaggtcacggacgggacgtgtgcgctgctgttcaaacatcgtgtactgcttggctgaccaggtcatcgcggctttccttcttgttgaggttggccacagcctaaatcttgtgagccatgagaacaaatgccaggattggcgctctcccataccctgaaagtatccttatgttggaatttcgccagctcaaagccttcattgcgattgccgaagaaggctatatcacccgcgctgcggaacgcttagggatgcagcaaccgccgctgacccggctgctgcaaagccttgaagccgaactgggcgtgatgttgatggagcgtctgccccgtggcgtgcgcccgaccaccgccgggctggccttgttagatgaggcacgcaacattctcgcccaggttgaaggggtaaccgacgtggtgcgtcgtgccgctcgcggtgagcgtggccgcttggcgattggcttcaccagctccgcggcgctgcacccgttcgtgcccagcgtgttgcggcggtttcgcgaaacctttgtcggcgtctcggtggtgctggaagaagcaggcaccggcgagctgttggacgcgctggtacatgaaaaactcgacgcggcgtttatccgctcgccgctcagcggctctcagtcgttgcaagaccagcctattttggtggagccgatgctgctggcgctgcctaccgagcatccgctggccatcgacgcgcaatcgcccctgcccttggccgcgttggcgaccgaagcgtttgtgctgtatcgccgccgcgtagggctgggtttgtatgacgcgattctggtggcctgccgtgaagcagggttcagcccgcaggtggttcaggaggcgccacgcatgaccgcgacattgagcctggtggcggcgggacttggggtgtccattgtgccggcgtcgatgcaaagactgcgtggggacggcatcgtttatcgcgaactggccgagtgtcgcagcctggtggcaccgttgcacttggcgacgcgggtcggtgacggctcggcggttttgcggcgtttcaaggagatggtggtgacagcggcagcggcagaggcttgaccatcggcaataaaaaacccccgaggcctgagccatcgggggttttgtgcgttctgggtgctggaccttagaacgggatatcgtcatcaaaactgtcgaaatccggagccggttgtggagcggcctgttgtggaggcggcgcctggcgcgactgttgcggtgccgactgctgcgggcgcggagcctgctggcgtggggccggagcggactgctggtagttgttaccaccgccttgttggtcgccctgttgtggacggccgccgagcagttgcatggtgccttgcatgtcgaccacgatttcagtggtgtaacgcttgatgccgtctttttcccactcgcgggtttgcagtttgccttcgatgtagacctgcgaacctttgcgcaggtattcaccggcgatctctgccaccttgccgaacatcgacacacggtgccattcggttttctcgaccttctggccggtctgcttgtcggtccactgttcgctggtcgccagactcaggttggtcacggcgttaccgttaggcaagtagcgaacttcgggatcctggccgcatgtaccgaccaatatgactttgttaaccccacgggccataacgttctcctaggctgggcgcgctgtcggcactgggttgaccagttgctcgagcgtcgcgcgatccaataattcggtgtccaatttgatgtaaatggccgcctcttcagcgaccacaactgcatctgttaccccaacgacggccttcaggcgctctaccagaccgctttcgcggatcgcctcaggcgatagcggcaaacgcaggcttgtgacgtagggaggttcgcgcatggtaacagcaaaggccagccaaagtgcagccagcccggcgcatccgaggaacacaaccgacaaaccgccatgctggaacatccagccgcccatgatgccgcccagcgcagaacccaggaactggctggtggaatacacccccatcgccgtgcccttgccaccggcgggtgaaactttactgatcagcgaaggcaacgaggcctccagcaggttgaacgcggtaaagaacactaccgtaccgattaccagcgcccgcaggctgtcgccgaactgccagaagaatagctcagtgagcatcaatgtcgcgacggcgcccaggagaactcgtttcattttgcgtttcttctcgccgtagatgatgaacgggatcatggcgaagaacgagatcaacaaggcggtgaggtagacccaccagtgctgctccttgggcaggccggctttttcgaccagcgccagaggcaaggcaacgaagctgcacatcagcatcgcgtgcaacacgaagatacctaaatccaggcgcagcaggtccgggtgcttgagcgtcggcaacaatgccttgcgtgccacgccggactcacggtgctgcagcgtgccggtggaacgcggcaccatgaacgccacgatcacgatcccgaacaacgccatgccgcccgtggcgaggaacagcccgtgcaagccaaaggcgcgggtcagcaatgggccgaccaccatggccaccgcaaacgacaggccgatggtcatgccgatcatggccatggccttggtgcgatgttgttcgcgggtcaggtccgagagcagcgccatgacggcggcggaaatcgcaccggcgccctgcaggacgcgcccggcgattacgccccagatcgagtctgactgtgccgcgaggacactgccgagggcgaacacgatgagcccgaggtaaatcaccggccgacggccgatgcggtcggaaatgatcccgaacggaatctgaaacagcgcctgggtcaggccataggcgccaatcgccaagccgatcaatgcgggggttgcgcctgcgagatccattccataggtcgccagcaccggcaacaccataaacatgccaagcatacggaaggcgaacaccagggccagaccgcttgccgctcgggtctcgccgctactcatgcgttcgctgtggggatcgtgcatggaaaaacctcgtgtgaaccggcggcgattctaccagtcccatcgattgagagggtatatgcggcgctttgccgcgcagctttcatgtaaggctgcacccggcactttgacagtgtatattcatccagtctttagccgtatactcctgcattatttacgcccgccgtgcgaggccatcttggacaagatcctgattcgtggggctagaacccacaacctgaagaacatcgacctgaccctgccccgggacaaactgatcgtcatcaccggcctgtccggctccggcaaatcgtccctggcgttcgacacgctgtatgccgaaggtcagcgtcgctatgtggaatcgctgtcggcctacgcccggcagttcctgtcgatgatggaaaagcccgacgtcgacaccattgaaggcctgtcgccagcgatctccatcgagcagaagtcgacgtcccataacccacgctccaccgtgggcaccattaccgaaatctacgactacctgcgcttgctgtatgcgcgcgtgggtattccgcgctgcccggaccacgatattcccctggaagcccagaccgtcagccagatggttgacctggtgctggcccagccggaaggcgccaagctgatgctgctggcgccggtgattcgagagcgtaaaggtgaacatctttcggtattcgaagagctgcgtgcgcaaggttttgtgcgcgcacgtatcaacggcaagctctatgagctggatgaagcgccgaaactcgacaagcagaagaagcactccattgatgtggtggtcgaccgcttcaaggtccgcgccgatttgcaacagcgtttggccgagtcgttcgagaccgcgctgaaactggcggacggtattgcactggttgcaccgatggacgacgagccgggtgaagagatcatcttctccgcgcgctttgcctgcccgatctgtggtcacgccatcagcgagctggaacccaagctgttttccttcaacaacccggctggcgcctgcccgacctgtgatggcctgggggttaagcagttctttgacatcaagcgcctggtcaacggtgacctgaccctggcggaaggtgcgatacgcggctgggacaggcgcaatgtctactacttccagatgttggggtcgttggcatcgcactataaattcagcctggaagtgccgttcaaccaactgccggccgagcagcaaaaagtcatcctgcacggcagcggctcgcagaacgtcgacttcaaatacctgaacgaccgtggcgatatcgtcaaacgttcgcacccgttcgaaggtatcgtgccgaacctggagcgtcgctaccgcgagaccgagtcggcgagcgtgcgcgaagagctggcgaaattcctcagcactcagccttgcccggattgccggggcactcgtctgcgtcgtgaagcacggcatgtgtgggtgggtgagaagaccttgccggcagtgaccaatctgccgattggcgacgcgtgtgagtactttggtgtgctcaagctgaccggacgacgtggggaaattgccgacaagatcctcaaggagattcgtgagcgcctgcagtttctggttaacgttggcctggattatctgtcgctggatcgcagcgccgataccctgtcgggcggcgaagcccagcggatccgtttggccagccagattggtgccggcctcgtgggcgtgttgtacatcctcgatgaaccgtcgattggcttgcaccagcgagacaatgaccgcctgctgggaacgctgaagcacctgcgggatatcggcaacacggtgatcgtggtcgagcacgatgaagatgcgattcgcctggcggattatgtggtcgacattggcccgggtgcgggtgtgcacggtgggcatattgttgccgagggcacgcctgccgaggtcatggctcacccggactcgttgaccggtaaatacctgtccggccgcgtgaagattgaagtgccggccaagcgtacgccacgcaacaagaagctggcgctgcacctcaagggcgcgcgcggcaacaacctgcgcaatgtcgacctggaaattccgctgggcttgttgacctgtgtgaccggtgtgtccggttcgggcaagtcgacgctgatcaacaacacgctgttcccactgagcgccaccgccttgaacggcgcgaccactctggaagcggctgcgcacgacagcatcaagggccttgagcatctggataaagtcgtcgacatcgaccaaagcccgattggccgtacaccgcgctccaacccggcgacctataccgggttgttcacgccgattcgcgaactgttcgccggcgtaccggaatcccgctcgcggggttatgggcctggccggttctcgttcaacgtcaagggcgggcgctgcgaagcgtgccagggcgatggcttgatcaaggttgagatgcactttttgccggacatctacgtgccgtgcgatgtgtgcaagagcaagcgctataaccgcgaaactctcgagatcaagtacaagggcaagagcatccacgaaaccctcgaaatgaccatcgaggaagcacgggtgttcttcgacgcggttccagcgttggcgcgcaagctgcaaacgttgatggatgtgggcctgtcgtacatcaagctggggcagtcggcgactaccttgtctggtggtgaggcgcagcgggtgaagttgtctcgtgagctgtccaagcgtgacaccggcaaaaccctgtatatcctcgatgagccgaccacgggtctgcactttgcggatatccagcaattgctcgacgtgctgcaccgcctgcgcgaccacggcaacacagtggtggtgattgagcacaacctggatgtgatcaagactgccgactggctggtggaccttgggccggaaggcggctccaagggtggtcagatcattgcggtaggcacgccggagcaggtttccgagatgccgcagtcgcataccggttactacttgaagccattgttggcacgcgataaagcctgatttatcgggtgcatgaaaaagcccctgtcactttgcggtgacaggggcttttttgtagccgggaatcagaactgcgattgcaggtaattctccagaccaaccaatttgatcaggcccaactgcttttccagccagtaggtgtgatcttcttcggtgtcattcaactgcacccggaggatttcgcgggtgacatagtcgttgtgctgctcgcagagctcgatgcccttgcagagcgcggcacgcaccttgtactcgaggcgaagatcggctgcgagcatgtcaggtaccgtggtgcccacatccaggtcgtcgggacgcatacgtggcgtgccttcgagcatcagaatacggcgcatcagtgcgtcggcgtgctgtgcctcttcttccatttcgtggttgatacgttcgtagagctcggtaaagccccagtcttcgtacatacgcgaatgaatgaaatattggtcacgagctgccagttcgcccgtcagcaacgtgttgaggtaatcgattacgtcggggtgaccttgcatcgccctacatctccctgcttgaaagtctgtagtttgaaccatcatgacccggaggtcacgagaccaacggcagaaaagcgaagaatttctgagaaaagtagcggaaataacgcaaaaaccgcccaaatgagggcggttctgcttctcgtttagagtcagctaagcgttacgcccagcgccgttgcaatgccttggccgtaatcggggtcggctttgaagaaatgctgcagctggcgctgaaccacatcactgctcacgccatccatagccccggcaatgttgttgatcagcagggccttttgcccggcatccatcaaacggaacagtgcgcctgcgtgactgtagtagtcggtgtcttcacgctgatcgtagcgattcgccgcgccattgagtgccagaggtggctcagcgtattgaggcgcctgttgtggcgtaccagcgacgctgtttggttcatagttaggagacgcacctccgaaaccaagggacatcgaaccgtcacgctgattgttattaaccgggctcaagggagcattgaccggcaactgctggtggttggtaccaacacgataacggtgagcatccgcataagcgaaaacgcggccttgaagcatgcggtccggcgagagaccaacacccggaaccatgttgcttgggccaaagcacgcctgctcgacttcagcaaagtaattcaccggattacggtccagcacgagctcgccaacctcgatcagcggaaactcctgctgtgaccaggtcttggtcacgtcaaacgggttttcgtagtgagcttcagcctcggcttcggtcatgacctgaatgttgacgctccacttgggaaagtcgccctgctcgatagcgttgaacaggtcacgctgagcgtaatcaggatcagtgccggcaatgcgagtcgcctcttcaggcgtcaggttcttgataccttgcttggttttgtagtgccacttgacccaatggcgctcgcccttagcattgatcaggctataggtatgactcccgaagccgtgcatatggcggtaaccgtctggagtgccacgatccgagaaaaggatggtgatctggtgcaacgcctcaggagagagcgaccagaaatcccataccatctgtgcacttttcagattcgtctgcggcagccgcttttgggtgtgaatgaagtcggggaacttcagcgggtcgcggatgaagaatactggcgtgttgttgccaacgatgtcccagttaccttcttcggtatagaacttcaaagcaaagccacgcgggtcacgcgcggtatccgccgagcctcgctcgccgccaacggtggagaatcgaaggaaagtaggtgtttctttaccaacggattcgaacagcttcgcactggtgtactgggtgatgtcccgggttacggtgaatttaccgtgagcgcccgaacccttggcgtgtacgcgacgctcagggatgttttcacggttgaagtgcgcaagcttctcgatcaggtgaaagtcatcgaggagcaacgggccacgcggaccggcagtacgggagttctggttatccgcaacgggggcaccgctggcggtagtaaggatattactcatgctcaatcttcctcaggtcagactaggaactgccggctaatcggcttggagggagtattgaccatcaagatgacaccatcaaatgcattaaatcatggactttgatagaaaataactaacacagaacctcgacggatagcggtgggtttattagagaaccggcagtgacgtgagaaatatagccggttttcgaccgcccacaaaaaaccgggcactaggcccggttctctgttgcagactgtcgtcttactcggcgcttacagcttcgccggcagtagcacgatcaaccaactcgacgtacgccataggcgcgttgtcgccagcgcggaaaccgcacttgaggatgcgcaggtagccaccctcacgggtagcgtaacgcttgcccaggtcgttgaagagcttaccaacgatagctttcgaacgagtacggtcgaaagccagacggcggttagccaggctgtctgtcttggccaaagtgatcagcggctcagcaacgcgacgcagttctttagctttcggcagtgtagttttgatcagctcgtgctcgaacagcgacaccgccatgttttgaaacatggccttgcggtgcgagctggtacggctcaggtgacgaccacttttacgatgacgcatggttcattccttaccaaactcacgttcggtgattacgacgatcaggcagtcgccttgtcgtccttcttaagacttgcaggcggccagttgtcgaggcgcatgccgagggacagaccgcgggaggccagaacgtccttgatttcagtcaaggatttcttgcccaggttcggagtcttcaacagttctacttcggtacgctgaatcaggtcgccgatgtagtaaatgttttccgccttaaggcagttagccgaacgtacagtcagttccagatcgtcaaccgggcgaagcaggatcggatcgatctcgtcttcctgctcgattaccactggttcgctgtcacctttgaggtcgacgaacgcagccaactgctgttgcagaatggttgcagcgcggcggatagcctcttcagggtccagagtaccgttggtttccagatcaataaccagcttgtccaggttagtacgctgctcgacacgggcgttttccaccacgtatgcgatacggcgaaccgggctgaacgaagagtcaagctgcaagcgaccaatgctgcggctttcgtcttcatcgctctgacgcgagtcggccggttcataaccacgaccacgagctacagtgagcttcatgttcagggcgccgttagacgccaggttagcgattacgtgatcggggttaacgatctcgacatcatgatccagctgaatatcggcagcggtaaccacccccgaacccttcttcgacaaggtcagcgtaacttcgtcacggccgtgcagcttgatagccagacctttaaggttcaacaggatttcaattacgtcttcctgtacaccttcgatggcgctgtactcgtggagcacaccgtcaatctcggcctcgactactgcacagccgggcattgaggacaacaggatgcggcgcagcgcgttgcccagggtgtggccaaaaccacgctcgagaggctcgagagtgatcttggcgcgggttggactgacaacctgcacatcaatgtggcggggtgtcaggaactcatttaccgaaatctgcatggatgcacctattttctagcccttacttggagtagagctcgacaatcaggctttcgttgatgtcggcggacagatcactgcgagcaggaacgttcttgaaaacgcccgacttcttctcagtgtctacttctacccattctacgcggccacgttgggcacacagatcgagagcttggacaatgcgaagttggttttttgctttctcgcgaatcgcgactacgtcaccagcacgaacctggtaagacggtacgttaacggtttggccgtttacgctgacggatttgtgcgataccagctgacgggattcggcacgagtcgaaccaaagcccatacggtatacaacgttgtccagacggcattcgagcagttgcagcaggttttcaccggttgcaccttttttgccagcagcttctttgtagtagccgctgaactgacgctcgagaacgccgtagatacgacggaccttctgcttttcacgcagttgggtgccgtaatcggactggcgaccgcggcgttggccgtggataccaggtgctgcttcaatgttgcacttcgattcgatcgcgcgcacgccgctcttcagaaagagatcggtgccttcgcgacgagcgagtttgcattttggaccaatgtaacgagccattctttacaatctcctggattacacgcggcgcttcttcggcggacggcacccgttgtgcgggattggcgtcacgtcggtgatgctggcgatcttatagccacagccgttcaaagcacggacagcagactcacgacctggacctggacctttgacgttaacgtcgaggtttttcaggccgtattccagcgcagcttgaccagcacgttcagcagctacttgagcagcgaacggcgtggacttgcgggaaccgcggaaacccgaaccaccagaggtagcccaagacagcgcgttaccttgacggtcggtgatggtcacgatggtgttgttaaaagaagcatggatgtgggcgatgccatcaaccactgtctttttaacttttttacgaggacgagcagcaggttttgccatgataattttcctgtcgattcgctggggcgattacttgcggatcggcttacgcggacctttacgggtacgcgcgttagtcttggtacgctgaccgcgtactggaagaccacgacgatgacgcagaccgcgatagcaaccgaggtccatcaaacgcttgattttcatgttgatttcgcgacgcaggtcaccttcagtggtgaacttcgccacttcgccacgcagcaattcaatctgctcgtcgctcagatccttgatcttagcggctgggtttaccccagcaactgcgcaaattttctgcgcagtagtgcgaccaacaccatagatgtaggtcagcgagataacagtgtgcttgttatctggaatgttaacgcctgcaatacgggccattcagtgggactccaattgacagctacctacgccccggaagccaagaaatagggcgcgagataatatcgctgtaataacaaataatcaacccggcagcgcactagctgccgggcttcaagcggatcacactcagccttggcgctgtttgtgacgcggttccgcgctgcaaattactcgaacaacaccttcgcggcgaataatcttgcagttacggcacagctttttcaccgatgcacgaactttcatcaccaactcctcgaaccttatgggtactcagcgcaacatgccgctgccgtaacccttcaggttggctttcttcatcagggattcgtactggtgcgaaacgaggtgcgattgtacttgggacatgaagtccatcacaaccacgaccacgatcagcaacgaggtcccgccaaggtagaacggaacgtttgctgcaaccaccaagaactggggcaacaagcagacggccgtcatatatagagcaccgaacagggtcaaacgagtcagaacgccatcaatgtagcgtgcagactgctcacctggacggatacccggaataaaggcaccggacttcttcaggttttccgctacgtctttcggattgaacatcaacgccgtatagaagaagcagaagaaaataatccctgcactaaacagcagaatattcaacggctgaccaggagcgatcgactgagagaggtcctgcagccagcccatgttttcagactgaccaaaccaggtacccaacgaagccggaaacagcaaaatgctgctcgcgaaaattgccggaataacaccggccatattcactttcagcggcaagtggctggtctgcgcagcgaagaccttgcggccctgctgacgcttggcgtagtgaacagcaatacgacgctggccacgctcaatgaacaccacaaaaccgataatcgctactgccagcaaaccgatagcaaccaaggcgaagatattgatatcaccctgacgcgcagactcgaaagactgcccaattgctctcggaagaccggcgacgatacctgcgaaaatcaacatcgagataccgttaccaacaccacgctcagtaatctgctcacccagccacatcataaacatcgcaccagccacaaacgtggataccgcgacgaaatagaagccaaagtcaccagtgaacgcaacaccctgcccggccaagccaacggacatgccgatagcttgaaccagggcgaggatgacagtgccgtagcgggtgtactggctaatcttgcgacggccagcttcaccttccttcttcaactgctccaactgcggactgacggcggtcatcaactgcatgatgatcgatgccgaaatgtacggcatgatccccagtgcaaagatactcatccgttccagcgcgccaccggaaaacatgttgaacaagctaagaatggtcccctcattctgtcgaaacaggtctgcgagtcggtccgggttgatacctggaaccgggatgtgtgcgcctattcggtagacgataatcgccaggaacagaaaacgcagacgagcccaaagttcagacataccgcctttgccgagcgctgagagagcaccttgcttagccatttattcctcgaacttgccgccagctgcttcgatagccgaacgcgcacctttggtggcgccgattcccttgccgatagtgacagcgcgagtcacttcaccggacagcatgattttcacacgctgtacgttgacgttgatcacgttggcatctttcagggtttgcacagtaacgatgtcgccctccactttagccagctcggacaaacgcacttctgcgcggtccatggctttcagggatacgaaaccgaacttaggcaggcgacgatgcagcggctgttgaccgccttcaaagcctggagcgatggtgccaccggagcgggaggtttgacctttgtggccacggccaccagtcttacccaaaccgctaccgataccacggcccggacgatgcttttcgcgacgggaacccggcgctggactcagatcattgagcttcatcgattaaccctctacacgcagcatgtagtaagccttgttgatcatcccgcgattctcgggagtatcctggacttctacagtgtgaccgatgcgacgcagacccaaacctttaacgcacagtttgtggttaggaatgcggccggtcatgcttttgatcagcgttactttaacggtagccatgatcagaagatctccttgacagtcagaccacgcttggcagcgatggactcaggagattgcatagctttcaaacctttgaaagtggcgtgaaccacgtttaccgggttagtcgagccgtagcacttggccagaacgttctgaacgccagcaacttcgaggacagcacgcatagcgccgccagcgatgataccggtaccttcagaggcaggctgcatgtacaccttcgaagcgccgtgagcggacttcatagcgtactgcagagtagtgccgttcagatcaacttggatcatgttgcgacgagcagcttccattgccttctggatcgcagcaggcacttcacgtgacttgccacggccgaagccaacacgccctttaccatcacctaccacggtcaacgcggtgaaagtgaagatacggccgcctttaacggttttggctacgcggttaacttgaaccagcttctcaatgtagccttcgtcgcgcttttggtcgttatttgacataacttagaactccagcccagcttcacgagcagcatcagccagcgctttaacgcggccgtggtacttgaagccagagcggtcgaaagccacttgcgagacgccagcggccttagcacgcgtagcgaccagctggccaacctttgtggccgcgtcgatgttgccagtggcaccatcacgcagttctttatccaaagtcgaggcgcttgccaggactttgttgccgtcggccgagatgacctgggcgtagatgtgctgcgacgagcggaacacgcagagacgcacgacttcgagttcgtgcattttcaggcgtgctttgcgagcgcgacgcagtcgagtaacttttttgtcggtcatttgctatgccctacttcttcttggcttctttacgacggacgacttcgtccgcgtagcgcacacctttgcctttgtacggctctggtggacggaagtcgcggatctcagcggccacctgacctaccagctgcttatcaatacccttgatcaggatatcggtctggctaggggtctcagcggtgatgccttccggcagttcgtaatccactgggtgcgagaagccaagggccaggttcaaaaccgtgccttttgcttgcgctttgtaaccaacaccgaccagctggagcttacgctcgaagccttggcttacgccttggaccatgttgtttaccaacgcacgcgtggtaccggccattgcgcgagtttgttgatcgccattgcgagcagcgaaacgcagctcaccagcttcttcaacgatctcaacggacgaatggatgttcagttcaagagtgcccttggcacccttcaccgaaagctgttggcctgcgaatttgacttcgacaccggctggcagcttaacggggttcttagcgacgcgagacatgcttatccccccttagaacacagtgcaaagaacttcgccgccgacaccggcagcgcgcgcagcacgatccgtcatcacacctttgttggtggagacgatagacacgcccagaccgccacgaactttcggcagatcttcagcggacttgtactgacgcaggcctggccggctaacgcgcttcacttcctcgatgaccgaacggccttcgaagtatttcagctcgatggacagcagtggttttgtttcgctgctgatctgataacccgcaatgtagccttcgtctttcaggactttggcaacagctaccttcaacttggaagatggcatgcttacgacggacttttcagccatctgggcattacggatacgagttagcatgtccgctaacgggtcctgcatactcatgggctagacgctcctaatacaaaaaaattagccttgcggctacatatgtcgccgagaatctccgagcatagaaaacacgggctcaggcgagccgggtattctagacacactccggaaatgaaacaagccccaaaaggggcttgttccagattcaaggtcaccggcggtcagtatcttgcgacgcaaaccgcctggacttcgaaagtacttaccagctggctttaaccagacctggtacgtcaccacgcattgccgcttcacgcagtttgttacggccgaggccgaacttgcggtaaacgccgtgtggacgaccggtcaggcggcagcggttacgcatgcgcgaggcgcttgcgtcacgtggctgcttctgcagagcaactgtagcttcccaacgcgcttctggacttgcgttcagatcaacgatgattgctttcagtgctgcacgcttcttggcgtacttggcaaccgtgagctgacgcttcagctcgcggtttttcatgctcatcttggccatggtcctactccaatcagttgcggaacgggaatttgaaagcacgcaacagggcgcgaccttcatcatcgttcttggcagtggtggtcagggtgatgtccagaccgcggagagcatcgatcttgtcgtagtcgatttccgggaagatgatctgctctttaacgcccatgctgtagttaccacgaccatcgaaggacttggcattcaggccgcggaagtcgcgaacccgaggcagggagatcgacagcagacgatccaggaattcgtacatacgctcacggcgcagagtcactttgacgccgatcggccaaccttcacggactttaaagccagcgatggatttccgagcgtaagtcacaacgactttttgaccggtgatcttttccaggtcggcaacagcgtgctcgatgacttttttgtcaccgatcgcttcgcccagacccatgttcagggtgattttggtaacgcgcggaacttccatcacgttcccgagcttaagttcttccttaagcttaggggcgatttccttccggtaaatctcttgtagtcgtgccatggtctaatctacctagcagtgttcaagcatcaaccgctttttgggtcgacttgaagacacgaattttcttaccgtcttctactttgaaaccaacgcggtcagccttgttggtttcgccgttgaagatggcgacgttagaagcgtccagcggagcttctttctcgacgataccgccctgcacgcccgacatcgggttaggcttggtatgacgcttgaccaggttcagaccaccgataaccagacggttattagcgagaaccttaagcaccttaccgcgcttacctttgtctttgccggcgatcacgatgatctcgtcgtcacgacgaatcttttgcatgtcggatctccttacagcacttctggggcgagcgagacgatcttcatgaacttctcagtacgaagttcacgggtcactggcccaaagatacgggtgccgatcggctcttgcttgttgttcagaagaacagcagcgttgccatcaaagcggataatggagccatctgcacggcgtacgccgtgacgagtgcggactacaacagcagtcatcacttggccttttttcactttaccgcgaggaattgcttccttcacggtaactttgatgatgtcaccgataccagcgtaacgacgatgggagccacccagcaccttgatgcacataacacggcgagcgccgctgttatcggccacatcgagcatggattgagtctgaatcatataatttctccgacccctagtccttagacttccacagcgcgttcgagaacatcaaccagtgcccaagacttggtcttggccagcggacgagtttcacgaatagtgactttgtcgccgatgtggcactgattggtttcgtcgtgcgcgtgcagcttagtcgaacgcttaacatatttaccgtagatcgggtgcttaacgcgacgctcgatcaaaacggtgatggttttgtccatcttgtcgctgacaacacggccagtcagcgtacggacagtcttttcggcttcagccatgatcacttacctgcctgctggttgagcacagtcttcacgcgagcgatgtcacgcttaacttgcgagagcagatgagactgccccaactggccagttgctttctgcatacgcagattgaactggtcgcgcagcaggccgagcagttgctcgttcagctgctgtgcggatttttcacgaagttcattcgctttcatcacatcaccgtccgtttaacaaaggcggtggcgagcggcagctttgcagcagccagggcaaaagcctcacgcgccagctcttcagttacaccctcgatttcatacaggactttgcctggctgaatctgggctacccagtattccacgttacccttacctttacccatccgaacctcgagaggctttttggagatcggcttgtccgggaatacacggatccagatcttgccgccacgtttaacgtgacgggtcagtgcacgacgcgctgactcgatctgacgagcggtgagacgaccacgagctacagacttcagcgcgaactcgccgaagctgactttgctaccgcgctgtgccagaccacggttgtggcctgtcatctgcttgcggaacttcgtacgcttaggttgcaacatttggcgtaccccttacttagcagcttttttacgaggcgctggtgcttgtggtttcagttcttcttggcgaccaccaattacttcgcctttgaagatccaaacctttacaccgatcacaccataagtggtgtgagcttcgtagttggcatagtcgatgtcggcacgcagggtgtgcagtggcacacgaccttcgcgataccattcagtacgtgcgatttcagcaccgccgagacgaccgctcacttggattttgatgcctttggcaccaatgcgcatggcgttctgtacagcgcgcttcatggcgcgacggaacattacgcgacgctccagctgctgagctacgctctgcgcaaccagcataccgtcgagctccggcttgcggatctcttcgatattgatgtgcacaggcacacccatttgcttggtcaggtcctgacgcagtttctcaacatcttcacctttcttcccgataacgatacctggacgagcggtgtggatggtgatacgtgcagtttgcgccggacgatggatatcgatacggcttacggacgcgctttttagtttgtcttggagatactcacgcaccttcagatcagcgaacaaatagtccgcataagtccgaccgtctgcgtaccagacggaggtgtgctccttgacgattcccaggcgaatgccaatgggatgtactttctgacccatctcttcgactccgttacttgtcagcaaccttgacagtgatatggcaagaccgcttgacgatgcgatcagcacggcctttggcacgtggcatgatgcgcttcagcgaacgcccttcgttgacgaaaacggtgctgaccttcaggtcatcaacgtctgcgccttcgttatgctcggcgttggctacggccgactccagcactttcttcatgatctcggcggctttcttactgctgaaagccaacaggttgagcgcttcgcccaccttcttcccgcggatctggtcggcgaccaagcgggctttctgggcggagattcgagcgcccgacaacttagcggctacttccatttccttaccccttaacgcttggctttcttgtctgccacgtgcccacgataagtgcgggtaccggcaaactcgcctagtttgtggccgaccatgtcttcgttaacgagaactgggacgtgttgacgaccgttgtgtactgcgatggtcaaaccgaccatttgtggcaggatcatcgaacgacgcgaccaggtcttaactggtttgcgatcgttcttttccgccgccacttcgatcttcttcagtaggtgaagatcaataaaaggaccttttttcagagaacgtggcactgtcgtatccctctatttacttgcgacgacggacgatcattttgtcggtacgcttattaccacgagtcttcgcgcccttagtcgggaagccccatggcgataccggatgacgaccaccagaggtacgaccttcaccaccaccgtgtgggtggtcaaccgggttcatggcaacaccacgaacggttgggcgaacgccacgccagcgtttggcaccagctttacccagcgaacgcaggctgtgctcggagttcgagacttcacccagggtcgcgcggcattcagccagcactttacgcatctcaccagaacgcagacgcagggtcacgtagacaccttcacgagcgatcagctgagccgaagcaccagcggaacgagcgatttgcgcgcctttacctggcttcaattcgatgccgtgtacggtgctaccaactggaatgttacgcagttgcagagcgttgcccggcttgatcggcgccagagcacctgcgatcagctggtcgccagcactcacgcctttaggggcgatgatgtagcgacgctcgccatctgcgtacagcagcagagcgatgtgagcagtacggtttggatcgtattcgatacgctcgacagtggcagcgatgccatctttgtcgttgcgacggaagtcgaccagacgataatgctgcttatggccaccaccgatgtgacgagtggtaatacgaccattgttgttacgaccaccagtcttcgattttttctcgagcagcggtgcgtgaggagcgcctttatgcagctcctggttgaccaccttgaccacaaaacggcggccaggggaagtcggtttgcatttaacgattgccatgatgcaccccttccttactcagcactgctgctgaaatcgagatcttggcctggctgaagggagataactgccttcttccagtcattacgcttgcccagaccgcgagcagtgcgcttgctcttacccagaacattcagggtagtaacacgctctactttcacgctgaacaggctttcgacggccttcttgatttccagcttggttgcgtcagttgcaaccttgaaaacgaactggcctttcttgtcagccagaaccgtagccttttcggaaacgtgcgggccaagcagaactttaaatacgcgttcctggttcatcccagcagctcctcgaatttcttcacggccgacacggtgatcaacaccttgtcgtatgcgatcagactaactggatcggaaccttgcacgtcacgtacatcaacgtgtggcaggttgcgagcagccaggtacaggttctgatcaacagcttcagacacgatcaaaacgtcggtcagattcatgttgttcagcttgcccagcagatctttggtttttggaccttcaacagcgaagtcctgaaccacgaccagacgatcagtacgcacgagttcagcaaggatggagcgcagagctgcgcggtacatcttcttgttgagcttctgagtgtgatcctgtggacgagctgcgaaagtggtaccgccgccacgccagattgggctacggatagtaccggcacgagcacggccagtgcctttctgacgccaagggcgcttaccgccaccacgtacgtcggaacgggtcttttgctgcttgctaccttgacggccgccggccatgtaggccacgactgcttggtgaaccagagtctcgttgaattcgccgccaaatgtcagttcggaaacttcgatcgcttgagcgtcatttacatttaattgcatgtcagcttccccttaaccgcgagccttggccgctggacgtacaaccaggttgccgccagtagcgccaggaacagcacccttgaccaacaacagattgcgttcagcgtcgacgcgcactacttcgagggactgcacggtcacgcgctcagcgcccatatgaccggacatttttttgcccttgaatacacgaccaggagtctggcactggccaatagagcccgggacgcggtgggaaacggagttaccgtgagtgttgtcttggccacggaaattccaacgcttgatcgtaccctggaagcctttacctttggactgaccggttacatcaaccagttgaccagcggcgaagatttcagcgttgatcagatcgccagcctggtagtcgccatcttcaagacggaactccataacagtgcgaccagctgcaacgtttgctttagcgaagtgacctgcttgagcagcagtcacacgcgaagcacgacgctcgccgacagtgacttgcactgcacgatagccatcggtttcttcagttttgaactgggtgacgcgattcggttcgatctcaatgaccgtgaccggaatggagacaccttcttcggtgaaaatacgggtcataccgcatttacgaccgactacaccaatagtcatgttgtaaacctcatgagtgtacggggctttcacccgctatggccgcccatttcagagcgttacacgactaagacccaagtcttagccgaggctgatctgtacttccacaccggccgccagatcgagcttcataagagcatcaacggttttatccgttggctggacgatgtccagtacgcgcttatgagtacggatctcgtactggtcacgcgcgtctttgttgacgtgcggggagaccagaacggtgaaccgctctttacgggtaggcagtggaattggaccacgcacttgagcaccagtacgtttcgcggtttccacgatttcctgggtggattggtcgatcaggcgatggtcaaaagccttcaacctgatacggatttgctgattttgcattggatttcagactccggctgctattcccagcgagcgcaatacgcccgttaaaaggaggcgcaattctatagacggccctgataggtgtcaacccaataaaaaaggcccccgctaagcgggggcctcctcaaaacatcaaggctatctcagaagagataattactcgatgattttagctacaacgccagcaccaacggtacggccgccttcacggatagcgaagcgcagaccgtcttccatcgcgatggttttgatcagggtaacaaccattttgatgttgtcgcctggcataaccatttcaacgccttccggcagttcgcagttaccagtcacgtcagtagtacggaagtagaactgtggacggtagcctttgaagaacggagtgtgacgaccgccttcttctttgctcagcacgtacacttcagcttcgaacttggtgtgcggcttaaccgaacctggcttaaccagaacctggccacgctcaacgtcgtcacgcttggtaccacgcagcagaacgccgcagttctcgccagcacgaccttcgtcgagcagcttacggaacatttcaacaccggtgcaggtggtgacggtagtgtcacgcagaccaacgatttccagtggatcttgaaccttaacgataccgcgctcgatacggccagtcacaacagtaccgcgaccggagatcgagaatacgtcttcgattggcatcaggaacggcttgtcgataacacgaactggatctgggatgtagctgtccagagtttcaaccagtttacgaacggacgtggtgcccatttcgttgtcgtctttgccttccagagccatacgagcagaaccgatgatgatcggagtgtcgtcgcctgggaagtcgtaagtgctcagcagatcgcgcacttccatctcaaccagttccagcagctcagcgtcgtctaccaggtcagccttgttcaggtaaaccacgatgtacggaacgcctacctgacgggacagcaggatgtgctcacgggtttgtggcatcggaccatcagcggccgagcaaaccaggattgcgccgtccatctgggcagcaccggtgatcatgttcttcacatagtcagcgtgacctgggcagtcaacgtgagcgtagtgacggatcagcgagttgtattcaacgtgcgcggtgttgatggtgataccacgagctttttcttctggtgcgctgtcgattttatcgaaatcaacgattgcggaaccgaaaacttcggagcaaacgcgagtcagagcagcagtcagagtggttttaccgtggtcaacgtgaccgatggtgccaacgttgacgtgcggtagggaacgatcaaatttttctttagccacgacaattaactccttgcctaaaggactgaatcagccttgttttttggatacagtttcagcgatgtgcgccggagctgtgttgtattttttgaattccatagagtagcttgcgcgaccctgagacatggagcgaacgtcggtcgcataaccgaacatctcacccaacggaacctcggcgcgaatcactttgccggaaaccgtgtcttccatacccaagatcatgccgcgacgacggttaaggtcgcccatgacatcacccatatagtcttcaggtgtaacaacttctaccgccatgattggctcaagcaactcaccaccgcccttctgggccagttgcttggttgccatggaagcagccaccttaaacgccatctcgttggagtcgacgtcgtggtaagaaccgtcaaaaacggttgctttcaggccgatcagcggatagccggcaacaacaccgttcttcatctgctcttcgatacccttctggatagccgggatgtattccttaggaacaacaccaccaactacttcgttcacgaattgcagaccttcctgaccttcgtcagcaggtgcaaaacggatccagcagtgaccgaactgaccacgaccgccggactgacgaacgaacttgccttcgatttcacagttcttcgtgatgcgctcacgataggaaacctgaggcttaccgatgttggcttcgacgttgaactcacggcgcatccggtcaaccaggatgtccaggtgcagctcgcccatgccggagatgatcgtttgaccagtctcttcatcagtcttgacgcggaaagatggatcttcctgagcaagtttgcccagagcgatacccattttttcctggtcatccttggtcttaggctctacggcaaccgaaataaccggctccgggaagtccatgcgaaccaggatgattggcttagcagcgtcgcacaaagtctcaccagtggtgacgtccttcatgccgatcagggccgcgatgtcaccagcgcgcacttccttgatctcttcacgggcgtttgcgtgcatttgcaccatacgacccacgcgctctttcttacctttaaccgagttgatcacgccgtcgccggatgccaacacgcccgagtaaacacggacgaaggtcaaggtacccacgaatgggtcggtagcgatcttgaacgccagggccgagaacggctcgctgtcgtctgcatgacgctccatttcttcttcctcgttatcagggttggtacccttgatagcaggaatgtcggttggagcaggcaggtagtcgatcacagcatcgagaaccaggggaacgcccttgttcttgaacgaggaaccgcaaacagccaagacgatctcaccagcgatagtacgctgacgcagagcggccttgatttccacgttggtgagctcttcaccttcgaggtacttgttcatcagctcttcgctggcttcggcagcagcctcaaccatgttgttgcgccactcgtcagccagttcctgcagttcagcagggataggcttacgaacaggaaccatacctttgtcggaatcattccagtagacagcttccatgttgatcagatcgatctgaccctggaagttatcttcggaaccgatagccaattggattggcaccggggtgtgacccagacgctgcttgatctgaccgatcacgcgcaggaagttggcaccagcacggtccatcttgtttacgtaaacaagacgtggaacgccgtatttgttggcttgacgccatacggtttccgactgaggctcaacgcccgaggtaccacagaacacaacgacagcgccgtcgagtacacgcagggaacgctcaacttcaatggtgaagtctacgtggcctggggtatcgattacgttgaagcggtgctcatctttgtactgcttctcggaacctttccagaaggcggtaatagcagcagaagtaatggtaataccacgctcctgctcctgaaccatccagtctgtggtcgcggcgccgtcatgcacctcgcccattttgtgacttttgccggtgtaaaacagtacgcgctcggtggtggtggttttaccagcatccacgtgagcaacgataccgatgttacggtagcggctaatcggagtagtacgagccataaagccctcgcaaaattagtgaagctaagattagaagcggtagtgcgagaaagctttgttagcttcagccatacggtgcacgtcttcacgcttcttaacagcagcacctttaccttcagcagcgtccaacagttcgccagccaaacgcagagccatagacttctcgccgcgcttacgggcgaagtctaccaaccagcgcattgccagagcgttacgacgggacggacgaacttcaaccggaacctggtaagtagcaccgcctacacggcgcgacttcacttcgaccagcggagcgatggcgtcgagagctttctcgaagatttccagggggtcgctgttcttgcgttctttaaccttttccagcgcgccataaacgatacgctcggccacggctttcttgccgctttccatcacgtggttcatgaacttggccagaatttggcttccgtattttggatcgtcaagcacttcgcgcttggctgctacgcgtcttcttggcatggataagccctcaaacggtcttcaggttcgctcggaatcagtgccctttcggggcgcctccgaccttactcttatcgactcagaaaataagatgattcagttttacaaaaagccgctactacttaggcttcttggtaccgtacttcgaacgaccctggttacgacctttaacgccggaagtatccaaggagccgcgtacggtgtggtaacgaacacctggcaagtcttttacacgaccgccgcgaatcagtaccacgctgtgctcttgcaggttgtggccttcaccaccgatatacgaggaaacctcgaaaccgttggtcagacgcacacggcatactttacgcagtgccgagttaggttttttcggcgtagtggtatacacgcgagtgcatacgccacgacgttgcgggcagttctgcagcgcaggcacgtcggatttctcgacgatacgcttacgcggctgacgtaccagctggttgatagttgccatctactagctccactgttgtcttgcgacgctattgtcttgcaagaaaagcaaaatggcaggaacgaattcccgccaaatttaggggtacaagagtctaaagaggatcttgtccccagtcaaggcaaggccccgacctcccctctcatcgaaccggggcaaaactgcctcgatccgacgaatggggctgccagggcccagacttatttaccgcagaactcagttaccgcttgagttcagcgcttcggtcagtgcagcttccacttcactggcgcttacgcgcagcggcttgtcagcatcacggcggcgcttgcgctcgctgtggtaagccaaaccggtacccgccgggatcagacgacccacgaccacgttttctttcaggccgcgcaggtaatcgcgcttgccggttaccgctgcttcggtcagtacgcgagtggtctcctggaaggaggccgccgagatgaacgactcagtggacaacgacgccttggtgatacccagcaacacacgagtgaacttggagacaaatttgtcttccgcgcccagacgttcgttttctaccagtacgtgagtcagttccatctggtcgcccttgatgaaactggaatcgccggattcagcgatttcaactttacgcagcatctgacgcaggatggtctcgatgtgcttatcgttgatcttcacgccttgcagacggtaaacgtcctggatctcgttaacgatgtacttggccagcgcactcacacccagcagacgcaggatgtcgtgtggatcgcttgggccgtcggagataacttcgccgcggtttacctgttcgccttcgaacacgttcaggtgacgccacttcggaatcagctcttcatacggatcgctaccgtcgttcggggtaatgaccagacggcgcttgcctttggtctctttaccgaacgcgatggtgccgctgacttcagccagaatcgacgcttctttcggacgacgagcttcgaacaagtcggcaacacgcggcagaccaccggtgatgtcacgggtcttcgaagtttcttgcgggatacgcgcgataacgtcaccgatcgcgatcttcgctccgtccgctacaccgaccagggcgttggctggcaggaagtactgagcaattacgtcagtgcctggcagcaacaagtccttgccgttgtcatcgaccatcttaacggcaggacggatgtccttaccggcagctggacgatctttcgcgtcgagtacttcaatgttggtcataccggtcaattcgtcagtctgacgcttgatcgtgatgccttcttccatgcccacgtaggtcacggtacctttcatttcggtaacgattgggtgagtgtgcggatcccacttggccacgattgcgccagcgtcgaccttgtcaccttctttaaccgaaatcacagcaccgtacggcagcttgtaacgctcacgctcacgaccgtagtcatcagcgattgccagctcaccggaacgggacacagcaaccaggtggccatccactcgctcaacgtgcttcaggttgtgcagacggacagtaccgccattcttaacctgaacgctgtcagctgcggaggtccggcttgccgcaccaccaatgtggaacgtacgcatggtcagctgggtacccggctcaccgatggactgggcagcgataacgccgaccgcttcaccgatgttcacctggtgaccacgagccaagtcacggccgtagcacttggcgcaaatgccgtagcgggtttcgcagctgatcggcgagcgaacaatcacttcgtcgatgctgttgagttcgatgaactcgacccacttctcgtctaccagagtgccggcaggaacgatgatttcctcggtacctggcttgaatacgtcacgggcgattactcgacccagtacgcgctcacccaacggctctacaacgtcgccgccttcgatgtgcggagtcatcagcagaccgtgttcggtgccgcagtcgacttcagtcacaaccaagtcttgcgcaacgtctaccagacgacgagtcaggtaaccggagttagcggttttcaacgcggtatccgccagacctttacgagcaccgtgagtggagatgaagtactgaagtacgctcaaaccttcacggaagttcgcagtaatcggcgtctcgatgatggaaccgtccggcttggccatcaggccacgcataccggcgagctgacggatctgcgcagcagaaccccgtgcgcccgagtcagccatcatgtacatcgagttgaacgactcttgatcgacttctacgccatgacggtcgataaccttctctttcgagaggttagccatcatcgccttcgacacttcgtcgttggccttggaccaaaggtcgatcactttgttgtacttctcgccctgggttaccaggccggaggcgtactggctttcgatctctttcacttcatcggtagcagcaccgatgatctgagctttttcatccgggataacgaagtcgttaacaccgatggaaacgccggaaatagtcgagtaagcaaaaccggtgtacatcaactggtcagcgaagataacggtctctttcaaaccaaccacgcggtagcactggttgatcagcttggagatcgcctttttcttcatcggcaggttgacgacgtcgtacgacagaccttttggcacaacttgatacaacagcgcacggccgacagtggtgtcgacaatacgagtgttggtcacgctgccgccgtcacggtcgttgacggtttcgttgatccgcactttgaccttggcgtgcagtgcggcttcgccggcacggaacacacggtcaacttcttgcaggtcagcgaacacacgaccttcgcccttggcgttgatcgcttcacgggtcatgtagtacagacccaatacaacgtcctgcgacggaacgatgattggctcaccgttggctggcgacagaatgttgttggtcgacatcatcaacgcgcgcgcttccaactgggcttccagtgtcagcggtacgtgcacggccatttggtcgccgtcgaagtcggcgttgtacgcagcacagaccagagggtgcagctggatagccttaccttcgatcagtactggttcaaacgcctggatccccagacggtgaagggtcggtgcacggttgaggagaaccgggtgttcgcggatcacctcagcgagaacgtcccaaacctctggcagttcgcgctcgaccattttcttggccgctttgatggtggtcgcgagaccgcgcatttccagcttgccgaagataaatggcttgaacagctcaagtgccatcttcttgggcagaccgcactggtgcagacgcagggtcgggcctacggtaattaccgaacgaccggagtagtcaacacgcttaccgagcaagttctgacggaaacgaccttgcttacccttgatcatgtcagccaaggatttcagagggcgcttgttggaaccggtgatagcgcggccacgacgaccgttgtcgagcaaggcatcgacagcttcttgcaacatacgcttttcgttgcgcacgatgatgtccggagcggacagatcaagcaggcgcttcaagcggttgttacggttgatcacgcggcggtacaggtcgttgaggtcggacgtcgcgaaacgaccaccgtccaacggtaccagcggacgcaggtctggcggcagaaccggcagaacggtcagcaccatccactctggcaagttgccggaaccctggaaggcttccatcaacttcagacgcttggacagtttcttgattttggtttcggagttggtttgcggaatttcttcacgcagacggccaatctcgtgctccaggtcgatagcgtgcagcagttcacggacagcttcggcacccatgcgggcatcgaaatcgtcgccgaactcttccagcgcttcgaagtactgctcgtcgttcagcagctgacctttttcaagggtggtcatgcctggatcgataacgacatagctctcgaaatagagaacacgctcgatatcacgcagggtcatgtccatcagcaagccgatacgggacggcagcgatttcaggaaccagatgtgggcaaccggcgaagccagttcgatgtgcgccatgcgctcacgacgaactttagccaacgcgacttcaacgccgcacttctcgcagatcacaccacggtgcttcaagcgcttgtacttaccgcacaggcactcgtaatcctttaccgggccaaagatcttggcgcagaacaggccgtcacgctcaggtttgaacgtacggtagttaatggtttccggctttttaacttcaccgaacgaccacgaacggatcatctcaggcgatgccaatccaatacggatggcgtcgaactcttcgacttgaccctggtttttcagcaaattcagtaggtctttcaaggcctttcctcctggcggagcagagagcgggctaaacagccccgctctcgattcgcgtcacgtgttattcggtttccagatcgatatcgatgccgagggaacgaatttctttgatcaacacgttgaaagactcgggcatgcccggctccatacggtgatcgccgtccacgatgtttttgtacatcttggtccgaccgttcacatcgtccgacttcactgtgagcatttcttgcagagtgtaagcagcaccgtatgcttccagtgcccagacctccatctccccgaaacgctgaccaccgaactgagccttaccacccagcggctgctgggtaaccaggctgtacgaaccggtagaacgagcgtgcatcttgtcgtctaccaagtggttcagcttcagcatgtacatgtagccaacagtaaccgggcgctcaaacttgttgccggtacggccgtcgaacagctgcatctggccgctttctggcaggtctgccagtttcagcatggccttgatttcgctttccttggcaccgtcgaacaccggggtagccattggaacgccgccgcgcaggttcttcgccagatccaggatttcctggtcggagaaggtgtccagctcttcgttgcgaccgccgatctcgttgtagatctcgtgcaggaacttacgcaggtctgcgaccttgcgctgctcttcgatcatacggttgatcttctcgcccagacctttggccgcgaggcccaggtgggtttcaaggatctgaccaacgttcatacgcgaaggtacgcccaacgggttgaggacgacgtcgaccggggtgccattggcatcgtgcggcatgtcttcaaccggcatgatcacggagaccacacctttgttaccgtgacgaccggccatcttgtcgcccggctggatgcggcgacggattgccaggtaaaccttgacgattttcagcacgcctggagccaggtcatcgccctgctgcagtttgcgcttcttgtcttcgaacttgtcgtccagcagacggcggcgatcaacgatataggcctgggccttctcgagctgctcgttcagagcatcttcagccatgcgcagtttgaaccactggccgtgctcaagaccgtcgaggatttcgtcggtgatgtcctgacctttcttcagacctgcgccgccttcagccttgtggcctaccagagcggaacgcagacgttcgaaggtcgcgccttcaacgatacggaactcttcgttcaggtccttgcggatctcgtcgagttgggtcttctcgatggacagtgcacgagcatcacgctcaacgccgtcacgggtgaagacctgtacgtcgatgacagtacccttggtaccggtaggtacgcgcagggaggtgtctttaacgtcgctggctttttcaccgaagatggcacgcaacagcttctcttccggagttagttgggtctcgcctttcggagtgaccttaccgaccaggatgtcgcctgcgccaacttcagcacctacgtaaacgataccggcttcgtccagcttgttcagtgcagcttcacccacgttcgggatgtctgcagtgatctcttcaggcccaagcttggtgtcacgtgccacacaggtcagttcctggatgtggatcgtggtgaagcggtcttcttgaacaacacgctcggacaggcagatggagtcttcgaagttgaagccgttccatgccatgaacgcgatgcgcatgttctgacccagagccagctcacccatatcggtggacgggccgtcggccatgatgtcgctacgctgaacgcgatcacccttgctcaccagcggacgctggttgatgcaggtgttctggttcgagcgggtgtatttggtcaggttgtagatgtcgacaccggcttcgccagtttcaacttcgtcatcggcaacacgaaccacgatacggctggcatcaacggagtcgatcacgccgccacgacgagccacgacgcaaacgccggagtcacgggctacgttacgctccatgccggtacctaccagcggcttgtcggcacgcagggtcggtacagcttgacgctgcatgttggaacccatcaacgcacggttggcgtcatcgtgctccaggaacgggatcagcgacgcagcaaccgaaactacctgcttcggcgaaacgtccatcaaggtgacgtcttccggcgccttaacggtgaactcgttcaagtgacgaacagctaccagctcgtcgatcaggactttcttgtcgttcatcgtggccgaagcctgagcgatcacgtgatcagcttcttcgatggcggacaggaacacgatctcgtcggtgaccagagcgtctttcactacacggtacgggctctcgaggaagccgtactggttagtgcgcgcataagcggccagggagttgatcagaccgatgttcggaccttccggcgtttcgatcgggcaaacacgaccgtagtgcgtcgggtgtacgtcacgaacttcaaagcctgcacgctcacgggtcagaccgcccgggcccagtgcggaaacacggcgcttgtgggtgatctcggagagcgggttgttctggtccatgaactgcgagagctggctggaaccgaagaactctttcaccgccgcagccactggcttggcgttgatcaggtcttgcggcatcaggccttcgctttcagccatcgacagacgctctttgaccgcacgctcaacacgtaccaggccaacgcggaactggttctcggccatttcgcctacgcagcgaacacgacggttacccaggtggtcgatgtcatcgacgatgcctttaccgttacggatgtcgaccagagtcttcagtaccgcgacgatgtcttccttgcacaacacgcccgaaccttcgatctcggtacgaccgatacgacggttgaacttcatccggccgaccgcagacaggtcatagcgctcagggctgaagaacaggttgttgaacagggtctcggcagcgtctttggttggcggctcaccaggacgcatcatgcgatagatctcgaccagcgcttccaattggttgctggtggagtcgatcttcagtgtgtcggagatgaacggaccgcagtcgatgtcgttggtgtacagggtctcgatgcgaacaacctgggccttggcgattttcgccaggatctcggtgttcagctcggtgttgcactcagccaggatttcgcctgtagccgggtgaacgatgaccttggcggtggtgcggcccaggacgtagtccaaaggcacgtccagcgacttgataccggctttttcgatctggttgatgtggcgcgcagtaatacggcggccggcttcaacgatgaccttgccattttcatcctggatatccaggacagcaatttcaccacgcagacgcgaagcaatcagttccaggctgagggtttcatccttcaggctgaatacgttggtggtgtagaaagcgtccagcacttgctcagtggtatagccgagcgcgcgcagcagtaccgaggccggcagcttacgacgacggtcgatacgcacgaatacgcagtctttcgggtcgaactcgaagtccaaccacgagccgcggtacggaatgatccgcgcggagtacaggagcttaccggagctgtgcgtcttaccgcggtcgtggtcgaagaacacgcccggggaacggtgcagctgggaaacgataacgcgttcggtaccgttgataacgaaggtaccgttttcagtcatcagtgggatttcgcccatgtagacttcttgctctttgatgtccttgatcgctttgttcgacgattctttgtcgaaaatgatcagacggacttttacccgcaaaggtacggcgtacgtaacaccgcgcaacacgcattctttgacatcaaatgccggttcgcccaggcgataacccacgtactccagcgcagcattgccggagtagctgatgatcgggaaaacggatttgaaggccgcatgcaggcccacgtcgcggaactgatctttagtcgctcccgcttgcaagaattcacgatacgaatccagctggatagccagaaggtacgggacatccatgacgtccggcaacttgctaaagtccttgcggatacgttttttctcagtatatgagtaagccatcagcgttccccagcttggtcacctgcttgtttggcccctcccgacgggagcagccagaaaatctcgcaaaccccatggtttgcaccaccgcatcgggtggctacagcgcgttaatggcggcgaccgagtcgacagccaagaacggaaaaaggccggtggcaagagccaccagccatcagccttcagcttaacgcttgggctggagacgcaaggtcgatgcttacttcagctcgactttagcgcctgcttcttccagcactgctttagctttgtcagcggcgtctttcgacactgcttccagaacctgggcaggagcgccgtcaactacagccttggcttctttcaggcccagaccggtcagttcacgaactgccttgatcacgtttactttcttctcgccagcttccagcagcatgacgttgaattcggtttgctcttcagcagcaacagcagcaacagctgggccagcggaagcagcggcagcggaaacgccgaatttttcttcgaaagctttgatcagctcaacaacctgcagaaccgacatttcagctacggcgttgaggatatcttcttgggagatagacattactgtatttcctgaattgggggacggcctacgcggccatcgaaataaacaaaaatacgcgaaaggaggtgctcagccttaggctgcggcagcttctttttgctcgcgaactgcagccagagtacgagccagcttgctggtagcgccttgaatcacgctcatcagctgcgaaatagcttcgttacgggtcggcagtgttgccagtacgtcgatttggttagctgcgaggaacttgccctcgaacgcagctgccttgatctcgaacttatcctgactcttggcgaattccttgaacaaacgggcagcagcgcctggatgttctttagagaacgcgatcagagtcgggccggtgaacacgtcgttgaggacactgtattcagtgtcagcaacagcgcgcttgagcagggtgttacgtacaactcgtacgtatacgccagcttcacgagcctctttacggagtccggtcatagcgcctactgtcacaccacgggcatcagccacgacagcggacagagcagctttggcagcctcgttgacttcagcgacgatggccttcttgtcttcgagattaattgccacgggttcaactcctgcttgttaccgtttcatctggccgaagccggatgtcgttttggtgtctgattcggtaaggaaccgggagcaccatctgcgtaggcttgtggtttaaggcttgcgccgcctacggtcttggatagcccccgccaggcagggaccccaattttttcgattggcgcgatctctcgcgccaatctgtgtcttatacgtccagcgagccttggtcgatgaccagacctgggcccatagtggtgctcagggtaacgcgcttaacgtagatgcctttcgaggaagctggcttgatacgcttcagatcagcgatcagggcttcaacgttttccttcagcttgacggcgtcgaagccgactttgccaacggaggtatggatgatgccgtttttgtcggtgcgataacgaacctgaccagccttggcgtttttaaccgcggtagctacgtctggagttacggtgccaactttagggttaggcatcagaccacgtggaccgaggatctgacccaactgacctacaacgcgcattgcatccggggaagcaataaccacgtcgtagttcaggtcgccgcctttcatttcggcagccaggtcgtccatgccaacgcgatcggcgccggcggccagagcagcttcagctgccgggccttgggtgaagacagcaacacgtacagtcttgccagtaccgtgtggcagcacagtagcgctacgaacgacctggtcggatttacgtgggtcaacacccaggtttacagcaacgtcaacggactcgctgaacttgacagtcgacagctcggtcagcagggcagcggcgtctacaaagttgtaggccttgcctgcttcgattttgccggcgatagccttttggcgcttggtcagcttagccattacacaccctccacgttaaggcccatgctacgagcagaaccggcgatggtacgcacggctgcatccatatcagctgcagtcagatccgcgtttttggttttcgcgatttcttccagctgagcacgagttacggtgccaaccttaacggtgttaggacgagcggaaccgctagtcagacctgcagccttcttcagcaaaaccgaagccggggtcgacttggtttcgaaagtgaagctacggtcgctgtatacagtgatgatcactggagtcggcagacctggctcaagaccctgagtacgggcgttgaaggccttgcagaattccatgatgttcacgccgtgctgacccagagccgggccgacaggtggacttgggttggcctgagcggccttcacttgcagcttgatgtaagcggtaatcttcttggccatgaggcactccaattacgggttcaaacgcctcgaaaggctccccggttacttgcgcgtttatcccagtgacgacaaaaccccacagcctaaggctgcggggttgggatgcttgctcagctagaccttctcgacctggctgaactccagctctaccggagtagagcgaccgaaaatgagcactgccacttggatccggctcttttcgtagttaacttcttcgacagtaccgttgaaatcagcaaacggaccgtccgtgacacgaacaacctcgcccggctcgaacaacgtcttcggcttaggcttgtcgctaccgtcagcaacacgacgcagaattgcttccgcctctttgtcggtgatcggagcaggcttatcggcagtaccgccaatgaaacccatgacacgaggagtgtccttgaccaagtgccaagtaccttcattcatgtccatctgaaccagcacatagccagggaagaacttgcgttcgcttttacgcttctggccattccgcatttcaaccacttcttcagtgggaaccagaatttcgccgaagccatcttccatgcctgccagctttacgcgctccagcaaagagcgcatcacatgcttctcgtaacccgagtaagcatgcacaacgtaccaacgcttagccacgggacacccttagccaacaatcaaggaaacaagccagccgagcagggaatcaagcccccacaacagcaacgccataaccagaacaacagccacaacaatcaacgtggtctgcgtggtttcttggcgagtcggccaaacgactttacggatttctgtgcgagcttcctttaccagcactgcgaaagacttgcctttggcagtctgcaggcctacaaaggcagctacagcagcaagggcaagcaaagcgagtacgcggtacaggatcggcgaagcagaatagtactgattgccaactacgcctacgactaccaatgcgactacagcaagccacttgactagatcgaaacgagagctttgagcttcagccttaggagtcatctatgaagatcctgtgaaaagaaagccagacacaccacgtgaatctggcaggtcaggagggaatcgaacccccaacctacggttttggagaccgtcgctctgccaattgagctactgacctaaaacaaaatcaggccgaccattatgcaggcctgaaaaagactttacaacaaccaaccccaagagacttgaaatcacccaacatcaacgccaggcacaacaccatcaagacgaggtagctgttaaaacaaaggcagatattttcatatctgccttgttatatggagctcttgagcggatttgaaccgctgacctcacccttaccaagggtgtgctctaccaactgagctacaagagcaaaacaccgtgcacaacctgcaaacttggagcgggtagcgggaatcgaacccgcatcatcagcttggaaggctgaggttctaccactaaactatacccgcggagcttgcagctcacgctaaaaatggtggagggggaaggattcgaaccttcgaagtcgtagacgtcagatttacagtctgatccctttggccgctcgggaacccctcctaagcgagccggcattctacatcacgccggccttctgtcaagcattttctcattaaaaatatgaggttagctgcgttgacgcttgcttcacactgcaggccgtaaaggtcttcactgcgaagcgggcgccattctatgcaaactattcgacagttgcaatgccttcgcacagcattattttatgttttaactcattgaattccttagcaaggttttcaaagggcagatcgtcggccagacgcctgctttcaggggccacacggaaccaatagccggaagcgtcaggcgcattgagctgttgcaccttgacccttatatccaggctcatcagacgctgctcgagcgactgcagttgccgcggatcagcaaagccacctatgtataggcacgtgttttgtggatcaggcgcttttgctcgatcacggcgaactaccggatcagaagattcgctcaacagtcgaatgtcctgctgagagcctcgatatagactcaggggcgtgacgtccttggcgcgcaacggggcctcttgttgatgccagatgtaatagaaggcattgagaacaagcaaaagcaaaaacagccaacgcataaacacctcaggacaaaggacacgccatcgccagacccacaaaaaccaaatccggaacgaagcgagcttgcggtacggcatccgagaccaggtcagcatccccgccggttaggaaaacggtgaagtcatccccccaataacgccgagccagctcgagctgggtcaatacaaaccccctgagcatcagcgtgcaaccacgctccacggcctcaacggtcgttcgcccaggggacagacgctccatggcctgttcggccgcggcatcgtcatagcgaatcttgcgggtgtgcgttcgcaactggctgcgcataaggggcaaccctgggcatatgaagcctccgagatgctcaccatcagcagcgatgaagtccgcagtcgctgccgtgccgaagtcgagcaccaggcaagcacctggtgccaaattgaaaccacccagcatcgctaaccagcgatcaagcccgagacgctcaaactcttcatacccgttgcgcactcccgccatttctcgcgccgggacggcgcaggcaacagtgactccaaagccgccctgtagcgcctcaaccagctttgcggtctcctctgaagcacggacactcaccaaacggcatcgcgtcagcaacaagcccggaattgctttgaggctctcaatcaatgcgagatccgaaccgacaactccttccgcagaggcgctagccgcctccgcctcaagtacacgccacttgataaagctattcccacagtcgagctcaagaatcatcacgcagcctcaggcttaactcaccaccgctatatattttctcgacaccgtcgacgttcagacgcaatgcgccttggtggtcgatccccagtacaacaccgtcaatctggttggcgccggcaatgagagagacagccttgccctgccataaatgatttctctcccactcttcatggagcgcagaaaaaccagaggccttgtgtcgctccaggtggctctgcaactgcaggctcagctgtgcaaccaagtgattgcggtcgaccgcagagcctgtttccaactgtaccgaagtccactgctgatcaacctcagcagcctgctgcatattgacgttaatgcctattccaagaacaacatgacaaatgtcagctggatcccccaccaactcgagcaggatgccagctattttcttttgcccaaccaggacgtcgtttggccatttcaaggcagcactctgtacacctaattcacgcagagcctgcatgaccgccaatcccactacgaggctaagaccttccaactgacgcagcccaccctcgatacgcaataccaggctgtaatagacattctgagcgaatgggctaacccacttgcggcctcgcctcccccttccggccgtttgctgctccgcaagcaccaggaatggcgcggcgtagccggcattgacaaggcgtaaagcttcggcattggtggagtcaatagagtctgaaatgtaaacgggccacgtcaaagaagcagcatttgcttcaatttctgctgcattcaagaagaccaagggggacgcaagctgataccccttaccacgaattttatgaatgggcagattcagttccgcctcaagatgctggagctgcttccaaactgcgctacggctgacacccaaggcgacacccagcgcctctccggaatggaatcggccatctttaagaagttctaacaacgtcagcatgcatgcatcgcctcacaatgaggcacgcatgatagccatgcataaggccattgcatagaaaggtagggatttagcattgcagggagggactccggcgcgcaaaggtgggccaggcatcgcggacaatcgttaacttcaccgcgagcaagcaccacccccgattattttttccgaccgcccaaaacaaaacccctgtttgcgttagcaaacaggggttctggaatttaatcttgacgatgacctactctcacatggggaaaccccacactaccatcggcgatgcatcgtttcactgctgagttcgggatgggatcaggtggttccaatgctctatggtcgtcaagaaattcgggtactgagtcgtgaccaaatggtctcgcttcagcaaattgggtatgtgatagctttcggtgttttgtgagcgtcgaactttcggttcatttcgtcttcacacaccgcaatctgatgctctttcgagtagtcaaattgcttgggtgttatatggtcaagcctcacgggcaattagtattggttagctcaacgcctcacagcgcttacacacccaacctatcaacgtcgtagtcttcgacggcccttcagggaactcaaggttccagtgagatctcatcttgaggctagtttcccgcttagatgctttcagcggttatctattccgaacatagctacccggcaatgccactggcgtgacaaccggaacaccagaggttcgtccactccggtcctctcgtactaggagcagcccctctcaaatctcaaacgtccacggcagatagggaccgaactgtctcacgacgttctaaacccagctcgcgtaccactttaaatggcgaacagccatacccttgggaccggcttcagccccaggatgtgatgagccgacatcgaggtgccaaacaccgccgtcgatatgaactcttgggcggtatcagcctgttatccccggagtaccttttatccgttgagcgatggcccttccatacagaaccaccggatcactaagacctactttcgtacctgctcgacgtgtctgtctcgcagtcaagcgcgcttttgcctttatactctacgaccgatttccgaccggtctgagcgcaccttcgtactcctccgttactctttaggaggagaccgccccagtcaaactacccaccatacactgtcctcgatccggataacggacctgagttagaacctcaaagttgccagggtggtatttcaaggttggctccacgcagactggcgtccacgcttcaaagcctcccacctatcctacacaagcaaattcaaagtccagtgcaaagctatagtaaaggttcacggggtctttccgtctagccgcggatacactgcatcttcacagcgatttcaatttcactgagtctcgggtggagacagcgccgccatcgttacgccattcgtgcaggtcggaacttacccgacaaggaatttcgctaccttaggaccgttatagttacggccgccgtttaccggggcttcgatcaagagcttcgcgttagctaaccccatcaattaaccttccggcaccgggcaggcgtcacaccctatacgtccactttcgtgtttgcagagtgctgtgtttttaataaacagtcgcagcggcctggtatcttcgaccggcatgagcttacggagcaagtccttcaccctcaccggcgcaccttctcccgaagttacggtgccattttgcctagttccttcacccgagttctctcaagcgccttggtattctctacccaaccacctgtgtcggtttggggtacggttcctggttacctgaagcttagaagcttttcttggaagcatggcatcaaccacttcgttaactaaaagttaactcgtcatcagctctcggccttagaatcccggatttacctaagattccagcctaccaccttaaacttggacaaccaacgccaagctggcctagccttctccgtccctccatcgcaataaccagaagtacaggaatattaacctgttttccatcgactacgcttttcagcctcgccttagggaccgactaaccctgcgtcgattaacgttgcgcaggaaaccttggtctttcggcgtgggtgtttttcacacccattgtcgttactcatgtcagcattcgcacttctgatacctccagcaagcttctcaactcaccttcacaggcttacagaacgctcctctaccgcatcacttacgtgatacccgtagcttcggtgtatggtttgagccccgttacatcttccgcgcaggccgactcgactagtgagctattacgctttctttaaagggtggctgcttctaagccaacctcctagctgtctaagccttcccacatcgtttcccacttaaccataactttgggaccttagctgacggtctgggttgtttcccttttcacgacggacgttagcacccgccgtgtgtctcccatgctcggcacttgtaggtattcggagtttgcatcggtttggtaagtcgggatgaccccctagccgaaacagtgctctaccccctacagtgatacatgaggcgctacctaaatagctttcgaggagaaccagctatctccgagcttgattagcctttcactccgatccacaggtcatccgctaacttttcaacggtagtcggttcggtcctccagttagtgttacccaaccttcaacctgcccatggatagatcgcccggtttcgggtctattcccagcgactagacgccctattaagactcgctttcgctacgcctcccctattcggttaagctcgccactgaaaataagtcgctgacccattatacaaaaggtacgcagtcacagaacaaagtctgctcccactgcttgtacgcatacggtttcaggatctatttcactcccctctccggggttcttttcgcctttccctcacggtactagttcactatcggtcagtcagtagtatttagccttggaggatggtccccccatattcagacaaagtttctcgtgctccgtcctactcgatttcatgactaagagattttcgcgtacagggctatcacccactatggccgcactttccagagcgttccgctaatctcaaagccacttaagggctagtccccgttcgctcgccactactaagggaatctcggttgatttcttttcctcagggtacttagatgtttcagttcccctggttcgccccttacacctatgtattcagtgtaaggtaaccatcttatgatggctgggttcccccattcagacatctccggatcaaagtctgtttgccgactccccgaagcttttcgcaggctaccacgtctttcatcgcctctgactgccaaggcatccaccgtatgcgcttcttcacttgaccatataaccccaagcaatctggttatactgtgaagacaacattcgccgaaaattcgaatttctcaactaagagaactcacaaattttaccttagcctgatccgttaccagtgaaagtaacg

SEQ ID NO: 32 - DNA, 197807 bp, Pseudomonas poae FL10F
tttttctccgctttcgaccgagaagatcgaaacgttaatagagccaaacaacaccgctctaccaactccttctgggcctcgatgaactgaagcaactcgccgtcgaattctgcgtaactctttgtttaccaaggagttttccgtttcgactgcgccggaagtggggcgaattatagacagatataattcgccgtcaacacttaatttcaggtttattcggatttgagcgtaatacgcgcaaatgccttcttaccggcctggcagacatgggtcgcgcccagctcgtatataaaggtgcgatcaaccacttcaccatctatacgcacaccaccggagcctagaaggtcccgagcaaccgccgagttcttcaccaagcccgccttattaaggacagcggcaatcggcattgcctcagcagcagtcagctcgatctcaggaagatcgtccggcagctcgccatccttcatacggttaccggccgcacgatgagcactggccgcagcctcctcaccatggaagcgcgcaacgatctcttccgccagcttgatcttcacgtcgcgcgggttggcacccgcctcaacatcagcgcgcagcgcattgatctcatccatcgagcggaagctcaacagctcgaagtaacgccacatcaacgcatcaggaatcgaaaccagcttgccgtacataacacctggcgcttcctggatacccacatagttacccaaggacttggacatcttcttgacgccatccaaaccctccagcaacggcatagtcagaatgcactgtgcctcttgcccgtacgctcgctgcaactcgcgacccatcagcaggttgaacttctgatcagtaccgcccagctcaacgtccgcgcgcagcgccaccgagtcatagccctgcaccagtgggtacaggaactcgtgaatcgcaatcggctgattggtggagtagcgcttgtcaaagtcatcgcgctcaagcatgcgcgccacggtgtactgcgatgtcaggcgaatgaagtccgccggccccatctggtccatccaggtggagttgaacgccacctcggtcttggccgggtcgagaatcttgaacacctgggtcttgtaggtctcggcattatcgagaacctgctcacgagtcagcggcgggcgcgttgcgcttttgccgctcggatcaccgatcatcccggtgaagtcacctataaggaagatgacctgatgccccagctcctggaactggcgcagcttattaataagcacggtatggcccaggtgcagatccggcgccgtcggatcgaagccagccttaatacgcaggggttggccacgcttgagcttttcgatcagctcggcctcgaccaacagttcttccgcaccacgttttatcagcgctagctgctcttcaaccgacttcataacagacccgcaaggctcagattcaaaagggaaccaaccatacaagatcagggactaattacaagttttgccctgcgcacggacaccgttcagcaagcccagcgttcgcgagcttgcgccacagatgatttggttatattttatacagttatttcatcttcatcatgtcattcatcttttccatttcatcttcaaagtcaaaattacttatgaccacagaaccgtctaaagcgccgccgctttacccgaagacccacctgctcgccgcaagtggtatcgccgcccttctcagcctggcactcctggtattcccttccagtgacgtagaagccaaacgaacatccctgagccttgacctggaaagtccagctgaacaactgacacaagatcaagacgctgccgacgcgcaacaagccacaaatgcacctgttgaatcaccgttcgcacagatagaaagcacgcccgaagacaccaagcaagcgactcaagagcagccagccgcagtcgcagccaagaacccgctgcatcgcgaagtgatcgtggccaaaggcgacacgctgtcaacgctgttcgaaaaggtcggattgcctgctgctactgttaatgaggtactggccagcgataaacaagccaagcagttcacccagctcaaacacggccagaagcttgagttcgaattggcgcccaacggccaactcaacaacctgcacagcagcgtcagcgacctcgaaaccatcaccctgaccaagggcgccaaaggcttcgcgttcaaccgcgtcactaccaaaccggtgatgcgctccgcctacgtacacggcgtaatcaatagctcgctgtcacaatcggccgcacgcgccggcttgtcccacagcatgaccatggacatggccagtgtgtttggctacgacatcgacttcgcccaggacattcgccagggcgacgaattcgacgtgatctatgagcagaaagtcgccaacggcaaagtcgtcggcaccggcaatatcctgtccgcacgcttcaccaaccgtggcaagacctataccgccgttcgctacaccaacaaacaaggcaacagcagctactacacggctgacggcaacagcatgcgcaaggcgttcatccgtaccccggtggatttcgcccgcatcagctcgcgcttctcgatgggccgcaagcacccgatcctgaacaagatccgcgcccacaaaggcgtcgactatgcagcgccacgcggcacgccgatcaaagccgccggtgacggcaaggttttgctcgcagggcgccgcggcggctacggcaataccgtgatcatccagcacggcaacacctaccgcacgctgtatggccacatgcaaggcttcgccaaaggcgtgtcgaccggcagcaacgtgaagcaaggccaggtcatcggctatatcggcaccacgggcctgtccaccggcccgcacctgcactatgaattccaggtgaacggcgtacacgtcgatccattgggccagaagttgccgatggcctacccgatcgccaaggccgagcgcgcgcgcttcctgcaacaaagccagccgttgatggcgcgcatggaccaggagcgctccacccttctggcttcggcgaagcgctaaggcatgccgctctatataggtgtgatgtccgggaccagcctcgatggcctggatatcgccctgatcgaacaaggcccggcgatcaacttgatcgccacacactacatcccgatgcctgacagcttgcgcaccgaactgctaagcctgtgcgccagcggcgcggacgaaatcgcccgctctgcaattgcccagcaacagtgggtgacgctcgccgctcaaggtattcatgccttactgcaacaacagaaccttaagccccaggacattcgcgcgattggcagccacgggcagaccatccgccacgagcctgccaggggctttaccgtacagatcggcaacccggcgttgctcaccgaactgacaaacatcaccgtagtcagcgacttccgtagccgcgatgtagccgccggtggccagggcgcgcctttagtacccgcatttcacgaagccttgttcggtgagcgcagcggcaaccgtgctgtgttgaacattggcgggttcagcaacctcagcctgatcgagaccggcaaaccggtagccggcttcgactgcggcccgggcaacgtcttgctggatgcgtggattcaccagcagcgcggcgaacactttgatcgcgacggccagtgggccgccagtggcaaggtcgaggctcaactactcaacgccctgctcagcgaccccttcttcctgaccaaaggcccgaaaagcaccgggcgtgaagtcttcaacctgggatggctgcaaaaccacctcggcagattgccagcgtttcaaccccaggatgtacaagcaaccctgcttgagctgacggcattgaccatcgttgagtccctgcaaaccgcacagtcggcgactgaaacgttattgatctgtggcggtggcgcgcataacgccacgctgatgagccgtctggcggcgcttctgccttccacccaggtcagcagcacggccacccacggcgtcgatccagactgggttgaagccatggccttcgcctggctggcgcattgctgcctcgaaggcattgccgccaaccgccccagcgtcaccggcgcccaggggctgcgggtattaggcgcgatctacccggcctgacgccttcataatccgcagacagcaaaacgccgcttggcctatcaaagccaagcggcgtttttgcatccgttgtcgatcagatcgagaacgaagacccacaaccacaagtcgtggtggcgttagggttcttgatcacgaaacgcgaaccttccagaccttcctggtaatccacctcggcacctgccaggtattggaagctcatcgggtccacgaccaggctgacgccctcgcgctcaacgatggtgtcgtcatcggctacatcttcatcgaaggtaaaaccgtactgaaaccctgaacaaccgccgcccgtaacaaatacgcgcagcttcaagcgatcattaccctcttcatcgaccaggctcttcaccttgtgcgcagcaccgtgggtaaattgcaaagccgtgggggtgaaggactcaacgctcatgctgataatctcccggcgtaccgccgccatatgcgtaatgccgggcattatccgcttctcctagaaaagcggtcaactattgttacggtatatcaatctgcgctgccgccattaaaaacacaaaaggcccgatcaacgggccttttgcacagcgccagccaagccttacggcagcatgcctgcgtgggacaagcccagcttctcatccaggccgaacaggatgttcaagttctgcaccgcctggcccgacgcgcccttgaccaggttatcgatcaccgacagcaccacgaccaagtctccgtcctgtggacgatgtacagcaatccggcatacgttggcaccacgcacgctgcgggtttccgggtggctaccggccggcattacatcgacgaacggttcattggcgtaacgtttttcaaacagttcctgcaggtttaccgaacggtcgacaacagttgcatacagcgtggaatgaatgccacgaatcatcggcgtcagatgcggtacaaacgtcagccccacatccttacccgcagcacgacgcagcccctggcgaatttccggcaagtggcgatgcccttttaccgcgtaggccttcatgctttccgacgtctcggagtacagcgaaccgacagcagcaccacgaccagcaccgctgacgccggacttgcagtcggcgatcaggcgcgaagcatccgcaagacccgcttccagcaacggcaggaaacccagctgcgtcgcggttggatagcaacccggcacggcgatcaggcgtgcttgcttgatctgctcacgattgacttccggcaagccgtacactgcctcttccaacaattcgggtgcgccatgtggctggccgtaccacttggcccactcatcagcgtcctgcagacggaagtcggccgacaggtcgatgaccttggtgccggcggccagcagttccccagccagtgcgtgagctacaccgtgaggcgtggcaaagaacaccacatcacaggcgcccagggtcttgatgtccggcacgctgaacgccaggccatcgtagtggcctcgcaggttcgggtacatatcggccacggccatcccggcctcggatcgggaggtaatgaccaccacctctgcctgcggatgctgagccaacagacgcagcaattcgacaccggtgtaacccgtgccgccgacgataccgaccttgaccataaacctgccctcaacgaacccactggaaagccgtcgataataggggccgtatcgtcctgcgacaaccgtcaacgtgacgtacgggcgcatgagccactactatcttcagttaccgtgaacctgggaataactagaaatgctctatctatggatcaaagccttccacattgtcagcatcgtctgctggtttgccgggctgttctacctgcctcgcctgtttgtctaccacgcgcaaagcgaggacaccgtcagcaaagaacgcttcagcgtcatggagcgcaagctctatcgcggcatcatgggcccggcaatgatcgccagcctgatattcggcggctggctgatctacctcaaccctgccatctttcaatccggcgcatggatccatgccaagctgaccctggtcgtactgctgatcggctaccaccatatgtgcggcgcacaggtaaaacgctttgcccgtggcgaaaacacccgcagccatgtcttttatcgctggttcaatgaagtgccggttctgatattgctggctatcgtaattttggtcgtggtcaaaccgttctaacttcaattacacggggtacctccaatgtcgctgcccgcttctcttgaacaacgtctgcgcctgcccgtcgtggtggcgccgatgttcctgatttccaatccgcaactggtcctggcctgctgccgcaatggcgtagtcgggagtttcccggccctcaaccagcgcgaaagcagtggtttcaaggcctggctggaagaaatcgaagcgggcctggcgcagctggacaaccccgcgccgtatgccgtgaacctgatcgtgcataacagcaacccgcgcctggaagctgacctggcgatctgcgtggaacacaaagtgccgatcgtcattaccagcctgggcgcggtgaaggaactggtggatgccgtgcacagttacggcggcctggtgtttcacgatgtcaccacgcggcgccatgccgaaaaagcggcagaagccggcgtcgatggcctgatcgccgtggctgcaggcgccgggggccatgctggcacctggagcccgttcgcgctgatcgccgagattcgccagttcttcgacaaaaccctgctgttggccggctgcctcaaccatgggcacgaagtcctcgccgcccagttgctgggcgcagacctcgcctatttcggtacgcgctttatcggcaccaccgaaagccatgccccggatgcctataaagagatgctgctcacatcgcgcgccgccgacatcgtgcacactcccgcagtctccggcgtacccgccagcttcatgcgccagagcctggaaaacgccggtttcgaccttgctgccctgcagggcaaaggtgaggtcaacttcggttccaagctcaaaccgttgagcgacgaggccaaggcctggaagactgtatggtcagccggtcaaggcgttggtgagattgatgacttgcccagcgtcgatgaactgattgcgcgcctggatgccgaatatcgcaaggcacgcgagcaggccacccagttacaatggccacgctgacaatcgccgggtctgctgataaaagccgacctgcactccccttcctgatcaagtgacaaggatgcccgcatgagcgacaaccgtttcaagattgtgtttgacggagccttgctcccgggtgtcgaaagcaccaccgccaaactgaacctcgccgagctgttcaagagcgaagtagaggctatcgaaaaactcttcaccggccgcccggttgcgctcaagcgtgacctgtcgcgctccgatgccgacacttacctcgccgcactgaaaaacgccggggtcgacgcacgcatcgagcctgagcagccggtagcgttcagcctggctgaaacgcacgaaacggattcaggcagcaccgacttctcgcgccccgccgcttcgccctatgcgccgccgcgtgcggctgtgggtgaccacactggcgagttctcgacgctcaaggttttcaccatccacgggcgcatcggccgtctgcgttacctcgcctggacgctggtgttgaccatcgccatgctcgttgccgggggcatcatctccaccgcaggcttcgccgtggcaaccgcgtcgccgacggcaggcatcattctcggttcgctgctgggttttgcgttgtttgtggcgattgtctgggtcagcgtgcaaatcggtgtgcagcgtctgcacgacctcgggtggtccggctggctgtacttcctgaacctggtgcccttcgtaaacagtattttcccactcttgctgatggtattgccgggcaataccggcgccaaccagtacggccctccgccaccgcgcaactccacagcggtaaaagtactggctacgttgtggctggcattcattccggtgatgctcgccatcctggtcacgctgggcatgaacggctacctgaatcagctcgaagccaacatggacagcagctacgaaagcagctccatcaacgccgatgacgataccgatcaaagcgtcatcgttgatgaagaagaaggcgcgcaaagtgctgacgacacggccgaacctgtagactctccagaacagtgaagaaacgcccgccgcctgtgatgcctctgtcgcaggcccggcggcgttgcgatggagaaaggcatgacccgttacgctctgatcaccggtgcctccagcggcatcggcctggccttggccgaagcactggcccgtcgcggccgcagcttgattctggtggcccgccagcgtgatcagttggaaagcattgcactcgaattgactcaacgcttcggcgtcgaggtgctgtttcgggcctgcgacctgggcgaaccattgcgtttgtccgggttcctgctggagcttgaagaaggcgagcggcagatcgacctgctggtcaactgcgccggtatcggcaccagcgggccgttcctggcccaggactggatgaccgaacaagacctgattgaggtcaacatcctggccctgacccgcatgtgtcacgccctcggcaatgccatggcgctgcacggtggaggccagattctcaacgtcgcctcggtcgcagcctttcaaccgggcccgtggatgagcagctactacgccagcaaggcgtatgtgctgcacttctccgaaggcctgcgtgaagagctgaagacttgcggcatcaaggtctcggtgctttgccctggcccaacgcgcacggcgttctttggcactgcgcaaatggacacggccaaactcgaccgaagccagcaactgatgagcccggaagaagtcgcgctctacaccgttcgggcgctggaaaaaaacaaagccatcatcattccagggcgacgtaaccgctggctggcattcagcccacgtttcagcccacgctggctgacgcgcaagattgccggcgcgatcaacaaggcctattgcccacgctgaccgcccggctacactcccctgcactttcaccatggagaaacagctgtggatactctgttcaccaagatcatcaaccgggaaataccggcgaagatcatctatgaagatgaccaagtcctcgccttccacgatatcgccccgcaggcgccggtgcattttctggttatcccgaaaaagcccattcgtaccctcaatgacctcaccgaagaagacaaaaccctggctggccatattctgttcaccgcccagcggctggcagtggagctaggctgcgagaagggtttccgcgtggtgatgaactgcaatgaagaaggtggacagaccgtctaccacatccatatgcatgtgctgggtcaacgccagatgaactggccaccgggctgagtcttcgtgggagcttgcgacggcttgccgccggacaggagcaagctccctcgccacaggggcaaattgactcagcgcaaacgcatcaccctctcttgcggtaaactggccgccgagattcttcccggaggtcagcatgactacccaacgtcactactcgccgattgaccgtctgttgctgcaagccgacatggccatgcgcacactgttgccgttcagcggccaaccgtaccgcccatcgcctgccatcgtgcagccggatgcgcaaatgagcgagaccgacacccgccacgtcgccggcctgatgcgcatcaaccataccggtgaagtctgtgcccaggcgctgtaccagggccaggcgctgactgccaagctgccgcaagtgcgcgcggcaatggaacatgcggccgaagaagaaatcgaccacctggcctggtgcgagcaacgcattcgtcagttgggcagccaccccagcgtgctgaacccattgttttacggtttgtcgtttggcatcggcgccgctgccgggttgatcagcgacaaggtcagcctcgggtttgtggccgccacggaacatcaggtgtgcaagcatctggatgaacaccttgagcaactgccggccgaagacgaaaagtctcgcgccattctcgagcagatgcgcattgatgaagaacaccacgcagacagcgcgttggacgccggcggcttccgcttcccggcgccggtcaggtttggcatgagcctgttggccaaggtcatgaccaagagcacctatcggatataagtgcttcgaatctgagccacaaaaaagggcgccatcaaggcgcccttcttttttgccgattggcgatcaacccaactcgatgatttcgtaatcatgggtgatggccacaccggccgcgccgagcatgatcgaagccgagcaatacttctcagccgacagctcgatggcccgcttgacctgggcttccttcagcgcccggcccttcaccacgaaatgcatatggatcttggtgaacaccttggggtcttcagtggcgcgctcggcttccaggaaggcttcgcagctttccacggcctgacgggatttcttcaggatgctgaccacgtcgaaattgctgcaaccgccgacacccagcaggagcatttccatcgggcgtacgcccaggtttcggccaccggcttccggcgggccatccatgaccacaacatggccgctgcccgactcaccgaggaacatggcctcgcccgcccattggatgcgtgccttcatcgcccagactccactgctaaaaaagggtcgccagcttagcacaggcccctgaaacagcagcgccccgcatgaaatcgatcaatgacagcgtttggtcggaaaattccccaatcgaggcagaatgtgtctggtaagctggcgccaattcaatggcgcattgccatcctttgtacagcgtgtatcaatgccgacaccgctggataaaaaaataaatccaaccacaccgtgcagtctttccgggatacaaccatggttgctcttactcccacacccaagatcaagaatctcgacaagctgttgatgcactgccagcgccgacgttacccggccaagcacaacatcatctgcgcgggcgaacgttccgaaacactgtttttcattatcaagggctcggtcaccatcctgattgaggacgaagacggccgcgagatgatcatcgcctacctcaataccggggatttcttcggcgaattggggctgttcgaacaagccggcaaagaacaggagcgcagcgcctgggtgcgcgccaaggtcgagtgtgaagtcgccgaaatcagttacgcgaagtttcgcgaactggcccagcacgatcccgacatcctctacgccctgagcggtcagattgcccagcgcctgcgcgacaccacacgcaaagtcggcgacctggcgttcttcgacgtcaccggccgcgtggcccgttgcctgctggagctgtgcaaacagcctgacgccatgactcacccggatggcatgcagatcaaagtcacgcgccaggaaatcgggcgcattgtcggctgctcacgggaaatggtcggacgcgtgctcaaggacctggaagaacgcaacctggtgcacgtcaaaggcaaaacaatggtggtgttcggtacgcgttaacccggcaggaagccggccagcatttgacggtacaaggcatccaaccggctgatcgcatccggcgcgggaaacgcttcgtgaagcgcgatatggctgtcggcacgtactcgctggtcgaggccacaggcttcattaaaacggttgaccgctgcaatcaatgcctcgcgatcgttatccagcaacaacgcaccgtgcaccaaccccaccgggcggccaccgctctgccgccaacgctgggcggtgccgaccatcttgcggccgttgaggttgacgttgtagcgaccgtcgcagaacgcaccgtcgatttcaccgacggacgcatcgccgcccagctcgatcagcaagtcgcagatcggctggcacaaacgctggtaaccggtttcgatgcggccttgatcgccttcgctgcgcggcggcgcgtacaccagggcgatattgacggtcgcggcagactgcggcaccggctcaccgccggtttcgcgcagcaacaccggccaaccggcatcggctgatacctggctggcggcgtcaaaggcgggtaatcgactcaagcggcgcggcatgaccagtgcttgatcgctgggctgccagaacagtagcccgaattcctgctcacccgcgcaaacggcggccagcaggtcttgctcggcggcgaggcctgcctcgacggtcatcgcgactggcttgatcatcaaacacctgcctatctagataaacaccaaacccactgtgggagcgggcttgtgtgggagccgggcttgcccgcgatgcaagcaactcggtctttcagcccaacccaggtgatgctatcgcaggcaagccagctcccacataaaccagctgccacatcgaccgtattccaaatcagtctaatgtggagccgctaactgccacaccacgctcagggaagaacagacgctgcagttccgcccccgggttctcggcgcgcataaaggtctcgccgaccaggaacgagtacacaccgctgatttccatcagctccacatcggcgcggttgacgatgccactctcggtaatcaccagacggtcgcgcggaatacgcggcaacaggtcgagggtgttttccaggctgacttcgaaggtgtgcaggttacggttattgacgcccaccagcggtgtgtcgagggttttcagtgcacgctccagctcgtcgccgtcgtggacttccaccaacacatccaggccgacgcttttggccacggccgccagctcagccatcttcacgtcatccagtgcggagacgatcagcagcacgcagtcggcgcccagggcacgggcctcaacgatttgatacgggtcgaccatgaaatccttgcggatcaccggcaacttgcacgcggcgcgggcctgttgcaggaacaggtcggaaccctggaagtagtcgatatcagtcagcaccgacaggcaggttgcgccacccttctcatagctggcggcaatctcggccggcacaaagtgctcgcggatcacgcctttgctcggcgaggctttcttgacctcggcgatcacggccgggtgcttgagcttggcctgggcgatcatggccttggcaaaaccacgcggcgcatcggcgatcttcgcttgggcttccagctcggccaggctgacgcgcgcgcggcgctcagcaacttcttcagccttgcgggccaggatcttttccagaacggtcggcacactcatgcttcattctccatcttgaatacagcggtgaatgctcccagctcttcgagcttttcgcgagccagaccggtgtgcaatgcatcatgggccaaggcgacaccttctttaagactataggcgtggtccgccgcgtaaagtgcagcgccagcattcagaacaatcatttctgccgctttctggccgttttccgttttacgacgccccaaggcatcacggatcagttccagcgaagctgccgggctctccaccgacagcccatgcaaactctggcttttcatgccgaggtcttcgggttcgacccaatactcagtgacttggtcattcttcagctctgccacaaaggtcggcgccgccaggctgaattcgtccaggccgtctttggaatgcaccaccagcacgtgcttgctgcccaggcgttgcaagacttcggccaacgggcggcacagcgcctggctgaacacgccgactacctgatgtttcacgccggccggattcgtaagcgggccgagcatgttgaacagggtgcgcaggcccaggtccttgcgcgggccggcagcgtgtttcatcgcgccgtggtgggattgggcaaacatgaagccaatgccgacgctgtcgatgcagcgcgccacttgtaccggcgtcaggttcaggtagataccggccgcctccagcaagtcggcgctgccgcttttgccggaaactgcacggttaccgtgcttggccacggtgcagccggccgccgcgaccacgaaggaggacgccgtcgacacgttgaaaatatttgcaccgtcaccgccggtgccgaccacgtcgaccacgccgtcgagggtcttgagttcgactttatcggccagctcacgcatcaccgacacggcgccgacgatttcgtcgatgctttcgctcttcatgcgcatggccatcatgaacgcgccgatctgcgcgtcgctgcattggccggtcatgatctcgcgcatcacatcgctcatttcagcggtgctcaggtccaggtggccgacgatacggctcagggcagtcttgatatccatggaaagtccttagcgcgtgccgccgctctgcttgagaaagttagcgaacagctcgtagccctgctcggtcaggatcgactcagggtgaaattgtaccccttcgatattcagtgtcttgtggcgcaggcccatgatctcatcgaccgagccgtcttcaagctgggtccaggcggtcagttccaggcactcgggcaaggtctcacgcttgaccaccagcgagtggtagcgagtaaccgtcaccggcagggtgaggccgtggaacaccccgaggtctttatggaacaccgggctggtcttgccatgcatcacttggcgcgcacgcaccacatcaccgccaaaggcctggccaatggactggtggcccaggcacacgcccaggatcggcagcttgccggcgaaatacttgatcgcttccagggacacaccggcttcagttggcgtgcaagggcccggcgaaaccacgatgcgctccgggttcagggcggcgatttcggcgactgtcagttcatcgttgcgcaccaccttgacctcggcaccgagctcgcccaggtactgcacaacgttgtaggtaaaggagtcgtagttatcaatcatcagcaacatgtgggttcaaacctcttgaattcactgatttcaaatgactgccttccaagagcgtggcccgctgccagacgcacgttccggttgccagggttagccggcaaggggcgtcaaacaacgggtgaagaaggcaaatcggtacaggtccggccgggccggcagagaaaaatgtcaggcgcgccaacgccaacgggcgtgtgccttgactactcgcatcaagagtttgctgatgatcaacacggggagggtctcgttcatacgttcaggcacagtaacgtagcctcgccagcggtgcaatatggagcagcaaatacgggggccgcgacagagcctttgtgggaaaaaactgttttcttcgcagaaaaccctcactacattgctaatgtttcgcttccgacacaaaaacaactaaatggacttttgcatgctcagaccaccgtttttcgcgcccctggccggctgcctcctgtcattggcctgtgctcaggcactggcggcgccgtcgccttactcaaccatgatcgtatttggcgacagcctggccgacgccggcacgtttcccgacggttcgtccggcgcgacgctgcgctttaccaaccgcaccgggccgacgttccagggcgactatggcctggtttcctcaaccctgttgggcaccaagctgggcgtcgcgcccaacgacctgaatgcctccacctcgccggttcgcgcggcccaaggtttgcccgacggcaacaactgggcggtcggcggttaccgcaccgacaacatcctcgactccatcacctcggtctccgacgcagcaattccgcccggcaacccgggtggcggcacggtgctgcgcagtcgccagggttatctcccggccaacggcgggcgggccgaccccaacgcgctgtacttcctctcgggtggcggcaatgacttcctgcagggccgcgtgctcagcccaggccaagcggttgcggccggtgggcgcctggcggacagcgcccaagtcctgcaacaagccggcgcgcgctacatcatggtgtggatgctgcccgacctcggcctgacgcccgccattaacggcacaccgctgcaggcatcgagttcggccctgagcaacattttcaaccagtcactggtgcagcgcctgtcgcagatcgacgcgcagatcatcccgctgaatattccgctgctcttgaaggaaaccttcgccgaccctgcgcgctttggcctggccaccgggcagaacctcaccggcacctgtttcagcggtaacagctgcaccgccaacccggtctacggcattggcggcaccaacccggacccgaccaagctgatctacaacgactcggtccaccccaccatcgccgggcaacgcttgatcgccgactacgcctattcactgctcgcggcgccctgggaactgacgctgctgccggaaatggcccaaggcacgttgcgcgcccaccaggatgagctgcgcaaccaatggcaggcggacaacggcaactggcaagcggtcggccaatggcgcgcaattgtcgcgggtggcggccagcacctggatttcgatgaccaaagcagctcagccagcggtgacggcagtggctacaacctgaatatcggcggcagttaccggctcgacgaaaactggcgcctcggcgtagcagccggcctgtatcggcagacgctcgaagccggcgccagcgattcggactacaagctcaacagctacatgggcaccgcgttcgcgcagtatcagcaaaatcactggtgggccgatgccgcgctgaccggcggcaagctggacttcgacagcctcaagcgcaagttcgccctgggcgtcagcgaaggctcggaaaaaggcgacaccgacggctggctctgggccttgagcggccggttgggctatgacatcgccggggccggcagcgactggcacttgtcaccgttcatcagcgccgactacgcgcgggtcgaagtggatggctattcggaaaaggacaaccgctctaccgcgctgacctttgctgatcaacaacgcgactccaagcgcctcggcgtcggcctgcagggcagctaccgggtcacgccgcaaacccaggtgtttggcgaagtggcccacgagcatgagttcgaaaacgacacgcaaaaggtgaagatctcgctcaacagcgtgcaaggcatcgacttcaagctggacggctacacgccacgcagcaattcggaccgtttgagtgtgggtgtcagccataagctgactcaggaactggcgctgcgggcggcgtataacgtgaggaaggatgacaatttgacccagcaaggggtgagtgtgggggtgagcctggatttctgatggagtcttgaaacctacacaaaacaaatgtgggagctggcttgcctgcgatgcagacacctcggtgtatcaggtacacccaggtgatgctatcgcaggcaagccagctcccacagttggatctacatctggcttcagttttgcggggtctgctccgccaacgccaccgcccggaacatcgcacggcgcttgttcagggtttcttcccactcaagcgccggcaccgagtccgccacaatcccgccacccgcctgcacgtgcagctcgccgtccttgatcaccgccgtgcggatcgcaatcgcggtgtccatgttgccgttccaggcaaaatagcccacggcgccgccgtacacaccacgcttgaccggctccagttcgtcgatgatttccatcgcgcgaatcttcggcgcgcccgacaaggtgccggccggcagaatcgcacgcagcgcatccatcgcggtcagcccttctttcagctcgccggtgacattcgacacaatgtgcatcacgttggaataccgctcgatgaccatcttctcggtgagcttcaccgaaccgatctccgagacgcgcccggtgtcgttgcggcccaggtcgatgagcatcaagtgctcggcgatttccttgtcgtcgctcagcaggtcttcttccagcgccaggtcggcctcttcggtcgcgccgcgtgggcgtgtcccggcgatcgggcgcacggtgatcaggttgtcttcaacgcgtaccagcacttccggcgaactgcccaccacgtggaagtcgccgaagttgaagaagtacatgtacggcgtcgggttgaagcaacgcagcgcgcggtacaggtcaatcggcgcggccttgaagtcgatggacatgcgttgcgacggcaccacctgcatgcagtcaccggcgaggatgtattccttgatggtgtcgaccgcccgctcgtagtcatcctgggtaaagctggagcggaacaccgggtcggcggccggcggacggctgaggtccaggccacggcgcggggtgatcggctggcgcagtttttccagcagggcttccagagcggcctggccttgctcgaaggcatcggcctgggctgggtcggcgaggacgatcgcatgcatcttgccggcgaggttgtcgaacaccaccaccgcgtcggagaccatcagcagaatgtccggcacacccagcgggtccgggttcgggcacttgcccaagcgtttttccacgtagcgcacgcagtcgtagccaaagtaacccaccaggccaccgttgaagcgcggcagaccggcgatggtcggcacgttgtagcgcgccttgaaggcttcgacgaaggccagcgggtcttcaacgtcgtggctttcgatctcgacgccatccagcgtgatgctcacgtgatggtcgtgcacgcgcagcacggtgcggcacggcaggccgatgatcgagtaacggccccacttctcgccgccctgcaccgattccagcaggtaggagttgggctcgtcagccagtttcaggtagatcgacagcggcgtatcgaagtcggccagggtttcgcaggccaaggggatacggttatagccggcagcggccaaacgcaggaattcttcgcggatcatgaggtgcctcgtggcttgagggtcaaacagtcaggtgtgcaaacgtgccgcagcgcggccaggatcagtcaggcgcgccaacgccagcgggccagggccttgatgactttcatccagagtttgcgagtgaccaccacgatggcgtttccagaaggggttggttcgatgtcgggcaacgttatctcagcgcccgctcccaagcaaccggggattagcaagcgcaggtcatcaatcaccagcgccggcgactcttcggcaatcggccggccatggttatagccgtagctcaaggccacgcactgcacgccggccgctttcgccgccagtacatcactgcgcgaatcgccgacaaacaacgactgcgaggccgggatattggccatcttcatcacaaagaacagcgctgccgggtcgggctttttctgcggcaaggtatcgccgccgatgatccagcggaaataacggccgatcttcatctgatccagcagcggcgcgacgaagcgctccggcttgttggtgatcagggccatttccacgccctgcttgtgcagccacttgagcgtgtcacgcacgccggggtaaaccacggtcagttcgtggccgtcttcataggcggcgttgaacagttccagggcgtgttcggcttccacttcatcgacaccttcggcatcaatattgttcgccaaagcacggcgcaccagcatctgcacgccgttgccgacccacatgcgcaccgactcgatccccgccggcttgcgccccaacttgagcagcatctggtccaccgctgctgccaggtcgggcaccgaatcgatcaacgtaccgtccagatcgaacatcaccagccgtggcagtttgccggggaacagctgctcaaagccgctcatggacgcgccagcgccagttcggcacgcatcttgtcgatgactgcctggtagtccggggcgttgaagatcgccgaaccggccacaaaggtgtcagcgccagcggcagcgatttcacggatattgttgacgttgacgccaccgtcgatttccagacggatatcccgcccggacgcatcgatcagtgcacgggcttcacgcagcttgttcagggtgccggggatgaacttctgcccgccgaagcctgggttgacgctcatcagcaagaccatgtcgaccttgtccatcacgtactcaagcacgctcaacggcgtggccgggttgaacaccaggcccgccttgcagccgccttcgcggatcagttgcagggtgcggtcgacgtgcagcgtggcttccgggtggaaggtgatgtaggtcgcgccggcctcaatgaagtcaccgacgatacggtccaccgggctgaccatcaggtgcgcatcaatcggcgccgtgatgccgtacttgcgcagcgccgcgcagaccatcgggccgatggtcaggttgggcacatagtggttgtccatgacgtcgaagtgcacgaagtcggcaccggcggccaataccttgtccacttcctcacccaggcgggcgaagtcggcggagagaatcgatggagcgataacgaagggctgcatgacgcaccttttttgagctaaatcacgatggcgcgcattgtatacctcatgctttgctgcgcgcaccgtgacctaactcaacggttagtaagccgcccggtagattttctcgatatccgccgcactgagcttgcgtgggttgttgcgcatcaggcgctcaatgcccgccgcttccgtggccatggccgggattgcgtcctcgggcaccccgaagctgcgcaggcctgccgggatctcgactgcggcacacagtcgcgtcatcgcctcgacggcctggtcggcggcgtcgttgacactcaaccccgtgacattcacgcccatggcctgggcaatgtcctgcatgcgctccacacacgccagcttgttccagtgcatcacgtagggcagcaacagcgcattgctcacgccatgggcgatattgaaacgcccgcccagcgggtacgccaaggcgtgcaccgcgcccaccccggcattgccgaacgccatgccggccatcaggctggcggtggccatgtcgtcgcgggcctgcaggttggccgggttggcgtaggccttgggcagcgccctggcgatcagcttgatcgcgccaatcgccagggcatcggtgatcggcgaggcattcagcgacaggtaggattcgatggcatgcaccaacgcgtccacgccactggcggcggtgacgctgcgcgggcatgtgagggtcatttgcgggctgatcagcgcaacgtccggcagcaggtaatcgctgacgatgccttttttcagttgcgcggccttgtcggagaggatcgccacattggtcacctccgagccggtgccggccgtggtcgggatggcgatcaacggcgggcctttgcgtggcacctggtcgacgccgaacaagtccgccagctcgccgtggtaaccggcataggcggcgacgctcttggcaatgtcgatggcgctgccgccaccgaggccgatcaggccgtcatgcccgccttcgcggtaggcgcgcatgcagtcttcgacgatggcgatttccgggtcgggcagcacgcggtcgaaaatttcataggggcgctcgcccaggtgttccagcgccagcgccacggtgccggatttgaccagcgcggcgtcggtgacgatcagcgggttatccacatccaggcgcgtgagttcaaaggccagctgttcgatggcgccagcgccggtcagcagtttgtgggcgatcttgaatgaggaggtactcatgtgcgcggcctcttattaatgatgggctggcacaagagtagctgggtattttgggttgcctagcattcagggtctgaatggtcaggtgggcccggtcaatgtgggagctggcttgcctgcgatagcatcaactgggtgtcactgaacgaccaggtcgcccgcatcgcaggcaagccagctcccacatttgatccggttcccaccgttacacctgggcggtgcgcaacttttcgctgcgcccacgcaaccattcaagggtcagcaacagcagcaccgagaaggcaatcaacaacgtcgccgccgcagcaatcgtcgggctgaggttttcgcggatgccgctgaacatctgccgaggcagggtcgcttgctcagggccggcgagaaacagcgtcacgaccacttcatcgaacgaggtcgagaaggcaaacagcgccccggaaattacccccggcgcgatcagcggcaaggtcacccggcgaaacgcggtcagcggcgaggcacccaggctggccgccgcgcgcaccaggttatggttaaagccttgcaaggtcgccgacacagtgatgatcacaaacggcacgcccagcaccgcgtgcaccacgatcaacgagaagaagctgttgcccaaccccagcggcgcaaaaaacaggtagctggccacgccaataatcaccaccggcaccaccatcggcgaaatcaccagcgccatcaccagcgctttacctgggaaattgccgcgggtcaggccaatcgccgccagggtgccgaacaccatggccagcaccgtggccgccggggcgacgatgatgctgttcttcagcgcacgcatccattcggccgaggcgaagaagtcctgataccagtgcagcgaaaagccttgcagcgggtacacgaggaaactgccgctgttgaacgacagcgggataatcaccagcaccggcaggatcaggaacagcaggatcaagccgcacaggatccgcaagctgtagaaccacacccgttccaccggtgacatataagggctcagcattgccaattctcctcagctcaggcgcaggcgactggcgcctaccagccggttgtagatcaggtacagcaccaccgtcgccagcagcaacaagccgcccaacgccgtggccatgccccagttgatgctggtgttggtgtagaacgccacgaagtagctgaccatttggtcgttcgggctgccgagcagcgccggggtgatgtagtaaccaatcgccaggatgaacaccagcaggcaaccggcgccgacaccggcataggtttgcgggaaatacacacgccagaaactcgcgaacgggtggcagcccagggaaatcgccgcgcgcatgtaagtgggcgagatgcctttcatcacgctgtagatcggcagaatcatgaacggcaacaggatatgcaccatcgagatgtagaccccggtgcggttaaacaccagctccaggggtttatcgatcaggcccatgcccatcaacgcgctgttgatcagcccgccggattgcagcaacacgatccaggccgccacccgcaccaggatcgaggtccagaacggcagcaacaccagaatcatcagcaggttgcttttgcgcgccggcaggttggccagcaggtaggccaatggatacgccagcagcaggcaaacgaaggtgatcaccagccccatccagaaggtgcgggcgaagatgtccaggtagatcgcctggtccggcgtagccggggccacttcgccgaggtcgtcgatgcggtgatcgaccgccgccaacaggtaatacggcgtgaggctgctggtgttacgccggatcgcctgccagtacgccgggtcgccccagcgttcgtcgaggctttccaacgcggctttataagaggccggcgcgtcggtaaacggcagcgcccgcgcggttttggtcagcaggctacggtagccggccagctccatgttcaagcgtttggacaggtcgcccagggtctggtttttgcgcgcttcgcccaggtcttcactgagcgcctggtacaccggctcgcccggcaaaccacggccgtcccaggtcttgaccgccaccacggtacgcggcaagccgcccaccacttccgggttgccgacgcttttgtagagcagcgcaacaatcggcaccaggaacaccagcagcaaaaacagcaccagcggcgcaatcaaggcctgggccttccagcgattgagccgctcggcacgcgccaggcgctgcttgagggtggggctgggaatggcgataaccatggcaaactccggaacgcttcaaagaattccctgtgggccgggctttttgtgggagctggcttgcctgcgatggcatcacctcggtatcactgaaaaaccgagtcgatcccatcgcaggcaagccagctcccactcaagcctgctttctcagagagggttatgcaggcttacttggcagcccaggaattgaagcgctgctccaactgctcgccgttatccgcccagaagctcacgtcgatctgcacctggttggcgatgttctccggtgtggtcggcatgtctttgagcacatccttggccagcaacggcacggcctgggtattggcggggccgtaggcgatgttttccgagtaggtcttctgctgctgcggctgcaccgagaaggcgatgaacttcttcgccgcttcggcgcggtccttggccaggcctttagggatggcccaggcatcaaagtcgtagatgccgccgttccacaccactttcaggttgctttctttttgcacggcggcgatgcggccgttgtaggccgagctcatcaccacgtcacccgaggccaggtactgcggcggttgtgcaccggcttcccaccattggatcgacggtttgagttcatccagcttcttgaacgcacggtcctggccgtctttaccggccagcactttgtacacgtccttcggcgccacgccgtccgccatcaaggcgaattccagggtgtacttggcgcccttgcgcaggccacgcttgcccgggaatttcttggtgtcccagaaatccgcccaactggtcggtgcagtggtcagcttgtcggcgttgtacgccagcacggtggaccacacaaaaaagcccacgccgcagggctgaatcgcgcccttgacgtagtcggcgccattgccgaacagttttgggtcaagcggctcgaacatgtcttcgtcgcagccacgggacagttccggcgactccacctccaccaggtcccaggacacgctcttggtgtcgaccatggctttgaccttggccatttcaccgttgtactcaccggcgacgatcttgccgttgcccgcgctttcccacggtgcatagaaggccttgacctgggccgccttgttcgcgccgccaaaggacacgaccgtcaggtccgggcctgccatggcctgtgtcgcgcccatcaagccgatgaccagggcggaatatttaagggatctcaacattgttgttctctccacgtgcagggttggtgaagccatggggcgattaattcgcctctagaagtgggtcgagtgcgcgaacgtgctcgacttgccagccaatcggtaccacgtcgccgactgccagggccgggtccagctcggcaatcggttgtttcacaaaaaaatcggccttgccgcagacttccaggcgcacacgcacgtggtcgcccaggtagataaattccgccacccgcccagagaagcggttgacgcaggattggctggagccattgaggctgacgcgctccggtcgcaccgacagagtcaccgggccgccgatctggccgacattcaccgccagtgcctcgaccttttcaccgcgcgccagctccaccacgcaacgctcgccggtgtggctgtgcagccggccattgaggcggttgttctcgccgataaagttggcgacaaaggtgtttttcggctcttcgtacaaggtgcgcggcgcggcgatctgctggatctcgccctggtggaacacggccacacggtcggacatggtcagcgcttcgccctggtcgtgggtcacgtacaccacggtcacgcccaggcgctggtgcaggtgcttgatctccatctgcatgtgttcgcgcagttgcttgtcgagggcgccgaggggttcgtccatcagcaccagctgcggttcgaacaccagcgcccgcgccagcgcaacacgctgctgctggccgccggagagttgcgccgggtaacgctgggcgaaggcattgagctggaccatgctcaatacacgtttgacccgctcgctgacgtcggtcttgctcaagccgcgtaccgacagcgggaaggccaggttctcagccacggtcatgtgcgggaacaacgcgtagttctggaacaccatgccgatgtcgcgcttgtgcggcggcacgttgttgatggaacgcccggccagcaggatttccccggcggtcggcgtctcgaaaccggcgagcatcatcaggctggtggtcttgcccgaaccggacggcccgagcagggtgaggaactcgcccttgcgaatctccaggttgaggtctttgacgatcaggttctcgccgtcgtagctcttctgcacgccacgaaagctgaccagcacatcatttgaatccacctcgctcatacccgcacctttttgttttggactgctgtggaacaagcgtagtccaggcgcgagcccccgaaaatcgggggccaggagagaatcacatcagccggatggaaggtttggggtagggatcgccctacaccgatggcgggcacagaacagtgcggcggcaatcgtcagcgtttgccggcaaagcctatgtcgtaaacagatacgcgcacctggaggagcccggcttgatcgttcccacgctccgcgtgggaatgcagcccaggacgctctgcgtcccaaagcgtgacgcagagcgtcacaagaggcgttaccacgcggagcgtgggaacgatcaatggggttataggagtttgtgttccatggcgtatttcaccagctcggccagggaggtgatatggagtttttgcatcaaccgcgccttgtgggtgctgatggtcttgctgctcagcgccaactgctgggcgatatcgttgacgttggcgccctgggccaaacgctcgaacaccgagaactcgcgctccgacaacaacgaatgcaggggccgcgtatcggtaaggccaacttcaaagaccatgcggtcggccaggtccgggtcgatataacgcccgcccgccgcgaccttgcgaatcgccgtgagcaacagcgccgggtcactgtccttggtcgcatagcccgccgcgccgaccttcagcgcgcgggcggccatttgcgcttcatcgtgcatcgacagcaccagaatcgccggtgggttattcagtgcccggatccgcgcaatcgcttccaggccattcacgccgggcatcgagatatccagcaacaccacctcgcacggcacatggcgcaaggtttccagcaactgttcgccattgctggcctcaccaaccaccaacaggtctttggccaggccgatcaattgcttgatgccttcacggacaatggtgtggtcttcggctaccaatacgcgaatcacaggggcttcctcttatcgttatgcatccaacggcaccgtgacactcaaggtggtgccctcgcccaattcgctgtgcaggctcaatcggccgcccatcatcagcacgcgctcgcgcatacccaccacgccaaaagataccgggcggccctgggcttcgatgaagccgacgccgtcatcgctgatggtcaaccgcagttcggtgccttcaacgctcaacgtcagctcgacagtatgcgcctgggcatggcgcatcacattggtcagcgcctcctgcaggatacggaacaggccgatggccttggcatcgctgagggccggcagattatccgggacttgcaccaggcaagggatttgcgtgcgcgcttcaaaacggcgcgcctgccactcgatggccgagccaatgccggcgtcgagaatcggcgggcgcagcgcggtggccacatcccggaccaactggaacagctgggcgatcaggcgcttcatgctgtgcaagcgctcgttcaggcctgggtccagttgcgcataggccaactcgcacattgaggtttccagcttgagcactgtgagcatctgcccgagctcatcgtgcacttcacgggcgatgcgcgccttttcttcttcgcgcacggtttccaggtgagccgacagctcgcgcaactgtgcttcgctttgcagcaacgccgccacgtaacggcggcgctcggtgacgtcgttgaggtagaccaccaggtattcgccatcggcaaaacgcagaaaactcaatgacacatcagccggcaggatgctgccgtcggcgcgcacgcaatcggtggcgaaggtttgcgggccgtcctcgctggcacgcgcgcgtttccacacattgagccagcggtccatgttcaaggtcgggtcaacctcgatcagcggtcgctcgatcaatgcgccagggccatagcccaacatggtttcggcagcacggttggcgtaacgcacatggctgtcccaattgacccacaggatgccgaccgtactctggtcgatagagaactgcgtcagccgcaatgcttcggcaccggcggcgcgggcggcactttcttcgcgggccgccagcaggccgtgttccaggctgcgttgctgacggcgctgccaaaacaccaccgccaggctggcgagcaagaacatcgccaagagcaggctgaggttttgccacaagcccggagattcgctcagccgtgggtatttgggttgcagccagcgactgtgcagttgatcgaggtcgcgggcgggtatcgcgcgcaaggcgctttgcatgatgctcgccagttccggccactcacgacgggtggccacgcgcagcaattgcggcaagccgatatcaccgaccaccgccagcccggcaaactcggcctcaccggacaagcggctcaactgcgcctcatccaccacggcataacgcgcttgctggctcaccaacaattgcagggcctgacgctccatgggcacgccttgcaggttgaggttgggatagttactgcgcaggtaatcggcgaccacgctgggcatgcgcacggccacgcgcgacaactcatcgagtttttccagctccaccgcgccgccgccttcgcggatcccgacgatatgctggggcacgcgcatataagggtcggtgaacagccacaggcgcaagccggccggggtttgttgcaggcccggggcgatatccacctcgccgtcgcgcacggcggcttccaactgctcctggctggggaagttgcgccaggtcagctcgatattcagcgccttcgccagccactgcatcaactccacattggccccggacaagcgctgcaggcgccgatcgtattgcgcgtacggcgcttgcagcaccagccccacacgcaattgcgggtgctgggccagccactcacgctgttgcgcatcgagttgcgcctgcggtgcggcaggcgcaggcgcggcattcgccatcaaggcaaagcacagacagccgataaccagcagacagcgaaaacccatgatccacgtctcacatcactgacaaatactgaccaacccattaggctgctggaatcacttctggccgggaattaacgatgccctttatccaccgttcggcactgccagcattgtgcctgtcgctgctatttaccagcgccttttctgttcaggccgccgacgcccccgcgcccgccgccgaaaaaccggttgaacgccaaccgctgcccgagcgcagccaggaagaagccagcgcccttgagcggcaaattccgcagcaggagcagcagcaactgcaggccggcagcgactccttcctggccttgtggaaaccggccaacagcgccgagcccgaaggcgtggtgattattgtgccgggcgccggcgaaagtgctgactggccgcaagcaatcgccccgctgcgacgcaaattgcctgacgccaactggggcacgctgagcctgtcgctgccggacgtaaacgtcgacaccttgccaccgcgcgttatggagtcgcctaaagccgccgtcgacaccagcagcaaggacggcagcaccgccgccaaaccgattgagcaagccgccagcgccgaagccgaaggcaccgacccggcagtggtgccaggcgccgacgagcaggacaagaccgacgccaagcgcattttcgaccgcatcgacgccgccgtcgccttcgcccaaacccaaagcgcacgcagcgtggtgctgctcggccatggcacgggcgcctggtgggccgcacgttacttgagcgagaaacaaccgtcccaggtgcagaagtttgtaatggtggccggcaagacaccggcagcacggcaacccgacctgcaacaactggccccggcgctgaaagtgccaacggcggatgtcttctaccaagacggtgccctggagcgcaaaaacgcactggctcgggtccaggccgccaagcgtggcaagaatgagggctataagcaggtgtcactcaagactgtgcccggcaacagttcggctgagcaggagcagttgtaccggcgggttcgcgggtggttgagcccgcaggctgctgctgagtaaccttgagcggataacccaatcaactgtgggagctggcttgcctgcgatagcgggctgtcagtgacaactgtttagctgacacaccgctatcgcaggcaagccagctcccacactaatggagttggcaactcagaatttgtgatggctagcgaaagtcccgccgctcgcgaatcaacgcgtaggcgttatgcagctcgcgggttcgctcggtcgcctcgcgcacttgggaggggctggcacccgtgccggctattttgtccgggtgatggcggctgagcaggcggcgataggcgcgtttgatcacggtcggctcggtggtcgacgttacccccagaacccgcatcgcgtcctgataggctccgccgcgcgtggccaatggcttgcgttcctgcacgtaatcggccgccagcgcctgcagctgttgtggcgtccagccgagccacttgccccacaggtcgatcaagtcgcgttcggcgtgatccgctttgccatctgcccaggccatgcgccaacacgcacgcaacacaccttccgccgcatggggctgagccttgagcacacgcagataagtgcgcacccggtcggaaccggatttaccccgattgaatgcggtaattgcccggcgctgggcggactcggtcatgtccagtgaacgcatttcctggcgcgcctgttggatatgcccgtccaccacccgaccattactcttggccaggcgccccaacaacacgaacaacaattcatcgttgcgcagcgccgggcgaccgcccaggcgctcgcgcaactgcgcccagctttgcagttgaagacggcgatccaacgcctgccccagcaatgcgcccaacaaggcccccggaatactggcaatggcaaagccagccccggcaccaatcagtgtccctggccacaacatcttattgctccgcagtcagcaaggtttcgacctgcgccaggcgctccagcgtgccgacatcaatccagcgtcccgccatgtgttcccccgttaccagacctttggccatggccgcccgcaacagcggcgccagcttgaaggcaccggcactgcaacccgcgaacaattgcgggtcgagcactgaaatgccactgaaggtcaggttatcggcaccgggcgctgcatcatgaagcaacccttggtccaggtagaaatcgccgcctgaagggtgatgcgccgggttatcgaccatcaccagatgggccaggccttgaagcggccggcgcagctgggtgaagtcgtagtcggtccagatatcgccattgaccaccaggaacggtgcgtcgcccagcaacggcaaggcctggaagatgccgccgccggtttccaacggttcgccttcggccgaatactgaatacgcaggccaaactgcgcaccgtcgcccaggtagctttcgatctgctggccgagccacgcatggttgatcacgatttcgctgaaaccggccttggccagcgcttcaaggtgatactcgatcagccgcttgccgcccgcctgcaccagcggcttgggcgtgtgcagcgtgagcggacgcatccgctcgcccttgcccgccgccaggatcatggccttcatacgcccgcctcgacgggttcgcccaagctggcaaacagttcgcccagctcagccaactcagggcggtctgccagcactgcttctatataagcaaagaagcgcggaacgtcggccaggtagcgtggtttgccgtcgcgatggcagatgcgcgcgaaaatgccgatgaccttgaggtgacgctgcacgcccatcaggtcactggcacgctggaactcttcaaaatctgcctgcacgggaatgcccagttgcccggcacgttcccaatagccacgttgccactcgcgtacgcgcgctttcggccagctgagaaaggcgtccttgaacaggcaggtgatgtcgtaggtgaccgggccgtagaccgcgtcctggaaatccagcacgccagggttcggttcgctgatcatcaggttgcgcggcatatagtcgcgatgcaccaacactttaggctgggccagggcgctgtcgatcaagtgatcgctgacgcgctgccacatagcctgctgctgtgcatcaaactcgatacccaaatgccggcgaacgtaccattccggaaacagttccagctcacggcgcagcaatgcgacgtcatagctgggcagcggcgcgtccatcggtaattgctgaaaagccagtagcgcatcgatggcatcggcaaacaattggtcggcgttttgctcgtcaatcacgtccagataggtttttctgcccaggtcattaagcaaaagaaagccgcgcggcaaatcttctgcataaatttttggcacatttattcctgatttcgcgagtaaatcagcgatatcgacgaaaggtttgcagttttcctgggggggtggcgcgtccattacgacgaaggttcgaccaccgccctcccatcggaaataacgcctgaaactcgcgtcgctgctggctgcggtcaatgtggccggtggtacggcaccccagtcctgagcgttgaaaaggatcggcaactgctcatccagccagactttcagctgttgtaaacgtagatcttgctcgggcattacaagggtctccgacggcgctagccgtcaagcgggtcatgctttattatcacgcatctttttcagaccatcgagaggcgtgcggcccaaaccgcgggcagatggcacgcaggaagcccggactaataagatggcattgaaatcccccgcgtttcgtagaaaatttccgttgctggtaaccggcagtctgctggccatgcaacctttcgccacctcattcgtggtcgccgcggaacagtatgactgctcagtctctgcttcgggtgcctgggattgcgcgccaaaaacggccgcagccccgttgccaccacgcccggtgcatgacggcgcagccgtcagctcggccaacagcacggcgcaagccgaggctggcggcagcgccgaggctgaaccgaagaccgcgctggtcaccgaagccaagggccggggcctgcgtgcgcgcagcgccgactacagccacctggactgggtgcctcgcgagaagctgaccgcagcccagctggccgaaaccggtccttattgctccggtgcgtacatcgagccgatgcgtcctggcatgaacgacaagacgaacaagagcgatgcgccgacctttatcggtgccaaggcctctcgttacgagcaggagcagcaagtggcaaccctggccggtgacgtcgtcatgcgccagggcagcatgcagctggaggctcaggaagccagcctgtatcaggccgagaaccgtggcgagctgaacggcgacgtccgtctgcgcgacaacggcgccctgatcgtgggcgaccatgcccaggtccagctcgacaccggcgccgcccagatcgacaacgccgaatacgtgctgcacaagtcgcgtatccgcggtaacgcgctgtacgccaagcgtgccgaaaacgcgatcatccgtctcaaggacggtacgtacaccacctgcgagccggacagcaacgcctggcagctcaaaggcaacaacatcacgttgaacccggccaccggtttcggtacggcgaccaacgcgacgttgcggatcaagaacattccgattctgtacaccccgtatatctatttcccgatcgacgaccgtcgtcaatccggcttcctgccgccgagcttcagcaccggcagcgaaaccggcttcacgctcgttacgccgtactacttcaacctggcaccgaactacgacgccacgttgtatccgcagtacatgaccaagcgcggtttgttgatggaaggcgaattccgctacctcaccaaatccagcgaaggccagttcggcggcgcgtacctgaacgacgacagcgacgagcggaaaaaacagaccgactacgaaaaaactcgctacatgctcaactggcagcataagggcgggctggattcgcgtctgtcgacccaggtcgattacaccaagatcagcgatccttactactatcaggacctgaagtcctaccaggaaggcatcaagactcaggacttcgtcaaccagcagggttccgtgacctatcgcggcgacagctaccaggctcgtttgaacctgcaggcataccaactggcgacgatttcccagatcaccccgtataacaggctgccgcagatcaccttcaacgggatgctgccgtaccatccgggtggcttgaacttcagctatgaaacagaagctgtgcgctttgatcgggaccttgaaaacggtacgtttaccgatgaaaacggcctcgtgtcgccgcgtttggacacctacgtaaccggcctgacccgtgcaaacggcactcgcctgaacgttgctccagccgtcgaatacccgatgaactggacctacggcttcattacgccgaagctcaagtatgtctacaccaagtacgaccttgatctggacagcatcggcaagaaccaaattatcgcgcaacaagcggcggcgacagcggccaacccttacgccggcggcaccttcaaaagctctcaagaccgtgcgattccggttgccagcgtagacagcggcctgtacttcgaccgcgacaccaactggttcggcaaagactatcgccagaccctggaaccgcgtgcctactacctctatgtcccgaacaaggaccagagcgatatcccggtattcgactccagcgaatactcgttcagctatgcctcgctgttccgcgacaaccgcttcagcggcaacgaccggatcggcgacgagaacaagctgtccctgggcgtgaccagccgctggatcgaagagaacggtttcgaacgtcaacgcgtgtccgtgggccaggcgctgtacttcaaggatcgccaggttcaactgccaggtatcctggcttccgaccgcgccgacgcaaataccgatgtgtcgccgatcgcactggactacgagttccgcttcaaccgtgattggcgcgccactgccgattacaactgggacaccgaaagccacagccctcgctccggcagcgcgatgttccactaccagccggaagataaccccaacaaggttgtcaacctcggttaccgctatcgcaacgaccaggtggtgtacaaccagctgaccggcaaatggcagttcggtggcgactacggcaccccgggccaagcgaacttcgtgaaggattactacaaaatccagcaacacgacttctcgatgatgtggccgatcattcctcagtggaacctgatcacccgctggcagtatgactatgcccgcaaccgtaccctggaagccttcggtggtttcgagtacgacaactgctgctggaaactgcgcgtcatcaaccgttactgggtttccaacgacgaatacagccagatcgccccgcttaacgaaaagggtgaccacgggctcttcttccagatcgtcctcaaaggactcggcggcctgaccggcgccaaggtagagagcttcctcgacaaaggcattgaaggttatcgtgaacgtgaagaccaagctttctgattgcttgcgcccgctagtgctgggcgcgctgttcctgggaaccgtatcggcacacgctgcggttcaacagctggacaaggtagtggccatcgtcgataacgacgtgatcatgcagagccaactggaccaacgggtcaaggaagttcagcaaaccatcgccaagcgtggtggcggcgtgccgcctaccagcgtgctggacccacaggtgctggaacgcctgatcgttgaaaacctgcaactgcagatcggcgatcgttccggcatccgtatctcggacgaagagctgaaccaggctgtaggcaccatcgctcagcgcaacaacatgagcattgaccagttccgcgccgctctggctcacgacggtttgtcctatgaggacgcacgtgaccagatccgccgcgaaatgatcatcagccgtgtgcgtcagcgccgtgtggccgagcgagttcaggtgtccgagcaggaagtgaagaacttcctggcgtcggacctgggcaagatgcagctttctgaagaactgcacctggccaacatcctgatcccgacaccggacagcgccaacgccgagcagctcaatgcagccgccgcaaaaacccaggccgtgtatgaccgcctgaaagccggtgctgactttgcccagacggcgattgccgtatcgggtagcgacaacgccctggacggcggtgacatgggctggcgtaaagccgcgcaattgccacctccgtttgaccgtgaactgagcgccatgcagccaggtgaaatcacccagccagcacgcacgccaggcggtttcatcattctcaagttgctgggtaaacgcggcggcgagacctcgctgaaagacgaagtgcatgttcgtcacatcctggtcaaaccaagcgaaatccgtaccgaggcgcaaaccaaggaactggcccagaagatctacgaccgcatcgaaggcggtgaagacttcgccaccctggccaagagcttctcggaagacccaggttcggccctcaacggtggcgacctgaactggatcgacccgaaagccttggtgcctgagttccagcaagtgatggccgatacgccgcaaggcgttctgtccaagccgttcaagacccaatatggctggcatgtactggaagtccttggccgtcgcgccaccgacaacaccactcaggcccgtgagcaacaagcactgaccgtgttgcgtaaccgcaaatacgatgaagagctgcagacctggttgcgtcagatccgtgacgaagcctacgtagaaatcaagctgccaggcgccgagcaaacaggcaccgaccaggcagcacagtgaaaccccagcgtttcgcggtaacacccggcgagccggccggcattggtccagacctgtgcctgctgctcgcctcgcaccctcagccacaccccctgattgccattaccagccgcgacctgctccttgagcgggccgcgcagctgggtgtggctgtcactttgctggacgtggcgccgggcaactggcccgacctgccggcacctgcgggcagcctgtacgtttgggacacgccgcttgcagccaaggtggttgccgggcaactgaacaaggccaatgcggcatttgtgctggaaaccctgacgcgcgccggtcaaggctgcatcgacggcgacttcgccggcatgatcaccgccccggtacacaaaggcgtgatcaacgaatccggtatcgccttttccgggcataccgaattcctcgccgagctgacccacaccgcccaagtcgtgatgatgctggccacacgcggcctgcgcgtggccctggtgaccacgcacctgccgttgcgcgatatcgccgacgccatcaccgccgagcgcgtggagcgcgttacacggatcctgcacagcgacctgcaacagaaattcggcatcgctcagccgcgcatcctggtctgcgggcttaacccgcacgccggtgaaggcggccatttgggccatgaagaaatcgacattattgaaccgacattagagcgcctgcgccaagaaggcatggacctgcgtggcccactgcctgccgacactctgtttacccccaagtatctggagcactgcgacgcagtgctggcgatgtaccatgaccaggggctgcccgtgctgaaatacaaaggctttggcgccgcagtcaacgtgacactgggcctgccgatcatccgtacctccgtcgaccatggcacagccctggacctggcgggcagcggcaagatcgataccggcagcctgcacgtggccctggaaaccgcctatcagatggccgagacccgtatatgactgagcattaccaacaccgggcgcgcaagcgcttcgggcaaaacttcctgcacgacgctggcgtcatcgaccgtatcctgcgctccatccacgccaagcccgaagaccgcctgctggaaatcggcccgggccagggcgccttgacccaaggcctgttggccagtggcgggcagctcgacgtggtggagctggacaaggacctgatcccgatcctcaaccagcagttcgccgacaagcccaatttcaacctgcaccagggcgatgcgctgaagttcgacttcaacagcctcaatgccgcgcccaacagcctgcgggttgtgggcaacctgccttacaacatctccacgccgctgatttttcacctgctgaacaacgccgggatcatccgcgacatgcacttcatgctgcaaaaagaggtggttgagcgtttggcggcgggccctggcggaggtgattggggccgtctgtcgatcatggttcagtaccattgccgtgtagagcacctgttcaacgtcggccctggggctttcaacccgccgccgaaagtcgactcggccatcgtgcgcctggtgcctcacgccgtgctgccgcacccggccaaggatcacaagctgctggagcgtgtggtgcgtgaagcgttcaaccaacgccgcaagaccctgcgcaacacgctcaaggccttgctgagcaacgccgaaatcgaggccgccggcgtcgatggcagcctgcgccccgagcaactggacctggctgcgttcgtgcgcctggctgaccagctcgccatccagcctgcgccgaccgcggaataagcggcactgtgggagcgggcttgcccgcgatggcggtggctcagccaaacatgcagtgactgacacactgcattcgcgggcaagcccgctcccacatttgtcctgcgtcgtactgaaagctctcgtcaggccgttgctctctaaaggccagacagcatgtctggcctagtgccctgttgatggcctagactgacccgcatctgctgtcctccgcttttgcttttaaggcctcttgcatgtccgatcctcgctaccagatcgacgtcagcgtcgtcacccgcttcctcgcggaccaatcgcaacccgaacacaaccgtttcgcctttgcctacaccatcacggtgaagaacaacgggcagttgccggccacactgctgtcgcgccactgggtaatcaccgatggcgacggccaggtcgaggaagtccgcggtgccggtgtggtcggccagcaaccgttgatcgacattggcgccagccatacctacagcagcggcaccgtgatgacctccaaggtcggcaccatgcaaggctcgtatcagatgaaagccactgacggcaaactgttcgacgccatcatcgcgcctttccgtctcgcagtgcctggagccctgcactgatggcgacgtacgcggtcggcgacctgcaaggctgcctggcgcccctcaagtgtttgctcgatcacgtggctttcaacccggccagcgaccgcctgtggttggtgggtgacctggtcaatcgtggtcccgagtccctcgaaacactgcgctttctttataagatgcgcgactcgttggtgtgtgtgctgggcaaccatgacctgcacctgctggccgccagcaacaacattgagcgcctgaaaaagggcgataccctgcgcgaaattctcgaagcgccagatcgcgccgagctgctggagtggttgcgtcggcagaaactcatgcattacgacgaaggccgcaatatggccctggtgcatgctggcatcccgccgcagtggacgctgaagaaagccctcaagtgtgccgccgaagtcgagagcgccctggccgatgacaacctgtacaccgccttcctcgacggcatgtacggcaacgagccggtcaagtgggacaacgatcttaccggtgtcgcccgcctgcgcgtgattaccaactacttcacccgcatgcgtttctgcaccgccgaaggcaagctcgacctcaagagcaaggaaggcgccgacaccgcgctgcccggctacaagccctggttcgcgcacaaggaacgcaagacccgtgacacaaagatcatctttggccactgggcagcccttgaaggcaagtgcgaagaacccggcgtgtttgccctcgacaccggttgcgtgtggggcggcgccatgaccctgatgaacatcgacaccggcgagcgcctgagctgccagtgcgaatctacccttcccgttacactgccggccgccaagccataggagcccgccatgagcgaattcaaacgtatcccccctgaagaagccctggccctgcgcaagcaaggtgccgtggtcgtcgacatccgcgatcagcagacctatgcaaacgctcacatcagtggcgcgcagcatttggacaaccacaacattgccgacttcatccgcgccgccgacctcgacgcgccggtgatcgtggcctgctatcacggcaactccagccagagcgcggccgcctatctgatcagccagggtttctccgacgtctatagcctggacggcggctttgagctgtggcgttcgatctatccgtcagaaattgcctcaagcgattcgcaataatttttttcacaccccgctaccccgcgtgatgcttgggctcgcgccgtttctgacgaacggcgcagccaaactaattacgtatcccgccttgacctcccggattccgaactatccttaagcgcaggccatccgaatcaggggagagccggtacaccggcgtgcgggtcatcggtagcgtttcagggtgtttggggggaaaacggccattggttgatcaccaatgactgccagcatcgactgattgacccggcgtcggctccacgtatcgagcgaggtgacgacgtcatgagtatctttagccacttccaacaacgcttcgcgtccactcagcaggaagaactcacgctgcaagagtatctcgagctgtgcaaacaggaccgcagtacctacgcgtctgccgccgaacgtctgctattggcgattggtgagccggagctggtggaaaccgccaataattcgcgcctgtcgcgaatattctccaacaaggtgatccgccgctacccggcctttgaagacttccacggcatggaagaatgcattgaccagatcgtctcctacttccgccatgccgcccaaggcctggaagagaagaaacaaatcctttacctgctcggccccgtcggcggtggtaaatcgtccctggccgaaaagctcaaacaactgatcgagaaggtgcccttctacgcgatcaagggctcaccggtcttcgagtcgccattgggcctgttcaacgccacggaagatggcgcgatcctcgaagaagacttcggcatcccacggcgctacctcaacaccatcatgtcgccatgggccaccaagcgcctggccgagtttggcggcgatatcagccagttccgcgtggtgaaactctacccgtcgattcttaaccagatcggcgtggccaaaaccgaaccgggtgacgagaacaaccaggacatctcggcattggtgggtaaggtcgatatccgcaaacttgaggaattcccgcagaacgacgccgacgcctacagctactcaggcgcgctgtgccgggccaaccagggcctgatggagttcgtggagatgttcaaggcaccgatcaaggtgctgcacccactgcttaccgccacccaggaaggtaactacaacagtaccgaaggcctgggcgcgattccgttcaccgggatcctgctggcccactccaacgaatcggagtggcacaccttccgcaacaacaagaacaacgaagccttcatcgaccggatctacatcgtcaaggtgccgtactgcctgcgggtcagcgatgagataaagatctacgacaagctgctgttcaacagctccctggccaaggcccattgcgcgcctgacaccttgaagatgctcgcccagttcaccgtgctgtcgcgcctcaaggagccggagaactcaaacatttactcgaagatgcgcgtctacgacggcgaaaacctcaaggacaccgaccccaaggccaagtcgatccaggaataccgcgacaccgcaggcgtggacgagggcatgaacggcctgtccacccggtttgcgttcaagatcctctccaaggtcttcaacttcgacccgcacgaaatcgccgccaacccggtgcacctgctgtatgtgctggaacagcagatcgagcaggaacagttccaggccgaaacccgcgagcgctacctgcgcttcctcaaggaatacctggcaccgcgctacatcgagtttatcggcaaggaaatccagaccgcgtacctggagtcctacagcgagtacggccagaacattttcgaccgctacgtgctgtacgccgacttctggattcaggaccaggaataccgcgacccggaaaccggcgaaatcctcaaccgcgtggccctcaacgaggagctggagaaaatcgaaaaaccggccggcatcagcaatccgaaggatttccgcaacgaaatcgtcaacttcgtgctgcgcgcccgcgccaacaacaacggcaagaaccccacctggctcagctacgagaagctgcgggtggtcatcgagaagaaaatgttctccaacaccgaggatctgctgccggtcatcagcttcaacgccaaggccagcaaggaggatcagcaaaaacacaacgacttcgttactcgaatggtcgagcgtggctacaccgacaaacaggtacgcctgctctccgagtggtacctgcgggttcgtaaatcacagtaaggcagcgacaggcgtttgctgccgggccctgggcctggcagctgaccgcttgtctctaggcttcaagctcgcggcttgaagcttgtaatgtgaagctgcccggagggctccccatgagctatgtgattgaccgacgcctcaatggcaagaacaagagcacggtaaaccgtcagcgtttcctacggcgttaccgtgaccacatcaaaaaggccgttgaagaggccgtcagccgccgttccatcaccgacatggaacatggcgagcaaatcagcattcccggacgtgacatcgacgaaccggttctgcaccacgggcgtggtggcaagcagaccgtcgtgcaccccggcaacaaggaattcaccaccggcgaacatatccagcgcccccaaggcggtggcggcggtaaaggcccaggcaaggcgggcaattccggcgagggcatggatgagttcgtgttccagatcacccaggaagaattcctcgagttcatgttcgaggacctggaactgcccaacctggtcaaacgcaacctgaccggcaccgacaccttcaagaccgtacgcgcagggatcagcaacgagggcaacccgtcgcggatcaatatcatccgtaccctgcgctcggcccatgcccggcgtatcgccctgtcgggcagcagccgcgccaaactgaagcaagccaaggaagagttggcgcgcttaaaacgcgaagagccggacaacttcggcgatatccaggaaatcgagacggaaatcgagaaactcagcgcacgcattcaccgcgtgccgttcctcgacaccttcgacttgaaatacaacttgctggtcaagcaacccaacccaagctccaaggccgtgatgttctgcctgatggacgtgtccggctcgatgacccaggcgaccaaggacatcgccaagcgcttcttcatcttgctgtacctgtttctgaagcgaaactacgacaagatcgatgtggtattcatccgccatcacaccagcgcccgggaagtggacgaagaggagttcttctactcgcgggaaaccggcggcaccatcgtctccagcgccttgaagctgatgcaggagatcatggccgagcgctacccggccaatgaatggaacatttacgcagcccaggcttccgacggcgacaactggaatgatgattcgcccatctgccgcgacatcctgatcaaccagatcatgccgttcgtgcagtactacacctacgtcgaaattaccccccgtgagcaccaggccctgtggttcgaatatgagcgtatcggcgaagcgtttgccgacaccttcgcccagcagcaactggtctcggccggcgatatctatccggtcttccgtgaactcttccagcgcaggttagtgacatgaccgccaaaaaagagcataagcgccaacccatttccaccggctccgagtggacctttgaactgatccaggcctatgaccgggaaatcagccgtatcgcggcgggttatgccctggacacctaccccaaccagatcgaagtgatcaccgccgaacagatgatggatgcctacgcctcggtcggcatgcccctgggctatcaccattggtcctacggcaaacacttcctcagcactgagaagtcctacacccgtggccagatgggcctggcctacgagatcgtcatcaactccgacccgtgcattgcctacttgatggaggaaaacaccatctgcatgcaggcgctggtggtggcgcatgcctgctacgggcacaacagcttcttcaagggtaattacctgttccgcacctggacggatgccagctcgatcatcgattacctggtgttcgccaagcagtacatcatgcaatgcgaggaacgccacggtatcgatgcggtggaagacctgctcgattcctgccatgcgttgatgaactacggtgtggaccgctacaaacgcccgtacccgatttctgccgaggaggagcgcctgcgccagaaggagcgcgaggagcacctgcagaaacagatcaacgacctgtggcgcactatccccaagaaaaccgggaaaaacagcgacaaggacaatgcacgcttcccggccgaacctcaggaaaacatcctgtatttcctggaaaaacacgccccgctgctggagccatggcagcgcgaaatcgtgcgtattgtgcgcaagatcgcccagtacttttatccacagcgccagacccaggtgatgaacgaaggctgggccacgttctggcactacaccttgatgaacgacctgtacgacgaaggtttggtcaccgacggcttcatgatggagttcctcacttcccacaccagcgtggtgttccagccgggcttcgacagcccgtactacagcggcatcaacccttacgcgctgggctttgcaatgtaccgcgacattcggcgcatgtgcgaacaccccaccgacgaggaccgccgctggttcccggaaatcgccggcagcgattggttgtcgaccatcaagttcgccatgagcagcttcaaggacgagagtttcatcctgcagtacctctcaccccaggtcattcgcgacctcaagctgttcagcatcatggacgacgacctcaaggacgacctggtggtgccggcgattcacgacgagcccggctaccgcgccatccgcgagaccctggcggcgcagtacaacctgggcaaccgcgaacccaacgtgcagatctacagcatcgatgtgcgcggcgaccgctcgctgaccctgcgtcaccagcagcacgaccgtaagcccttgggcgaatccactgaggaagtactcaagcacctgcatcggttgtggggcttcgacattcatctggaaaccctgcagggcgaccaggtgatgaagactcaccatgtgccaccgcgcagcgatcacaacgacaacgactacggccgcctggacttggccgtcgttcatctctgaaacagcaaagcctccattggtcaggcacaggcggtatcctgtgccgctaatggaggctttttcatgaaaatctataaagtcggcggtgcggtgcgtgatcgcctgcttggcatcaaggtcaccgacgtcgaccgcgttgtcgttggcgcgaccactgaagaaatgctcgccaagggctacaagccggtgggcgctgacttcccggtattcctcgacccgaaaaacggcgacgaatacgccctcgcccgcaccgagcgcaagagtggccggggttatggcggctttgtgtttcacgccagccctgaggtcacactggaagaagacctgattcgccgcgacctgaccatcaacgccatggcggaggacgacgacggcaacctgacggatccgtaccatggccagcgcgatctggaagcccgcgttctacgccacgtttcgccggcgttcgccgaagatccattgcgtgtgctgcgcgttgcccgctttgcggcgcgctatgcacacctgggcttcaccgtagcgcctgagacgctggagctgatgcgtgagctcagtgaatccggcgagctggaagccttgaccccggagcgcagttggaaagaaatctcccgggcgctgatggaagatcagcctcaggtgtttatccaagtgctgcgtgactgcaatgcactgaaaaccctgatgccggaagtgaacgcactgttcggcgtgccgcagcccgaggctcatcaccccgaaatcgacaccggcatacacaccctgagcgtgctggaacaggccgccctgcaccaacagccgctcaccgtgcgctgggcttgcttgctgcatgacctgggcaaaggcctgacgcctgtggataagttgccgcagcacattgctcatgaacatacgggcttggtactgatcaaggcggtcaacgagcgcttcaaagtgccgagggattgccaggaactggcgctattggtgggccaatatcacactcatggccatcgtgcattggagctgaaagcctcgacattgctggagttgctgcagagttttgacgtgtatcgccggccgcagcgctttgaggaatttgtggtggcgtgtgagatggacgcacgcggccgcaaaggctttgagcagcgaagttacccacaggcggattatttgcgcggcgcggccaaggttgcgcgcgaagtggcggtggcgccactgctggagaaagggtttaaaggcccggaactgggcgaagcgctcaaacgcgaaaggctcaaggcgctgaaggcctacaaggaacagcgtaacgcttagcaggcgagcttttccaatgcaaaacctgtgggagcgagcttgcccgcgaaggcgtcggcccaccaagcaatgatggtgactgacgcaccgctttcgcgggcaagcccgctcccacatttgaatccggtcgagccaagagaatcggcggcgataggaagcaggcgagcttttccgatgccgttcagttgagcgtaaaaactgtgggagcgggcttgcccgcgaaggcgtcggcccaacaagcattgatggtgactgacgcaccgctttcgcgggcaagcccgctcccacatttgaatccggtcgagccaagagactcggcggcgataggaagcaagcgagcttttccgatgccgttcagttgagcgcagcacctgtgggagtgggcttgcccgcgaaggcgtcggcccaccaagcattgatggtgactgacgcaccgctttcgcgggcaagcccgctcccacatttgaatccggtcgagccaagagactcggcggcgataggaagcaagcgagcttttccgatgccgttcagttgagcgcagcacctgtgggagtgggcttgcccgcgaaggcgtcggcccaccaagcattgatggtgactgacgcaccgctttcgcgggcaagcccgctcccacattgaatccggtcgagccaagagaatcggcggcgataggaagcaggcgagcttttccgatgccgttcagttgagcgcagcacctgtgggagcgggcttgcccgcgaaggcttcggcccaccaagcaatgatggtgactgacgcaccgctttcgcgggcaagcccgctcccacattgaatccggtcgagccaagagaatcggcggcgataggaagcaggcgagcttttccgatgccgttcagttgagcgcagcacctgtgggagcgggcttgcccgcgaaggcttcggcccaccaagcaatgatggtgactgacgcaccgctttcgcgggcaagcccgctcccacattgaatccggtcgagccaagagaatcggcggctataggaagcaggcgagcttttccgatgccgttcagttgagcgcaaaacctgtgggagcgggcttgcccgcgaaggcgtcggcccaccaagcattgatggtgactgacgcaccgcattcgcgggcaagcccgctcccacatttgaatccggtcgagccaagagaatcggcggctataggaagcaggcgagcttttccgatgccgttcagttgagcgcaaaacctgtgggagcgggcttgcccgcgaaggcgtcggcccaccaagcattgatcgtgactgacgcaccgcattcgcgggcaagcccgctcccacattaaatccggtcgagccaagagaatcggcggctataggagaatcgtcggtgtcagttgctggccctgccactcaaaagcgacaggtgccagcacttggtcgatctgcgcatcgcgccacaactcggcgaatgtcttgcccgcttcggggtgcacgcgatcgggcgccatcaaggacagcggccacagcacaaaggcatttttcaggatctccgcacgtggcaggatcaatccgtcgaagttgcccaccaggtcgccatacagcagcacatcgatatccaacggcagccctttgcggtccggcgcatagcggccattctcggcctcgatgaatttcaaccggcgatccagctccatcaacggcagctcggtataggccgacaccaccaggttgaagaacggcccgctcttgatgcccaccggctggctttcaaacaccggcgagcagcgtacatcggtcaagaagctcgccaacgcatccaggccagcgcgtaaatgcggctcgcgttcgatattgctgccaaggccaaggtaaatctgagttagcggcatccgcgctcgatctccacgcccacgcctttggctgccggcacggcgcctggcttggtcaacttgaggtgcagccagggaatctggaattcgctcatcaacacttcggccaggcgttcggcgaaggtttccaccagctggtactgggacagctcggcaaaggcctggatgcgcgcggatacgctggcgtaatcgagcgccaacgtcaggtcgtcaccggccgcagccgggcgattgtcccaggcgaagctcaggtccaggcgcaggcattgcttgatgccgcgctcccagtcgtaggccccgatcacggtgtcgacttccaggccttcgataaacactctgtccaagctcttctccgcagcacgacaagggcgcgatgccccgttagaatcagggcgtcctcgcccggaatagttagcatgttttggtcactggcgattctcgcctacctgctcggctcgctgtccttcgccattttgctcagccgcctgacgggaaaccccgacccgcgaatgagtggctcaggcaatgccggcgccaccaatatgttgcgcctggccggcaagaaactcgccgtactgacactgctcggcgacatctgcaaaggccttctgcccgtactgatcgccaatctggccggtcttaccctgcaacagcaggcctgggtgggcgtgtgtgccgtcctcggccatctgttcccgctgtacttccgctttcgcgggggcaagggtgtcgccacggcagccggcatgctgctggggatttaccctcccgccgcgttgctcgccgtgctggcctggctgctgacgttctacctgacccgcaccagctccctggccgctttgatcgccacaccgctcaccctgccgttgctggcctggcaggcgccagcggcgctgttgccgatgagcgtgctgacactgctgatcgtctggcgccaccgcggcaatttacgcgacctgtttgccgggcgcgaacggcatttttaaatacgtcaggtgcgcccggcccacgcagagcacttacaacggcgacagctgctccataggccagcgcgcctgcacgctgatcgccaggctttcatgctgcccggcctgcaggcgttggcaaccggcataggcgatcatcgcaccgttatcggtgcagaactcaggccgcgcgtagaacacatcgccgtgcatgtcgccgagcattttttccagcgaggtgcgcaaggctttgttggcgctgacgccgcctgcgatcaccagacgcttcatgcccgcctgtttcagggcgcgcttgcacttgatggtcaaagtctccaccacggcctgctggaacgccagcgcgatgtcgcaacgggcttgctcactgtcgtccccggcgctgacgctatgctgccaagtgttcagcgcggaggttttcaaaccactgaagctgaacatcagacctgggcgatcgcacatcgggcgcgggaaggtataacggcccggcacgcccttttctgcaaggcgggcgatttccggaccaccagggtaattgaggcccatcatcttcgcggtcttgtcgaacgcttcaccggcggcatcgtccagggactcgcccaacagcgtgtattggccgatcgcgtcgacctgaaccagctgcgtatgcccacccgaaaccaacaaagcgacgaacgggaactgtggcggtgttttttccagcatcggcgccagtaaatggccttccatgtgatgcacgccgagggctggaatgccccaggcgaatgccagcgcctgggcgcaagaagccccaaccagcagggctccgaccaatccggggccggcggtataggcaatcgcgtcgatctcggtcggcacgcagccggcctcgtccagcacctggcgaatcaacggcagcatgcgcttgacgtgatcgcggctggcgagctccggcaccacgccgccataggcacggtgcaggtcgatctgactgaacagtgcatcggccaaaagcccgcgttcactgtcgtaaagtgcgacaccggtttcgtcgcaggaggtttcaagtcccagtactagcatgggtttgcgccttgtagaggctgaattcgaaggcgcgcataatagtcgccactccccctcccgactagcggttttcgatcagaggctttgcattccgggcaatgaggggttaacatccgcaacccttaaaaaccgacgacctcagccgcgaattttttgcgacgagaacgttgattcccggtaatgaaagaaggtagctctggatgccagccgtcaaagtaaaagagaacgaacccttcgacgtagctctgcgtcgtttcaagcgctcctgcgaaaaagccggtgttctggctgaagttcgtagccgcgaattttatgagaagccaacttctgagcgtaagcgcaaagcagcagccgctgttaagcgtcacgctaagaaagttcagcgcgagcagcgccgcgccgttcgtctgtactaatacacagacttacgtagcaagcttctgccaagcccggccctcagccgggctattggcatttgcggatatcgcttgatgcttcaccgtcgacgccgcacacgcgaccgagacactgcttcacacgtcaggactggctcttttgccagcggtgcacgtctcttctgacgagcctaacaaggctactgacgagcacactcattcttcaagcagacgatcaactgtgtcggctgtgcccaacgatgcgtttccgaggcccgccattggccaacaccggacgcccgggcaacatttccatgccgaacactgatagaaattaacgtcagtgaatgttcggcagatacactccctgacagcccaagcagacgacagttgatcgagccgcatagtttgcgcgcctgagcacttcgcgggcctcattgacacgcagtgatgacgagaacgccatggccgggctaattccccagagctttattgacgaccttctgaaccgcaccgacatcgtcgatgttgtcagctcgcgcgtgcaattgaaaaaagccggcaaaaactacaccgcctgctgcccgtttcataaagagaaaaccccgtcgttcagcgtcagccccgacaagcagttctattactgcttcggctgcggcgcaggcggtaatgccctcggcttcctcatggaccacgacaacctggacttcccccaggctatcgaggacctggccaaagccgccggcatggaaatccctcgcgaagaaagtggccgcccgcacaaaccgcggcaacccaccgactcgccgctttacccgctgctgaccgccgctgccgacttctaccgtcaggcgcttaaaagccatccgcagcgcaaggccgccgtcgattacctcaagggccgcggccttaccggtgaaatcgcccgagacttcggcctcggtttcgcgccgccgggctgggacaacctctataagcacctgagcagcgacaccctgcagcagaaagccatgatcgacgccggcctgctggtggaaaacgccgagaccggcaagcgctacgaccgcttccgcgaccgcgtgatgttcccgatccgcgacagccgcggccggatcatcgcgttcggtggccgagtgctgggggacgacaaacccaagtacctgaactccccggaaaccccggtgttccacaagggtcaggaactctacggcctgttcgaggcgcgcaaaaacaatcgcaacctcgatgaaatcatcgtggttgaaggctatatggacgtgatcgcactcgcccagcaaggcctgcgtaatgctgtggccaccttgggcaccgcgaccagcgaagaacatatgaagcgcctgtttcgcgtggtgcccagcgtgctgttctgtttcgacggtgaccaggctggccgcaacgccgcctggcgcgcgctcgaagcgacgctctcaagcctgcaggacgggcgccgcgcgcgctttctgttcctgccggaaggcgaagacccggacaccttggtgcgctccgaaggcaccgatgcattccgcgcgcgcatcaatcaacacgcgcagccgctggcggactatttcttccagcaattgaccgaagaagccgacccgcgctccctcgaaggcaaggctcacatggccaccctcgcggcaccgctgatcgacaaagtgccgggcgccaatctgaaatcactgatgcgcatgcgcttgttggaaattaccggcttgagcggcgaagccgtcagccagctggtgcacaacgcgccgcaagaggcgcccccggcgtacgacccgggcatggattacgacgccatgccggactattccgacttccaccaaccgcaggaggcctacacgccccagcaggagtggacaccgaagaagcccggcgccggcggcaagaaatgggacaagaagccctggagcaagaacggcaagcgcggcgatcgcgatgaagcctatgcgccacgcacgccagtggcggtggaagccccgacgctgattgcgttgcgcacgctgatccaccacccgcaattggccaagaaagttgagagcgccgatcattttgccaacgaaagcaacacctatgctcaggtactgatcgccttgatcgaggcggtacagaaaaatcctaagctaaactcaattcagttgatggctcgttggcacggcaccgaacaaggccgcttgttgaaagcactcgcagaaaaggagtggctaattgacggcgataaccttgaacaacagtttttagacaccattactaggttatccgcgggtcagcacacgcagaccctcgatgaactcatcaagagagcgaggcagccgggattatcggctgaagagcaaattcagatagcaaaacagatgcgcgacctcttaaaacagaatgtttccgcatcaaacccgacctcagctggcgtgtgaggtcatagctcgggtataatcctcggcttgttttttgcccgccaagaccttcagtggatagggtgttatgtccggaaaagcgcaacagcagtctcgtatcaaagagttgatcgttctcggtcgtgagcagggttacctgacttacgcggaggtcaacgaccacctgcctgaggatatttcagatccagagcaggtggaagacatcatccgcatgattaacgacatggggatcaacgtattcgaagctgcgccagataaggattcccttatgctggcggacgccgataccgacgaggctgccgctgaagaagcggctgccgcgctggctgctgtggagaccgatatcggtcgtaccaccgaccctgtgcgcatgtatatgcgtgaaatgggtaccgtcgagctgctgacacgcgaaggcgaaattgaaatcgccaagcgtatcgaagaaggcatccgtgaagtgatgggcgcaattgcgcacttccctggcacggttgaccatattctgtccgagtacactcgcgtcaccaccgaaggcggtcgcctgtccgacgtcttgagcggttacatcgacccggatgacggcattgcgccgcccgccgccgaagtaccgccgcctgtcggtgcgaaaaccgcgaaagctgacgacgacactgatgacgacgagactgaagccagcagcgacgacgaagaagaagtcgaaagcggcccggacccgatcatcgctgcccagcgcttcggtgcggtttccgatcaaatggaaatcacccgcaaggccctgaaaaagcacggtcgtggcaacaagcaggcaatcgccgagctgatcgccctggctgagctgttcatgccgatcaagctggtgccgaagcaattcgaaggcctggttgagcgtgttcgcagtgcccttgagcgtctgcgtgcccaagagcgcgcaatcatgcagctgtgtgtacgtgatgcacgtatgccgcgcgccgacttcctgcgccagttcccgggcaacgaagttgacgaaagctggaccgacgcgctggccaaaggcaaggcgaaatacgccgaagccattggtcgtctgcagcccgatatcatccgttgccagcagaagctgactgcgcttgagactgaaaccggtctgacgattgctgaaatcaaggacatcaaccgtcgcatgtcgatcggtgaggccaaggcccgccgcgcgaagaaagagatggttgaagcgaacttgcgtctggtgatctccatcgccaagaagtacaccaaccgtggcctgcaattcctcgatctgatccaggaaggcaacatcggattgatgaaggctgtggacaagttcgaataccgtcgcggctacaagttctcgacttatgccacctggtggatccgtcaggcgatcactcgctcgatcgccgaccaggcccgcaccatccgtattccggtgcacatgatcgagacgatcaacaagctcaaccgtatttcccggcagatgttgcaggaaatgggtcgcgaaccgaccccggaagagctgggcgaacgcatggaaatgcctgaggataaaatccgcaaggtattgaagatcgctaaagagccgatctccatggaaacgccgattggtgatgacgaagactcccatctgggtgacttcatcgaagactcgaccatgcagtcgccaatcgatgtcgccactgttgagagccttaaagaagcgactcgcgacgtactgtccggcctcactgcccgtgaagccaaggtactgcgcatgcgtttcggcatcgacatgaataccgaccacacccttgaggaagtcggtaagcagtttgacgtgacgcgtgagcggatccgtcagatcgaagccaaggcgctgcgcaagttgcgccacccgacgcgaagcgagcatctacgctccttcctcgacgagtgataccagaacccccggcccaggccgggggttttgcattctgcagattactttctatagattaactgccgcgcaacacccctcccccgcaatgcccgtctacactcgaaacattccccgtgccataacgagaccgttatgcccagactgccgaccgtgatactgctgtcgctgctgacctggaccgcaacggctggcgcgttgactctcaccgatgaagagcgtggctggctggcggaccatcaggagctgcgccttggggtggatgcctcctggccaccgttcgaataccgtgacgaaaatggccgttatcaaggcctggccgccgactacgtgcgcctgatccaggaccgcctgggcgtcaggatcaaactgatcgagcccgtaaactggaccgccgtgctcgagcaggccaaaaacaaccagctcgacctgctgcccggcatcatgtccaccccggagcgccagggtttcctggccttcacgcgcccgtacctggatttcccaattgtcatcctcgcccatgaaggcggcgcgaaaccgcgcaacctgaaggatttgtacggtctcaagattgctgtggtggaaaactacgcaccgcatgaattactgcgcacccaccacccggatctcaacctggtggccatgccaaacgtcagctcgaccctgcaagccctggccaccgatgaagtggatgccgtggtcggcgatcttgcctccagcgtctggagcctgcgccaacttaagctcgatggtttatacgtcagcggcgaaacgccctaccgctatcagttggcgatgggcgtaccgcgcgatgagaaaatgctggtgggcatcctggacaaggtgctcgccgacctcagctcagacgaaaccgacgcgatccagcaacattgggtcggcagctttaccgatcaccgcacattctgggccgacctgctgatgtacggcctgcccgccgtactgctgttgagcaccgtgctcgccatcgtgattcggatcaatcgtcggctcagctcggagatttcccgacgggtcgcccttgagcaggaactacgcagcagcgaataccactatcgcggcctggtggagagcctgtccgccatcgcctgggaagcgagcatcactgatttcacctacagctacgtctcgccccatgccgaagacctgctcggctacccgcgcgcgcattggctgatccccggcttctggcgcaacatcatccaccccgccgacctgacgcgcgccgaagcctattgctaccgcgaaacccgcgccaaccgcgatcacagcctcgattatcgggtgatcaccgccgatggccgctgcctgtgggtgcgcgacatagtcagccttatcgagcatgggcacgagccggtgctgcgcggcctgatgatcgatatcagcgaagccaagcgcaccgaagaagccctgcagctttccgagcagaaatttgcctcggtgtttcagcaatgcccagacatcctggtgattgcgcggctgtccgatggctgcctgctggaggtcaacaaggcttttgaagaccaaattggcttgagcgccgaacaagtcgtgggcaaaaccgccaccgaactgaatatctggggcattcaaggcgtcggccccgacctgctgcaacgcgtgcaaaccaccagcatccgcaacctcgaaatgccgtttcgacgcagcaacggccaagcctttaccggcctgatttcggcggagccgttccaactcgacaccaccgaggcattggtggtggtggtgcgcgatatcacccagctcaaggaaacccagcaacagctgcaaacctccgaagagaaattcgccaaggccttccatgcctcacccgatggcttgctgctcagccgccaacgcgatgggctgctgattgaagtgaatgacggtttcagccggattaccgggtttaccagcgccacctcgctcgaccaatccaccctggacttgggcatctgggtcgacctcaacgaacgcaaacacatgctggaactgatgcagcgcgacgggtttgtgcgcgatttcgtctgccatatacgccgcaacgacggccagattcgtctctgcgaagtctccagccgcccactgcccatcggcgatgaagattgcatgctgaccattgctcgggacatcaccgaacgccagttcatgcaggaaaaactgcaacaggccgccacggtgtttgaaagcacggccgaaggcgtgttgatcaccgacacccggcagaacatcagcgccgtcaaccgtgccttcactgaaatcaccggctacagcgaagccgaagctctgggcagtacgccgcgcctgctcgcctcaggcctgcatgacagcgccttctatgcggccatgtggcaccagttgaccgcccacgggcactggcagggtgagatatccaaccgccgcaaaaacggcgagttgtaccccagctggctgaccatcagtgccgtgcgcaaccgcgagcaattgatcactcactttgtcgccgtgtttgccgacatttccagcctcaagcacgcccaggcgcggctcgactaccaggcgcatcatgacccactgaccggcctgcccaaccgcaccttgtttgaaagccgattgcaggcggcactcaatggccagcaggaaagcggcaaccaaggcgccgtgctgttcctcgacctggaccgcttcaaacacatcaacgacagcctcggccatcccatcggcgacctgctgctcaaggacatcgccgtgcgcctcaaggaccaactgcgcgatgtcgacaccgtggcgcgcctgggcggcgacgaattcatcatcctgctgcccggcctgcaacacgccagcgacgccgaacacctggccaataaactgctcgcctgttttaccccgcccttccaggctggtgagcacgagttctttatcagcgcgagtatcggcaccagcctgtacccgcaggacggcactgacgtcgccacgctggtcaaaaatgccgacgccgcgatgtaccgctccaaggccaagggccgcaaccgcgtcgaaagctacacccgcgacctcaccgcccaagccaacgaacgcgtggccctggaacacgaactgcgccgcgccatcgagcgtgaagaattgagcctgtattaccaacccaagctgagcctggcgacccaggaactgatcggcgccgaagccctgatccgctggcgccaccccaccttcggcgacgtgccgcctgaacacttcatcgccctcgccgaagagaacggcatgatcctgcagattggcgactgggtgctggaacaggcctgccggcaactgcacgcctggcaaaccgtcttcgatgatttcgggccgctgtcggtgaaccttgccggcgcgcaactgcgtcaccccaatctgctcgggcgcattgagcagctcctgcgcgactaccgcctggagcccggctgcctgcaactggagatcaccgaaaacttcatcatgagccaggccgaagaagccctggaagtgctgcaccagctcaaacgcctcggcgtgcagctggcgattgacgatttcggcaccggctattcatccctcagctacctcaaacgcctgccgctggacttcctcaagatcgaccagtcattcgtacgcggcctgcccgacgaccctcacgacgccgccatcgtgcgcgccatcatcgccctgggccacagcatgcaattcaccatcatcgccgaaggcgtggaaaaccccgcgcaacaggccttcctcgccgccgaaggctgcgaacagatgcaaggctacatcgttagcctgcccctgccgcccgagctttttgccgcgacatttcttcatatgagggtttcagacttttcggatggcacagcggggaaaccgtcgttataatccgcgacctactgagggcctatagctcagttggttagagcaggggactcataatcccttggtcgcaggttcgagtcctgctgggcccaccaaacaaaaaagccgcgcactgcgcggctttttgctgtctgcgaaaaaaggcgcgattcagtcacagggatcaacggtatttcatccaccccccgtatcgtcgagaatgccaagccgaacgagctgttcccaatgaaagcggattttcttcaagtggttgattatggatattgacagcggctctgcgacaaatgattgcgcgcgaatccatcgcgccggggtggatctgaacgggctgatgtcggttctcggcaaacacctgtattccacacccaacgtagccctgcgcgagctggtgcagaacgcgcatgactcgatcctgcgtcggcgcctggaacaaggcgactggcaaggcgagggccgtatcgaggtggtcggcgatccacagtcaaacaccatcactatcaccgataccggcgcaggtctgacggagcatgagattcacgcttaccttgcaaccgtgggtgtcggctacacccggggcctgcgcgagaccggcgaggatgcgggaagcctgatcggaatgtttgggctgggttttctgtcggccttcgtactggctaaacgggtgatcgttcgcagcacgtcctaccagcagccgcaattgggattctgttatcagtccagcaacgctgaacagtacagcgtggagccctgcgaagcgcgcccggtgggcacgcgaatcaccctggaacttcatgagcagcaccgcgtcttggccgaggccgcctccctgcgtgcaattctggagcgctattgcgcgctgcttgaagtaccgatacatgtcgctggtggtgccagcgaggcgatcaaccgggagccgccgccctggcgactgcctgtagagagtgctgtgcatccgttgcaattgcacaaacgggaactggcgttcgccaaaggctttgagcacaccttcgaaccgatctgctgcatacccgtcggctcgcatgagcagccggatttgcaggggttgctgtgggttcaggacggcgcgacctatggttcgaacgacaaccgccatctaagtgtattcctgcgagggatgctgctggatgacaatgcccgcgacctattaccttcctgggccggctttgtaggcggcgtgatcgagtccaagcacctgacacccacggcgagccgcgaggccctgcagcgcgatcaacactacaccgcaacccgccatgcgatcggcgaagcgctgatccatggtttgctcaagctcgccgagcaccagccgcaggcttggcgacgggtattgtcgcgccataacgaatcgctgttaggggcgaccctatgcgatcagcggctctttgacctgctcaaggataacctgcggattcccaccactcagggcgatctgcgggctagcgatctgcacgtcgcaggggtggtgcatgtgttgctggacagccaagatgggtttgaaacgatgttgttccatgccttgggttttccagtggcgcatggcaatcgttatgcagtgttgccattcctgcgcctttggtgcgaggcacaaggtatacgcctggtcgagctgggcagcgaaagtggcaaccggcaattgtttacccctgtcagcatgccgacgtcgcaatttgactggctgagcgcgcagttggcggtgaacgaagagctggtggtggcgcgcttcgcccctgaagcgctaccaatggtggtggtcagcaatcacgaggggcagttgaagaaccggcttgaaagcgatgaggcggatcggcggatcgcatcggctgcgttgcatctcgctcgtcaatatacgcagcagataactgtacaagctgcaaaccggctttatctcaaccttgccaacccggccgtcgaggccttgatccaggctatcgacggcaattcgtcgggcgccctcgatgcggcccgactgctcaagaccttcaaggtgattatctcagggcaggccgcagggcaaacgcctgccgacctgacagaagcgctggaagggctggcgcagtcggtgcaaatcttgctaagccgatgacgggtgatcccgaatgatcgaaggagaatgaagcacatggatatttggaactgggtgggaaaacttaaggctgagttgcgagagtcgggcaagggccaggctgtcgattcgctggatcgaatgcttcaacacatcttcaacctggaagtcgtccaggctcaggcgttgcttcctgaggttaaggcgctggccaaaaccgttggccatccgtggctggaggtgttcgtgggccattgggagatgcgcaaccgtgtcggcagcttgctggaaggggaaacagctctggcgcaggtggtcgcgctgttcgagcgggccaatcgggaagatgcccaacagtgcccccaatcggtctgcgtaacccaggacctggtgtcgtgctatgccaatgtcgatggtgcgggatgggcgcaggagcggatcgctgtctgtgatgaggccttacaacgccttgccccccgcctgggttgcttttcctgtatgagttatgaaaaggccgacgccatcctcgatgatggacgccccgaggacgccctggcgttcctggacgagcagcaggccaagatcgtggctgccggacagcccatctacgactgcatgcacgaggtacgtatcgcagccctgctacgattgaagcggcccgagcacgcctggtcggtgatggtcgagtgggattccggtgtgaagggccaggagtggctgaccgagcgccaacagcgactgatgtataaggcgcaggtgttagcccatttgcagcgcgacgacgaggcctgggcgcttctgctcgccgagaatgagctgatcccgcgctaccggctgttctggctccgtgcgctcgaagagttgttgcaacgggccccggagcgcaataaccaagcgctggccaatttgttgcagcaggtcatcgagcagcatgatcggcacggggcgcaccggctggtgattcaagtcgccgctatcagcattccactggcactgcagcgcgaggacctggcccaggctcaccatcacctcgagctggcacgcagccacgtggggcagctgcgccgagatcgcggcgcgcaggcgctgctggagtccctggcgaggcagattgatgccgcctgtcctcagggcgagccgactttgccctttcggttcggcaggcagaactcataatccatggggcgtaggttcaagtccgtgtgggcccaacaagtttaaagccgcgcattgcgcggcttttgtgtgtctggaagtctgtaacatatagccccattgccgcccgctctggagccccacccttgcccgtcctcgatgaaatcgatcgccaactgattgctgccttgcagatcaacgctcgcgaaagcgtggccatgcttgcccggcaactgggtattgcgcgcaccacggtgacgtcgcgcctggcacgcctggagaaaacccaggtgattaccggctacggcgtgcgcctcggccagcgtgtggtcgatgggggtttgcaggcttatgtggggattaccgtgcaagcgcgctcgggcaaggaagtgttgcgcaggctgagtgccatggcgcaggtgcagcagctgtgtgcggtgagtggcgaatttgattacgtggcgtggttacgcaccgattcgccggagcagctggatcagttgctggaccagatcggcagtgtcgacggcgtggagaaaaccaccacgtcgatcatcctcagtaacaaattggaccgcggtcaaccaatctgaccgcctatttcgtcactttgactaaaaacagttcaatccgacgacacattgcgtcttaataacgaacgctacgctccctaaactggctgccatcttttcctatactcaacgggccgcaacccgccgagtcgtcagtaaggtcagccatgagcattccgtccagcaccatcagcaagaccaatcgccaccccgccgacggtaaaaaacccatcaccatctttggcccggattttccgtttgcctttgatgactggatcgagcatccggccggcctgggcagcattcctgccgcgaaccatggcgccgaagtggcgattgtgggtgccgggatcgcgggtctggtggccgcttacgagctgatgaagctgggcctcaagccggtggtgtacgaagcgtcgaagatgggtggccgcttgcgttcccaggcgtttgaaggcgccgagggcatcatcgcggagctgggcggcatgcgttttccggtgtcgtccaccgcgttctaccactatgtggacaagctgggcctggagaccaagcccttccccaacccgctgacgccagcctctggcagcacggtggtcgacctcgaaggccagacccactacgcacaaaaactctcggacttgccggtgctgttccaggaagtcgccgacgcctgggcggatgcgctggaagccggctcgcagttcggtgatatccagcaggccatccgcgatcgcgacgtgccgcgcctcaaagcgctgtggaacaagctggtgccgttgtgggatgaccgcaccttctatgacttcgtcgccacctccaaggccttcgccaaactgtcgttcgcgcaccgcgaagtcttcggtcaagtgggtttcggcacaggcggctgggactcggacttccccaactcgatgctggaaatcttccgcgtggtgatgaccaactgcgacgaccatcaacacttggttgtcggcggcgtggcacaagtgcccatgggcatctggcgccatgtgccggaacgttgcgcccattggccggcaggcaccagcctcagctcgttgcatcgcggcgcgccacgggcgggcgtgaagcgcatcgcgcacgccgacggtgggcgctttgccgtaaccgacaactacggcgacactcgcgagtacgccgccgtgctgaccacctgccaaagctggctgctgaccacccaaatcgaatgcgacgaaaccctgttctcgcaaaagatgtggatggccctggaccgcacccgttacatgcagtcgtcgaaaacctttgtgatggtcgaccgccccttctggaaagacaaagacccggaaaccggccgcgacctgatgagcatgaccctcaccgatcgcctgacccgtggcacttacctgttcgacaacggcgacgacaagccgggcgtgatttgcctgtcatattcgtggatgagcgacgcgctgaaaatgctcccgcagcccatcgacaagcgcgtgaaactggcgctggacgcactgaaaaagatctacccgaaagtcgacatcaaggcgcgcatcatcggcgacccgatcaccgtgtcatgggaagccgacccgcatttcctcggggctttcaaaggcgctttgcccggccactatcgctataaccagcggatgtatgcgcactttatgcagaaggacatgcccgccgaacagcgtgggatttttatcgccggtgacgacgtttcctggacgcccgcctgggtcgaaggcgcggtacaaacttcgctgaacgcggtgtggggcatcatgacccacttcggcggcagcacccatccggagaacccggggccgggtgatgtattcgacgaaatcggcccaatcgccctggccgattaaggagttgagcatgcgcgtcgccctgtaccaatgcccaccgctgccgctggatgtggccggcaacctcacgcgcctgcaccagctcgcccatgaggcgtcgggcgcggatgtgctggtgttgccggagatgtttctcagcggctacaacatcggcgccgaagcggttggcgcgctagccgaggcacaggatggcgcgtcggctcaggcgattgccgcgcttgccaggagcgcagggctggcgattgtgtatggctacccggagcgggccgaggacgggcagatctataacgccgtgcagttgatcgacgcccatggccagcgcctgtgcaactaccgcaagactcacctgtttggcgacctggaccactcgatgttcagtgccggggaagatgatttcccgttggtggaactgaacggttggaagcttggtttcctgatctgctacgacctggagttcccggaaaacacccggcgcctggccctggccggggctgaactgattttggtgcccaccgccaatatggtgccgttcgacttcgtcgccgacgtcaccgtgcgggcacgggcctatgaaaaccagtgttatgtggcctacgccaactattgcgggcaggaaggcgaaattcagtattgcggccagagcagtattgccgcgccgaatggccagcgcgtcgcccaggccgggctggatgaggcgctgattgtcggggagctggatcgccaatccatcatcgacgcccgcgccgccaatcactacctgcaagaccgtcgccccgagctgtacgccgcgctgcacaagccctgacccggccggtttgttaacatggccacctcctacgtttcggaagtgcccatgcctgcgccggcccagcctcatcaccttcacctgaccctcgcgaatggcctgcgggtgtccctacgccatgcgccacgtttaaagcgttgcgctgccgttttacgggtggccgccggtagccatgacgtgccattggcctggccggggctggcgcattttcttgagcatttgttgtttctcgggacgcagcgttttccctccgacgaagggctgatggcccacgtgcagcggcatggcggacaggtcaatgcgagtacccgcgagcgcaccacggactactttttcgaactgcccgtgcaggcctttgcggatggactggaacggctggcggacatgctgacctacccgcgcctggcggttgaggaccagctgcgggagcgcgaagtgctgcacgccgagtttgtcgcatggtcccaggatgccaaggcacagcaggaggtcgcgctgctggagagcttggcagccgatcatccactgcgcggttttcatgcaggtaatcgggacagtttgccggtggagcgtgaggcatttcagcaagctctgcgggaattccacgcgcatttttacagaagcgggcagatgaccttgagcctcgccgggccgcaagcattggaagagttggaagcattggcgcagcgattcagcgaggcattggcctcggggcctttccacccacaggccgaaccgcccgcgctgatgcaaggcgcagcgcagggctatcaacacaccgcgaacaaccacctgcaccatgtcattgcctgcgacgtgccgcgccaagcactggattttctctgcacctggctcaacgcctgcgcacccggcggcttgttggcgacgctgaaagcacaaaagctggcgaccgaattgcaggcatccgtgctgtatcactttgccgggcaagcgctgctggatatcgatatcacactcggtactcaaggcgacgcggctactcagatcgaagcgttgttgctcgactggctgagctttttcgcacagagcaattggacgccgttgcgcgaagagttcgccttgctgagcgctcgccagcaacagatccagggcgccctggcactggctcgaaacgccagcgaagacttgtcggaacagagtgttgcagccctcaaagccatgctcgactcactgcacctgccgcccgccgagcacgcctggcaattaccgcccggcaatccattcctgcgcccgccgatcaaggaagaacgtgcgggcctgattcgcggccagaccagcgcccatcgtggtttgcgcacctttgcccaggatcgctcgcgcgggcggcgagacgtgtcggcgctcaccttcagccaggccctggcggatgacactgatgggggcgctttgtacctgcaatggcgatttgaatccgccgccccagccgggctggaacgtacgttgcagccgttgcgcgaacatgcgcgtcaggcgggagtcgatttgtctttcgaaaccttcggcaatgattggttggtgaaaatggtcgggcttcacgaaccgatgccggcggtagtcgaagcgctggcgctcaacctgagccggaccgatgaggcgccgtcacccaccgcccaaacgccgatgattgccatccgggaattgctcaaggcgttaccggcttactgtgtcggtacgggtttcgggatgagcaagacatcagcgtcatggaacactgcacgctggcaggggctgggcacagccttgcccgcggcgtgtgaaacggcgatcaagaccgctgcagcgcgactgcctggccagccggcaagcctcgaacacacgccccacagcctcgacggccagcggctctggcacgaagtgaagaccgactccagcgaagccgcactgctgctgttttgcccgacgccaacccaatccctggccgatgaagccgcgtggcgactgctcggccatctgatccagggcccgttctaccaacgcctgcgcgtcgaactgcaagtcggctacgcagtattcagcggcatccgacagattaatgggcaaacaggcctgctttttggcgtgcaatcgccaagcatctccctggcggggatcgtcgaacacctgcaaaccttcctgacccaactgccggcgctgatcgacaattatgccgacttgggcaaccaggccctggcgcagcaattcaccgcccaggcattgcccatcgcccaagccgcagacctgctctggcatgcacagctggctggccattcgtcgggttatctgcaacagcttcaacagctgatccaagccctcacgcacgcggatttgcagcacgccacccaacaactcaacgacgctgcaggcggctggcgctgtgtggccaacggcacccgagtgagtgattcctggcagacaggagcctgatcattgctggccctgcaaaaggcttttgccaccaagacagcgctaacttgaaaagaattgcgtaacattcatacgcacacctctgaacatctccggttggaggtggactatatgtattgctgagtagtgaacgtcccatccctcgtaggagtatgaatatgacctggtccaaacctgcttacactgatctgcgtattggtttcgaagtcaccatgtacttcgccagccgttgattggctgagtaatacaacgcctcggttcgcccggggcgtttttgttttgagctttgctgatggagcgatcatgtttgtccagattctaggttccgccgccggcggtggtttcccgcagtggaactgcaactgcgtgaattgcgcaggctttcgcgacggcagcctgcgggcgcaggcgcgcactcagtcgtctatcgcaatctccgacgatggcgtgaattgggtactgtgcaatgcgtcgccggatatccgcgcgcaactgcagggattcgctccgatgcaacccggccgtgcgctgcgtgataccgggatctgcgcgatcatcctgatggacagccagatcgaccacaccaccggcctgttgagcctgcgcgaaggctgcccgcaccaggtgtggtgcaccgacatggtccatgaagacttaagcaccggtttcccactgttcaccatgctcacgcactggaacggcggcctggcgtggaaccgcatcgagctggacagcagctttaccatcccggcctgccccaacctgcgattcactccgctgccactgcgcagcgccgcaccgccctactcgccacaccgcttcgacccccaccccggcgacaacatcggcctgatcgtcgaagacctgcgcactggcggcaaactgttctacgccccgggcctgggcaaggttgacgcgccgttgctggagatcatggccggcagcgattgcctgctggtagacggcacgatgtgggacgacgatgaaatgcagcgccgtggcgtcggcacccgcaccgggcgcgagatgggccacttggcgcagaacggccccggcggcatgctggaagtgctggagcagttgcccgagcagcgcaaggtgcttatccacatcaacaacaccaatccgatcctcgatgaagattcccccgagcgagcggaactggtgcggcgcaatgtcgaagtggcttacgacggcatgagccttgaattgtaggagcaatcgagatgactgatacaccgttgaccactgccgaattcgaagcagccctgcggaccaagggcgccttctaccatatccatcacccgtaccacgtggcgatgtatgaaggccgcgccacgcgcgagcagatccagggctgggtcgccaaccgtttctactatcaggtgaacatcccgctgaaagacgccgcgatcctggccaactgcccggaccgcgagatccgccgcgagtggatacagcgcctgctcgaccacgatggcgcccctggcgaagacggtggcatcgaagcctggctgcgcttgggccaggcagtcggcctcgaccctgaccaactgcgctcccaggaactggtgctgcccggcgtgcggtttgcggtggatgcctacgtcaactttgcgcgccgtgccagctggcaggaagccgccagcagttcgctgacggagctgttcgccccgcagatccaccagtcgcgcctcgacagctggccgcagcactacccatggatcgacccggccggttacgagtatttccgtacccgcctgggccaggcccgtcgcgatgtggaacacggcttggcgatcacgctgcagcattacaccacccgcgagggccaggagcgcatgctggaaattctccagttcaaactggacatcctgtggagcatgctggatgccatgagcatggcctacgaactgaaacgcccgccctatcacagcgtgaccgagcagcgggtgtggcataaagggatcaccctatgagctttgatcgcagcagaacaccaacctggcgccagggctaccgctaccagtacgagccggcgcaaaaaggccacgtgttgctctaccccgaaggcatgatcaagctcaacgacagcgccgcgttgatcggcggcctgatcgatggcgagcgcgatgtggccgccatcattgccgagctcgataagcaattccccggcgtgcctgaactgggtaaagacatcgaggatttcatggaggtcgcccgtgctcagtactggatcgaacttgcctgagaagccaccggtcggcctgccgctgtggctgctcgcggagctgacgtatcgctgcccgttgcagtgcccgtattgctccaacccgctggattttgccgaacagggcaaggagctgagcaccgaacagtggatcaaggtgtttcgtgaagcgcgggaaatgggtgccgcgcaattgggcttttccggcggtgagccgctggtgcgccaggaccttgccgaactgatcgccgaagcccgcaagctgggcttctacaccaacctgatcacgtccggcatcggcctcaccgagcagaagatcagtgacttcaagaaggccgggctggaccatatccagatcagtttccaggccagcgacgaacaggtgaacaacctgctggccggctcgaaaaaggccttcgcgcagaagctggaaatggctcgtgcggtgaaggcgcatggctacccaatggtgctgaactttgtcacccatcggcacaatatcgacaagatcgaccgcatcattgagctgtgtatcgctttggaggcggactttgtcgaactcgccacgtgccaattctacggctgggcgcagctcaatcgtgtggggttgttgccaactaaagaacagctggtacgcgccgaacgcatcaccaacgaataccgtgccaagctcgaagccgaaggccacccgtgcaagctgatattcgtcacgccggattactacgaggaacgcccgaaagcctgcatgaacggctggggcagcatcttcctgacggttacgccggacggcaccgccctgccttgccacggcgcccgacagatgccggtgcaatttcccaatgtgcgcgaccacagcatgcagcacatctggtacgactcgtttggcttcaaccgctttcgcggctacgactggatgcccgagccgtgccgttcatgcgacgagaaggaaaaggacttcggcggctgccgctgccaggcattcatgctcacgggggacgcaagcaacgccgacccggtgtgcagcaagtccgagcagcacggcatcatcctgcaagcgcgggaagaagccgaacacgccactcagaccattgaacagctggcctttcgcaacgagcgcaactcacggctcattgcaaaaggctgaggcttttagcgtttggcgatgatgtacacggcgtgaatgatgccggggaagtaaccgcacaaggtcagcaggatgttcagccagaacgcgccggcgaagcccacttgcaggaacacacccagtggcggcagcaggatggcgatgatgatacgaataatgtccatgggtcagctccagaaaatcggctcgtgtgagccgtgtagctaatcgaccttggccgttcgtgagggttcagtgggatctggcaccgggccatcctcaggccagaatctccagcccatgcttctgcacgatgctcagtaacttgagtgccatgccgctgggttgcttctcgccggactcccatttcttcaccgtggaggcgctggtgttcaggtaacgggcgaatacaggttggcttacgtggctgttttcgcgtagttgcttgatttgttcggccgggatttgcgccggcaccgttgcaaggcacatttcgtcaaactcacgaagcgtggttttgctgatggcgcctatcgagtacaacgctttggctgattgatgaatggactccagcgcttcactttcatacttcttggtcatgatatatctccacaaactccttgagatccagtagctgctgaacctgtatttcacttaaagcttcataagtcttcgccatcgctcgaaacgcaattaaatccttctgactgatattgctttgatcctgtttggcgaacagaagctgataaacccagtaatgcctgcccctggccaagactatggagcgatgccggttctgattcagacgtttcttccaaacaccgccgcctaaattatcagcttggcccttcagcatctggccaaatgcctctctcaactccgaatcacagatccaggccttgctggccgaatcagcaaaatgccgcgtcttgaacaacctaagcctcatggatatcccttcccgcaaacataccactcagtggtacagattagaaatgaggcacgctcgaaatttttcatgccccagcggcagtccttgccgatgcctgtaaaaaaccactgttctcaataaggctcaatcaacgctttcaatccaaaaatttcaccgacaaaaaaacgcccccagccaaaagaatcaggctggaggcgccgcgtatgccgcgagacggttctggaatgcagggtttaaacggcgatgcccttgcggcattgcagttgtgcggtgcgcacgcgggaaaaggcgcgggccaggcgcaggagcatttcgtcgatgttacttttgctcaccgtcagggccggtgtgaagcgcaggcagttgggttgcggggcgttgaggatcaggccttcatgcagggctgcttttacgacggcatccgcagaatcatccgacagcgtcaggccccacatcaggccatgtccacgtagctggccgtggtcgtagcgataagccaaacgggcgaggccttcgcccaggtaaaggcctgactcacggacatgttcgaggaacccgtgttccagcagcgtttcgagcaccgccccgccagccgaggccatcaatgcattgccatgatgggtgccttccaattcgcccacctcgaagcagcacgctgtgccgcgcgccagtaacgccgccaatggcacaccgccgcccaggcccttgccgagggtgattatgtcggcgcgcacgccatactgttgttcggcgagcaagctgccgcagcggccgatgccggtttgcacttcatcgaggatcagcaggattcccagctcgcggcacaggcgttcaacgcctttcagataatgttcagtggcgggaattacgccagcttcactctggatcggctccagcatgatggcgacggtctgtgcatccaccgccgcgtgcagggctggcaggtcgttgaagggcacatggctgaaacccggcaattgcggctcaaagcggtttgccccgccattggccgaggccgccatcgctgcgaaactgcggccgtggcaagcgttgctggcgctgatgatgcgataagccccgccgcgatgcagttggccccatttgcgcgccagcttgatcgcggcctcgcaggcttcggcgccgctattgagcaggtaaccctgatcgctgccggtgtgctggcacagccgatcgacaaggttcagctgggcgcggttgtgcaggccattgcctgggttgatcagcgcttgagtctgatcggccagggccttgatcaatatttgcgggctatggccaaggctgttggcggcgctgccctgattgaaatccaggtaggcgcgctcgtcgctgtcccaaagccaggagccctggccacgcacaaacacctgcgcaggccttgccgcagtgtgcatcaacctgtcactggagaggtcacgtggcgcgtcgaggatcaaatcgtccaggctcggtgcagggcggcgaaacagattcacagcttacccccgatggcaaccggaccttggtcgatgccccgtgcaaaccgagccttgaggtgttttgccttgcctatgtaaacgctatcaacaaatacgctgttcattgcccgatccggccctgtaagccctgcgaataggcgctagactaggcctccaagcggccatcggccatttcgattttccagctttttcgataagtaactcttatggatttcaagcaactgcgttatttcgtcgcggtgtatgaggaaggccacgtgggccgggcggcggagcgtttatcgatctctcaaccggccctctcgcaacagattcgccaattggagcagaacctggatgtgagcctgttcgagcgcagcagcaagcgcctgttgccgacgctcgctgcgcataccttgtacaaccacgcgttgccgctgatcgacggcatgcagcaggcggttgaagccttgcgcaacttcaagggccaggcgatgcgcaccttggccatcggcgtgctgcaaaccgtgcacaccagcctggtcccgcaaatgcttgagcgcgtgcgcaaagcccagccgcatttggtggtgcagatctacgaattgacgggcatggagattgaacggcggctgctgaacggctcgctggacatcggcatcagctacctgccgccgcgccagccggggctgcacggcgtactgttgtatgaagatgaattgaaggtggtcatccccgaagaccatcccctgcgcgaattcaagaaagtctcgctgaaacaggcggccgagttgccgatgttgctattgggcgaggagtttcaagtgcggcagatctggcaaggccagttgtccaacctgggccgcaggccgcaagtgcaggcggagctcaacacgatggtgggtattctcgacagcctgccccacaccaagctcgccaccgtattgccggggcgctcccaggacgaacacaacagcaaggcgctactgtggaaacccttgagtgaaccgagggtggcgctgaaagtgggtttggtgtgccgcgacgtacaacgccagcaagccacggtggcgctgctgcgcaccttgctggaagacgtgatgaatgccccgtaggcgcctgtctgactttttcgcaggcaaaagaaaaccccgccgaagcggggctttgcagactgtttccctgacatccatttcactccgccgtcctggcagaatcctacgtgtccgtgttgttgctttgcgcttcctgcgcgacgtccatgtgaagtagattatccgtggatccaatttggcgatagaggacgaatagcagcacgtgatgtaagagaatgcttacacgccctccaagcctttaaaactgtgcttcatccagcaaaaacagcgattcgctaccggcttttaccgacgcactcagcgaatgaatacgcggcagcaggcgagcaaagtagaagcgcgcggtgcccagtttgctggcatagaagtcttcctcagcttctttgcccaacgccgccttggccatgcgcgcccacatataggcataggccatgtagccaaaggcgtgcaggtactccaccgaggccgcgccgatttcattcgggttggtcttggcacggtccagcacccaggcggtcaactcatccagattatccaccgccgcactcagcggacgggtgaactcacccagttcggcacccgccgtggcgatgaactggcggatctcgtcggcaaacaaggtgtagaacgcaccgccgctgccgacgatcttgcgccccatcaagtccagcgcctgaatgccattggtgccttcgtagatctgcgtgatgcgcacatcccgaacaagctgctcctggccccactcgcgaatgtagccgtggccgccgaacacttgctggccgagcacggtggtttccaggcccaggtcgctgaggaatgctttggcgaccggcgtcagcaacgccaccagattgtcggcacgctcgcgggcggcggcgtcttcgctgaacttggcgatatccaactgcgtagccacgtaggtggagaacgcgcggccaccttcgttcgaggccttcatggtcagcaacatgcggcgcacatcagggtgcacgatgatcggatcggcgactttgtccttggcctgcgcaccggtcggcgaacggctttgcagacgatcacgcgcatattcaatcgcgttctgatacgagcgctcacccgacgccaagccctggataccaacccccaggcgctcgtagttcatcatggtgaacatcgccgccaacccacggttcggctcacccaccagataacccacggctgcgtcgaagttcatcacgcaggtcgcggacgcctggatgcccatcttgtgctcgatggagccacagctcaccgggttacgcgcgcccaggctgccgtcggcattgaccatgaacttcggcaccaggaacaacgagatgccttttggtccggcgggcgcgtcaggcagcttggccagcaccaggtggataatgttttcggtgaggtcgtgttcgccgccggtgataaaaatcttggtgccgctgatcgtgtaggaaccgtccgcctgaggctctgccttggtgcggataatccccaggtcggtcccggcatgcgcttcagtcaggcacatggagccggcccactcgccggagtacatcttcggcaaataggtggctttgagtgcttcgctggcgtgggtgttgatcgacacgcaggcgccggatgtcagcatcgggtacaagccgaacgccaggctcgacgagttgatcatctcttcaacctgggccgaaacagccttgggcatgcccatgccgccgaagaccggatcgccgcctacgcccacccagccgccttcggcgtaggttttataggcctgtggaaaaccatccggcgtgctgaccacggtgtccgcccaacggcaaccttgctcatcgccgttacggctgagcggggcgatggatttggccgtgactttgccggcttcctcaaggatcgcctcgacagtttcggcatccacgctgtctgccaatgccggcaattgggcccaagtcttggcgacctcaaaaacttcgttgaggacgaagcgcatatcacgcagcggcgctttgtaatcagccatggcaaacctcgtgagaacgtgaaaagtgattcgataggatcggttttacaagctccgagtgtacccgaacaacttttcagacacatagggtccgttcgtgactattaagtatttataagtcacacacagatctaataatgtaggagctggcttgcctgcgatggcatcaccgcagtttcgctgacaaaccgaggtgactgcatcgcaggcaagccagctcccacacaagcctgcacacaattacccgcagaagcatcagccgcctacagtgcaaacaactgagcaggcaggctcatcaggcattcgctgcccgcctccaccgccgcccggtgcgtcgccgtacgcggcagcaaacgcttgaagtagaagtcgcaggtcgccaacttagcctgggcaaactcggcgtcgtcgtgtgcctgagccactatcgccatgcgcaaccacaggtaggcgaggatgatgtaaccgctgtacatcaagtaatccaccgccgctgcaccgacttcatcggggtttttcatggcggccatgccgacttgcatcgtcaactcgccccattgctgattgagtagattgagctgcgccacatgcgccttgagttgcggatgctcggcattcgccgcgcaaaacttatgcacaatcttggtgaaaccgcgcagcagcttgccttggctaccaagcaccttgcggcccagcaggtcgagcgcctggatgccgttggtgccttcatagatcggcgcaatacgggcatcgcgcgccaattgctccataccccattcgcgaatatagccgtggccgccaaacacctgcatgccgtggttggttacttcaagccccgtatcggtcatgaaggctttgcagatgggcgtaaggaacgccaacaggtcttcggcttcctggcgttggccggcgtcgctgctcaggtgcgcggtgtcgagcaattgcgcagtgaagtaagtcagcgcgcggttgccttcattgaaggctttcatggtcagcaacatgcgccgtacatcggcgtgcacgatgatcgggtcggcggccttttccggggccttggcgccggtgagcgagcgcatctgcaggcggtcgttggcgtatttgatcgcgccctggaaactcgcttcgccgttgcacagtccctgcatgccggtgcccagacgcgcgtggttcatcatggtgaacatgcagttgaggcccttgttcgcctcgccaatcaggaagcccttggcaccgtcgaaattcagcacgcacgtggccgacgccttgatgcccatcttgtgctcgatggagccgcagtgcaccgcgttgcgctcacctgaatcggcatggaacttgggcacgataaacagcgagatacctttggtgcccgccggtgcatccggcaacttggccagcaccaggtggatgatgttggcactcaggtcgtgctcgccggcggagatgaagatcttgctgccagtgagcgcatagctgccgtccgcctggggcacggcgcgggttttgatcagccccagatcggtgccgcaatgggcttcggtcaggcacatggtgccggtccactcgccagcggtgagtttggtcaggtaagtggctttctgctcatcggtaccgtgggcgtggatcgccgacatggcgccgtgggtcagcccagggtacatgccccaggacgtgttgctggagccgatcatttcgctcagcaccaggcccaaagagtgcggcaagccctggccaccgaaagccggatctgccgccacgccgtgccagccgccttccacatactgggcgaaggcttccttgaagcccttgggcgtggtgaccacgccgttgtcgaaatggcagccttcctcatcgccgctgcgattaagcggcgacagcacgttttcgcagaatttggcgctttcttcgaggatcgcgctgaccatgtccgggctggcgtccgttgcgcccagcgcggcgtagtggccgtggaaatcaaacacgtggtcgatcagaaagcgcatgtcgcgcaggggagctttgtactcaggcatggcgatgtctccggcagcagatggtttcaacctactgccggccaccgccgcaaacaatcactgtagaaccgctgaatacaccgccatcactcaaccggcagccgtctccatgcgcaccgcgccacgccgggtttgccccgccgcaaccacacagttacgccccgcgcctttggcggcatacagcgcctggtcggcggatttgagcacttcttccggcgtgcgttgctcggcctgacgctcggccacgccgatgctgacggtcaccgacacactcgacgcgccgctgcccgcacggcgttggcggccttgctgatcgtcatgagggcgatcggggttgcgcagcttgatgtcgtagttggcgatgatctcgcgaatctcttccaggtgcggcatgcattcgtccagggtcttgccggcgaacaccacggcaaactcctcaccgccataacggtaggcgcgcccgccaccattgaccttggacagcttgctggccaccaggcgcaagacctggtcgccgacgtcatggccgtgggtgtcgttaaagcgcttgaagtggtcgacgtcactcatcgccagcacatagttgcgccccagccgttgcatgcgctcgttgagggcgcggcggccgggcaaaccggtcagctcatcgcggaaggccatttgatacgcctcatgcgccacgccggcggcgatcatcagcatgacctggctgcacatgatgttcagcgtaaacggcaggatgaaggtttgcggcaacatccagaacagccccagcagccccaccaattgcgcggcgtgcaaagggcgcggctgataccagtactgcgccgccagggtgacaaaaccaatcaggaacatcgggtacgacagttggatcaagctcatccatcggccatgcaaggccggccagcgaatctccgccaaccagctcaacaaggcctgcgggaaactctgctcaagcgccagggccacgctgccgacggcgaacagcacggcgcagcgcgccacgaagtcgcggaacaggtgggttttttcctgccacagcgcataaatgctgaacagcagcggcaacaacaggcaacacagatgaaacaccaccgccgcatcttcgcgcacgcggccgttgtcacggtagtaatcggtctgggtgtccagcaggaagtaaacgacatacaccgtgaccatcaaaaacagttcacgctggcgccgatacaccgcgcagtaagagccgccgagcagcaacaccaaggtcggcagtacgttgaacagcgaggtgaagaagacgttgagatctttgacatacgcagccgagagcccggccagcaacagcagcaacgagggaagaaaatgactgaaacgtacagcggacgcgcgcgacaagggtaaagctccgacccactcaaaaaagatggcacagtgccttcactgcgcacagttaagcacattcaatgtgacctgtatcacattgccatcactttaacggcagccaagcgcaatccctgagtgctgtactgtgttttttataagccaataaaaaaccgccgctcccaaaggcagcggcggttttcaagagaacccggtaaggcttagtaagccaggccgaagtcttcttctttcatgtccatcaggttgttggcacccgacagcatggttgcaacgtgcgtacgagtacgcggcaggatgcgctggaagtagaagcgcgcggtctgcagcttggcggtgtagaacgcctcttcgctggtgccggcagccagtttctcggcagccaggcgtgccatgtcggcccagaagtaagccaggcaggcgtaaccggagtacatcaggtaatccaccgacgcggcaccgacttcttcgcggtctttcatcgcggccatgccgaccttcatggtcaactcgccccactctttgttcagtgccgccagcggtgcaacgaactctttgacggcttcgttgccttcgttggcctggcagaacttgtgcacgatcttggtgaagcccttgagcgcttcgccttgcgtcatcagcactttacggccaagcaggtcgagtgcctgaatgccggtggtgccttcgtacagcatcgaaatgcggctgtcgcgaacgttctgctccatgccccactcggcgataaagccgtggccgccgtagatctgcacgccgtggttggcggactcaaaaccgacttcggtcatgaacgccttggcgattggggtcatgaacgccagcagggcatcggcctgcttcttcgcttcgtcgtcggtgccgtacttgacgatgtccacttgcttggcggtgaagtacaccatcgcacggttgccttcggcgaaggctttcatggtcagcagcatgcggcgcacgtcagggtgcacgatgatcgggtcagcggctttgtccggtgctttcgggccggtcaacgagcgcatttgcaggcgatcgcgggcgtatttcaggccgccctggaagccgatttccgcgtgggccaggccttgcagcgcggtacccaggcgagcggtgttcataaaggtgaacatgcagttcaggcctttgttcgccgggccgatcaggaaaccggtggccgcgtcgaagttcatcacgcaggtggcgttaccgtggatgcccatcttgtgttccagggaaccacaggtcactgcgttgcgcgcaccgatcgaaccgtcggcgttcggcaggaacttcggcacgataaacagcgagatacctttggtgccggccggtgcatccggcaggcgggccagtacgatgtggacgatgttgtcggccatgtcgtgttcaccggccgagatgaagatcttggtgccggaaaccttgtaggagccatcagcctgaggctcggccttggtgcgcagcatgcccaggtcggtgccgcagtgcggctcggtcaggcacatggtgccggtccactcgcccgagaccagtttggtcaggtaggcgtcttgctgctcaggggtgccgtgctcggagatggtgttcatcgcaccatgtgacaggcctgggtacatgccccacgaccagttggcttcgccaaccatttcgctgactgccaggcccagggattccggcaggccttggccgccgtgctctacgtcgtgggccaggcttggccagccgccttcgacgaactgtttgtaggcttctttgaaaccagcaggggtcttaacgcctgactcactccaggtgcacccttcgatgtcacccacgcggttcaacggtgccagcacttgctcacagaacttggcgccttcctcaaggatggcgtcaaccatgtccggggtagcgtcctggcaagccggcaggctctgatagtgcgcttcataaccgagcagttcgtcacgaacgaagcgaatatcacgcaagggggccttgtagtcaggcatagcgataaacctctgctgatgtatctgggatgaacaaccgcgtggatgtgtgctggcggtcaaacaggtgtttgaaacatacgtttacgacctggggttgtcaagcatcgtccagacgccatttgtcatgacgcggatcaacggcgcgcacggcaaggcctgcggcgggttgccacagcaaaaaaggaatttagaagatagagagggcgaagcaggacaaatgtgggagctggcttgcctgcgatagcatcaccgcggtttacccgtaataccggggtgcttgcatcgcaggcaagccagctcccacacaagccagctcccaaaggaaagccggcagatctagagaaagggattaagcgtacgtatcgatcaacgtaccgagcatttcatccgaagccttggcgactttggcgcccagctccacttgaaacttgccttgggccatttcaaccatattgctcgccgagttggacggctgagcccggtcgttggcttgcagacgatcgctttgtgcgtctgatggctgggtcgtcgcggcgctggcaatcttgccggcggcctggtcgacacggttttgcccggcctgaatcgtgctcagccccgaataaaacgcgctgcttccagagatttccatggcgtaagcctgcctttagagaatcgtgaacctgaattgaagcagacatccgggcaaaacgcccgtcaaaaacactaatggcataatgccttagcgatagccaaaatcagtcaagcaagtccaattccaggtattcggccaccgcttctgcgctggcctgcttgagtttcggcacccggcccaggcagggcgccggcagccgctcagccagggtggcgaggttttcttccagacgggaggtcttggggtcgatgatgttcgccacccatcccgccagcggcaaaccgtcccgcgcgatggcttcagcggtgagcaaggcgtgactgatacagcccaggcgcacgcccaccaccaggatcaccggcagctggagcgccatagccaaatcggagaggttgtcctgatcggccaacggcacccgccagccgcccgcgccttcgatcaaggtgaaatccgcctgccgcgccagaatctgctgcatcggtttgagcaacgactgcaccgtcaacgccacgcccgcctcccgcgccgccaggtgcggcgcgatggcaggctcgaacgccaccgggttgacctcggcatacgtcagcggcaacgaacactcggccagcaatgccagcgcgtcgctattgcgcaaaccttttggtgtgacctggcaacccgaggccaccggttttcccgcggcggtacttctgcccgcgagccgtgcggcgtgcagcaggccggcggcgatggtggtcttgccgacatcggtgtcggtgccggtgatgaaataagcggcgctcatagaggtttctccagtacggcatacaccacttgatacgtggcgggcaggccctgggcctgacggaactgctcgtaagcgtccaccagtgcaacaatccgcgcgcgtcccgtcaaccctccggggcgacccgggttgaggttgtgcgcgcccaatgctttgagttcgtgggtcaggctgcgcacatccgggtaatgcagcacatggggctggcgcgccaggctgaccacgcgcaagccgctggccgcgcacagctgctgataagcctcgaaactgcggaagcgattgacgtgcaccaggccatccgccgcgcgccagctttcgcgcagctcagccagggtgcccacgcacaggctggcgaacgccagcacgccaccgggctgcagcactcggtaagcctcgctgagcaccgcctcgaaattcgcgcaccattgcaccgccaggctggaaaagatcagcccgcaactatcgccctgcaacggcaagcgttcagcgtcaccggcgatgaaatgctcggcgccgcccaaaggccgggcgtggttaagcatgccctcggcaatatccagcgccacgccgtggctggccggcaaccgctcgcccagcacgcggctgaaaaaccccgtgccacagcccaggtccagccagcgctggggcgccgtgtcggcgggcagccgcgccagcagttcagtgcccaccgcgcgctgcaactcggccacgctgtcgtaactggcggccgcgcgggaaaacgatgccgctacctggcgcttgtccggcaaggcgccgggcagcgatgggtgggataaatcagtcatcaacgcactcatgcaaaaaagcctggatggcccccgcaacgccgtgagggtcttccagaagaaaagcgtgaccggcctgttcaatcaggccgatttctacatcgggcagcaacgccagcaaatcactggcggcttcggcaggcaccagctcatccagaccggcgaacaggtgcagctggggaccgcgataggcctgcagcgcggcacgcgtatcgagctgggcaagcaattcaagccctggcatcaacacgctggaaggcgccgtcggcgcgccgctgaccagcaagcgcgagagcccgcgcgggtcttgcgcacctttggcacacagcaggccaaaacgcttgagggtgacttgggaatcggcatggcaaccggccagaaacgcatcaaaggtttcggccggcatcgcgctgagccagcctgcatgcgcgacaaagcacgggttactcgccagcgtcagcaacccacaacaccgctcgccgcgccgtgccgccagctccgaggcgagcatgccgcccagggaccaaccacccagccaggcattgtccggcagcgtggcgtcgagttcgtcgagccagtcattcacgtcactggaatccagcgccggcaacggttcgatgtgcacctgcaggtgctcatcgaggccacgcaaagcggctgccaacggttccagcggcgacacaccgaggccccagccgggcagcaatatcagtcgatcacgcatggtcgggctccgtggcgcctaacaagcggaaacacgcttccaatccgtttaacaatagctgcacctgcgcctcgctgtgtgccgccgtcaatgtcacgcgcaaacgcgcgctgccggcaggcacggtgggcgggcggatcgcggtgaccatcaggccgcgctcgcgcagcatctgcgacaggcgcacggccttggcactgtcgccaatcaggatcggctggatcggcgtaaagctgtgcatcaagtccaggccaagctgctcggcgccctggcggaactggcggatcaggccgttgaggtgctcgcgccgccaatgctcggtgcgcagcagttccaggcttttcagggtggcgcaggccagggccggcggttggctggtggtgtagatgtaaggccgggcgaactggatcaggctttcgatcagatcttcactgcccgccacaaacgccccggcggtgccgaacgctttgcccagggtgccgaccagcaccggcacgtcctcctggctcaagccgaaatgctcgacaattccgccgccattggcgcccagcgggccgaagccatgggcatcatccaccatcagccacgcgcctttggccttggcttcgcgggccagtgcgggcaggtcggccagatcgccgtccatgctgaacacgccatcggtgaccaccagcgtattgccggtggccttttccaaacgcttggccaggctgctggcgtcgttatgcaggtagcggctgaaacgtgcgccgcagagcaacccggcatccagcagcgaggcatggttgaggcggtcttccagcacggtatcgccctgccccaccaatgcagtgacggcgccgaggttggccatataaccagtggtgaacaacagcgcgcgcgggcgaccggtcaggtcggccagggcttcttccagttcatggtgcggcgtggcatgcccgaccaccaaatgcgaagcgccgccgcccacgccccagcgggacgcaccggcgcgccaggcttcgatgacgtgcgggtgattggccaggccgaggtaatcattgttgcaaaatgccaacagcggctggccgtccaccaccacttgcgggccttgggggctgtccagcagcgggcgttggcgataaaggtgttcggcacggcgggcagcgaggcgcgcggcgagatcaaaagacatgcaggcctcggcagatcaaagaacttaagactggatgcactcaactgtgggagctggcttgcctgcgatagcggtcattcagacacattgatgctgaatgtgccgccgccatcgcaggcaagccagctcccacagttggattgcatttcaatcaaacaacggcgttatagaactgctcgctgctcttttgctccaccaacgcctgctcgatcgccgcctgatgcacttcatcggcgtgctcttcgcgggcttccggcaggatgcccaggcgtgcgaacagttgcatgtccttgtcagcctgcgggttggcggtggtcagcagtttgtcgccgtagaaaatcgagttggcgccggcgaagaacgccagggcttgcatctgctcgttcatcgcctcacggccggccgacaggcgcacatgggattgcggcatcaggatgcgcgccacggccaacatacgaatgaagtcgaacgggtcgatgtcatcggcgttctccagcggcgtaccggccacctttaccagcatgttgatcggcaccgactccggatgctccggcaggttggccagttggatcagcaggttggcgcggtcgtccagggactcgcccatgccgaggatgccgcccgagcagatcttcatgcccgaatcacgcacataggccagggtttgcaggcgctcgctgtaggtgcgggtggtgatgatcgaaccgtagaactccggcgaagtgtcgaggttgtggttgtagtagtcgaggccggcctgggccagcgcttcggtctggtcctggtcaaggcggccaagggtcatgcaggtttccaggcccatggccttcacgcctttgaccatttcaagcacatacggcatgtctttggccgacgggtgtttccacgccgcgcccatgcagaaacgcgtcgagccgatggccttggcgcgggcagcctcttcgaggaccttctgcacttccatcagcttttctttttccaggcccgtgttgtagtggcccgactgcggacaatatttgcaatcttccgggcaagcgccggttttgatcgacagcaaggtcgacacctgcacacggttggcgtcgaaatgcgcgcggtgcacggtctgcgcctggaacaacaggtcattgaacggctgtacaaacagcgctttgacttcggccaaagaccaatcgtgacgcagggtggcagtggtgctggcgctcatgggcgattccttgattatgctttggctttcgctgtgggaagggcaatacccacagtcacgacacggatgctcggcatatttaaggaagattcatgcactgtcaacctggatacaaacatgaagtttacatctggctaaaaaacaaccagatctgcctggtgtgcgatgaagtcaccgaatcgaccgattgtgtgtgcaacgtctgcgaaatcgagctgccgtggctaatggcgcaatgcgaggtatgcgccctgccgttgcccatggacggactgatctgcggccaatgtcagaaacacccacccgcgtttaaacaggtgattgcgccgtggtcctacagctttccggtcgacaccttgatcagccgcttcaagcatcaatcgcgctggccccttggccacctgctcgcgcgcctgctggggcagcacctgcaacaccgcttcgaaaacaccgacctcgcgcgccccgactgcctgctgccggtgcccatggcagctaaacgcttgcgcgaacgtggcttcaaccaggcgttgatgctggctcgctggctcagtgaacgccttgctatcgcccacgatgaacacctgttgttacgcccgcatgaaaccgtcgcgcaacaagccctcgacgccaagacccgcaaacgcaacctgctcagcgcattcgcgctggcacccgacgctcaggtgcaaggccgtcacctggcgctggtggacgatgtactcaccaccggcgccaccgcccacagcctggcccgcctgttgatggatgccggagcgcgccaggttgacgtctactgcctggcccgcacgccaaaacccggcacatgacttgactcccgtgcgccgcgcctgcaacgtccgctgaccttatagaagcgtatccacatgtctctgccgacctccctcagccaacacatcatccgccacccccagcgtattgccttgctggcgcacatcgccgagcagggttcgatcacccgcgcggccaaaagcgccggtttgagttacaaggcggcctgggacgccatcgatgaactgaacaacctggcgcaaaagccgctggtcgagcgcagtgtcggcggcaagggcggcggcggtgccaagctgacggccgaaggtgagcgcgtgttgcgcctctatcagcgcctgcaagtgttgcaggccgaaatactcggttcggatgaagctgccagtgacttcaacctgctgggccgcttgatgctgcgcaccagtgcgcgcaaccagttgcacggccgggtcatcgcgattgaaagccatggccgcaatgacctgatccacctgcagttgtcgggcgacttgagcctgagtgcgcaaattacccatgacagcacccagcgcctcgaactcgagaccggcgtggaagtggtggccttgatcaaggccggctggctggaattgcaggctatcgggcaagccgcaacacctggacacaattgcatgagcggcgttatcgagacgattctcgacgctgaggacggccccagcgaggtgcgcatcaccctgcccaacggccaggttttatgcgccctggcgcagcccgccgtgctcaaggcgttgaaggccaccgagggccagccgatccaggtgcagttctcacccagcaacgtgttgctcggcacgcccgcgtagggcgcagggcgacttcaaactgcaacaatttcgtcacgcgtgctccttaaggtgtctgcaaaaaccgcagggagcctgaaatgagcctattagaagaaaaccaagccaccgaccttgagcagatggtcggcctcacccgccggcgttttatcggcgccggcgccctgtgcggcgctgcgatgttccttggtggcaacctgctgacccgcagcgccctggccgtgaacgccgccagcgccagcccgctgctgggcttcaccagcatcgccgccgccaccagcgacgccatcaccctgccgcccggttacagcgcctctgtattgatcagttggggccagccattgcacaagaacggcccggcgttcgacccgtccggcaacggcaccgccaaagcccaggagcagcagttcggcgacaacaacgacggcatgagcctgttcgccttccccggcgacgacaaccgcgcactgctggcaatcaacaacgaatacaccaattaccgctacctctacgcccacggcggcgcaccgcaatcggccgaagacgtgcacaaggcccaggccagcgaaggcgtgtcggtcatcgaggtgcggcgcaagggcgacacctggcagttcgtccaggactcgcgctacaaccggcgcatccacggcaactcgccgatccgcctgagcggcccggctgccggccacgcctggctgaaaaccagcgccgacaaaaccggcaaaaaagccctcggcacctttcagaactgcgccaacggcaagacgccttggggcacttacctgacgtgcgaagagaacttcactgactgctttggcagcagcaacccacaacaggcctttgacgccgggcaaaagcgctacggcgtggtggcggccagcaaagagatcaactggcatctgcacgacccgcgttttgacatggccaagaaccccaacgaactcaatcgccatggctgggtggtcgagatcgacccgttcgacccgcaatccacaccggtcaagcgcaccgccctgggccgcttcaagcatgaaaacgccgccctggctgaaacccgcgaccgccgcgccgtggtgtacatgggcgacgacgaacgcggcgagttcatctacaagttcgtcagccgcgaccccatcaatcatcacaaccccaaggccaacaaagacctgctcgaccacggcaccttatacgtggcgattttcgacgcgggcgacggcgacgccgaccaccccaagggcaaaggccactgggtcgagctgacccacggcaaaaacggcatcgacgccagcagcggtttcgccagccaggccgaagtgctgatccacgcgcgcctggccgccagcgtggtgaaagccacacgcatggaccgcccggaatggatcgtggtcagccccaccgacggccaggtctattgcaccctgaccaacaacgccaaacgcggcgaagacggccagccggtgggcgggccaaacccgcgcgagaaaaacgtttacggtcagatcctgcgctggaaggccgacgccgataaccacggcgcgctggacttcacctgggacctgtttgtggtggccggcaaccccggcgtgcatgccggtacgccgaagggcggctcgtccaacatcaacccgcaaaacacgttcaacagccccgacggcctgggtttcgacaaggccgggcgcttgtggattctcaccgacggcgactacagcaacgcgggcgacttcgccggcatgggcaataaccagatgctgtgtgccgacccgactaccggagaaatccgccggttcatggttgggccggtggcgtgtgaagtcacgggcatcagcttttcgccggaccagaagacgctgtttgtgggcattcagcaccccggcgaaaccggcggttcgacctggccggagcatctgccaaacggcaaaccgcgctcgtcggtgatggcgattcggcgcgatgacggcggggttgtcggcgcctgaccgaccgccatcgcgggcaagcccgctcccacagggggttgcattccaacggtgggagcgggcttgcccgcgatagcaatggcacagtcaccacctatctcaggcccggtgcgttaccataccgggccggacgcggcgccctgctgcgcgcaggagttcgcatggcccatccgtttgaaacactcacgccagatttggtactcgacgccgtcgaaagcatcggctttctcagcgatgctcgcgttctggcgctcaacagctacgaaaaccgtgtgtatcaggtgggcatcgaagacgccgaaccgctgatcgccaagttctaccggccccagcgctggaccaacgaagcgatcctcgaagagcaccgtttcaccttcgaactggccgaatgcgaagtgccggtggtcgcgccgctgatccacaacggcgaaagcctgttcgaacatgccggtttccgcttcactctgttccctcgccgtggcggccgtgcgccggagccgggcaacctcgatcagctttatcgcctgggacagttgctcgggcgtttgcacgcggtgggctccacccgcccgttcgaacaccgcgaagccttgggggtgaagaacttcggtcacgactccctcaacaccttgctcgaaggcaatttcattccgaaaagcctgctgccggcctacgagtccgtggcccgcgacctgctcaagcgcgtggaagaggtgtacaaggccacgccgcacaagaatatccgcatgcacggcgactgccaccccggcaacatgatgtgccgcgacgagatgttccatatcgtcgacctggacgattgccgcatgggcccggccgtgcaggatttgtggatgatgctcgccggcgaccgccaggaatgcctgggccagctgtcggaattgatggacggctatcaggagtttcacgacttcgacccacgcgagctggccttgatcgagcccctgcgcgccttgcgcctgatgcactacagcgcctggctggcgcggcgttgggatgacccggcgttccctcacagcttcccgtggtttggcagcgagcgctattggggcgaccaggtgctggcgttgcgtgagcagctgtcggcgctcaatgaagaaccactgaaactcttctaaccccctgatcgttcccgcgctctgctgatcgttcccacgctctgcgtgggaatgcagcctgtgacgctccgcgtcacgattccaggtgcggacgcggagcgtcccaaaaagcggcgttcccacgcagagcgtgggaacgatcaccaccggtcgacaaaaatccttacaattgcgcctttgttagctgcctatgcaaggattccgcaatgcaacccgccaacccccgcaagggttacatcctgggcctgagcgcctatgtcatctggggcctgttcccgatttatttcaaagccatcgccagcgttcccgccgccgaaatcatcgtgcaccgcgtgttgtggtcggcgctgttcggcggcttgctgttgatggtgtggaaacacccaggctggttgcgtgaactgctcgataaccccaagcgcctggccatattggcactcagcggctcgttgatcgccgccaactggctgacctatgtgtggtcggtcaacagcgggcgcatgctcgaagccagcctgggttactacatcaacccgctggtgaatgtgctgctgggcatgctgatcctcggcgaacgcctgcggcgcctgcaatggatggctgtcggtcttgcagcggtaggtgtggcgcagcaggtgtggcaagtcggcagtttgccgtgggtgtcgctggtgctggcgctgacctttggtttctacggtttgatccgcaagcaagcccccgtcaaggcactgccggggctggtggtggaaacctggatgctggtgccgattgccgtggcgtggttgctgttcaacccgtcggcacacagtgcgcagcttgaattctggagcacctccgaagcctggtggctggtggccgcaggcccagtcacattgattccgctggtgtgcttcaacgcggccgcgcgccatctgccctataccgcgctgggcttcttgcagtacgtggcacccacgctggtgttgctggaagcggtgttcctgttcggcgaacacctggcgaccagcacgctgatcgccttcgcatttatctgggcgggcctggtggtctacagcctggacgcctggctgactgtgcgcaaacgctgatcaaataacgtacaaacctctgcaagccacagcgggcgtggcttgcagacatccaccccaaggttatccacaacctgatccccgccatttgtgcacaagccgttgaaactgctcgttttttgctcaagccgagcagaagcccggccggcgtggcctggcgccgggtctctacaggttatccacaggcccatgcaagatttccatgcataaccctgtgggccgttattcctcgtggtgcaactccaccatcaggtcatccgccagggtttccagggacagttgcaaggtatccagggataacgctgtcggcacctgcaacacggcctcggcggtaaacaacggatcgccgctcatgggcgccgggcgcacatccgtgctcagactttgcaggttcacgccctgcttgctcagcagcgccgtgatctcgcgcacaatgcccgaccggtcattgcccaccagcgtcatcaggatcgccttggacgccgcggcctgcccggtactgccctcacccaccagcacgcgaatgccgtgtgtggataagtcctccagcgcattcaccaggtcctgacggctttctgcaggcacactgacccgcaggatcccggcaaactgcccggccatgtgcgccatgcggctctccagccagttgccgccgtgggccgcaatgttctgcgcaatgcgttcaaccaggccgggtttgtcggcggcgataatagtgagtacaagatggtccatggcgaagccctctgggatttcaatctacaaggtggacgcaggcgccctcgaaaacaaatcgtgtaccatttttatatttatctggaacaatccaatagttttttgagaacatctcgttctccgctgtgaccgtacgaccaaagtgggtcgctaaacgacgtatttagtctaattttcacaaccgcaagtcatcatgtagtatgcccaaccgtgcactacataatgaaaatctgaaacagcgcataagctccgcagagtgaggcaagcaatgactgaacacgttcaagtcggtggcctgcaggtcgccaaagtcctgttcgacttcgtgaacaacgaagccattcccggcaccggcatcactgccgaccagttctgggccggcgccgacaaggtcatccacgacctggcaccgaagaacaaagccctactcgccaaacgcgacgatttccaagcgcggatcgatacctggcaccagacgcacgccggccaggcccacgaccctgtggcctacaaagccttcctgcaagatatcggatacctgctgccagaagccgcagacttccaggcctcgactcaaaacgtcgatgacgaaatcgcccgcatggccggcccgcaactggtggtgccggtgatgaatgcccgcttcgccctcaacgcctccaacgcccgctggggctcgctgtatgacgcactgtatggcaccgacgccatcagcgaagccgacggcgccgagaagggcaagggctacaacaaagtgcgtggcgacaaggtgattgccttcgcccgcgccttcctcgacgaagccgcgccgctcagcgcaggcagccacgtggattccaccggttacaagatcgtggatggcaagctgatcgtcagcctcaagggcggcagcaacagcggcctgcgtgacgatgcccagctgatcggtttccagggcccagcagcccagccgattgcgatcctgctcaagcacaacggcctgcacttcgaaatccagatcgacgccaacaccccggtcggccagaccgacgccgccggcgtcaaagacgtgctgatggaagccgcgctgaccaccatcatggactgcgaagactcggtcgccgccgtggatgccgatgacaaagtggtgatctaccgcaactggctcggcctgatgaagggcgacctcgccgaagaagtggccaagggcggcaagaccttcacccgcaccatgaacgccgaccgcgtctacaccggcgtagatggccaggacgtgaccttgcacggccgttcgctgctgttcgtgcgcaacgttggccacttgatgaccatcgacgcgatcctcgacaaacacggcaacgaagtgcccgaaggcatcctcgatggcctgctcaccagcctggcagcgatccacagcctcaacggcaacagcagccgcaagaacagccgcaccggttcggtctacatcgttaaaccgaaaatgcacggccctgaagaagcggcgttcaccaacgagctgttcggccgtatcgaagacgtgctgaacctgccgcgcaacaccctcaaggtcgggatcatggacgaggagcgccgcaccacggtcaacctcaaggcctgcatcaaggcggccagcgagcgcgtggtgtttatcaacaccggcttcctcgaccgtaccggcgacgagatccacacctccatggaagccggcgcgatggtgcgcaaggccgccatgaaagccgagaagtggatcggtgcttacgaaaactggaacgttgatatcggcctgagcactggcctgcaaggccgtgcgcagatcggtaaaggcatgtgggcgatgcccgacctgatggcggcgatgcttgaacagaaaatcgctcacccactggccggcgccaacaccgcttgggtgccgtcgcccactgcggccgcactgcacgtgctgcactaccacaaggtcgacgtgttcgcgcgtcaggccgaactggccaagcgtgagcgcgcctcggtggacgatatcctgaccattcctctggccagcaacaccgattggtccgaagaagaaatccgcaacgagctggacaacaacgcccagggcatcctcggctatgtcgtgcgctggatcgaccaaggcgtgggctgctcgaaagtgccggacatcaacgacgtcggtctgatggaagaccgcgccaccctgcgcatctccagccagcacatcgccaactggttgcgccacggcatcgtcaacgaagcccaagtgatggaaagcctcaagcgcatggcgccggtggtcgaccgtcagaatgccggggatgcgctgtatcgcccgttggcaccggatttcgacagcaacatcgcgtttcaagcggcggtggagttggtgattgaaggaactaaacagccgaatggttataccgagccggtgttgcaccgtcggcgccgggagtttaaagcgaaaaacggtaggtagttaaacgcgaactccctgatcttgagatcagggagttcaagtcaacccctataattaacccatgcggttttatcatgggatgtattgaatatcagccttcccctcaaacacgtatttcttacctacttctttttcataaaccgccgcgatcgtcagtgcttgatgatcgcctccatcggtcactgtcacagtaacgtttccggccaaagagcgctcgtccccgtcgccagagaagcgtaatccccaaggatgatctgcagcgtattcaaaattataggttttaccgtcttcaacgttctctgggtaaacaattgccaagatgggtttgcctttattgtcaaacgccacgaaattgtttgcggccccttcaaccttatccaaattaaactcaaggtgaggtttatctttataggtaactttcagaattgccgagcctttgaacggacttttagtcgccatttccatctcccgcttaatgggtatttaaagtaacgatctctgcgcgctacttcacccagtaaacaagagccacccaagctttcctactgttaaaactaacaggtatcggacaaacctgaccaacggtaactactgcgccattcctaattcacgcttgaccatcttcgccaacttcacgctatcaatcggcttgagcaaaaagtccaccacactcaaatgcatcgcatcgatcacgtccggcgcctcggcgtcccccgacatgatgatgatcggcaacgccgcccgctcggactcgcgcaccttttcaatcagttcgaggccgttgctgggttccatgcgcaggtcagtaatcaatagaccaatcgagctactggttttcaacaaatcccacgctgcctcaccactgtcagccgtcatgcagcgaatgccgtccaggcccaggatttccgccagcagttcacgcgcgtccttgtcgtcatcaacaatcaacacgcgttgtggcggtaaatcaggctccagcatcacagcgctcagcgcctcgcgctcggcatcgctcaaaatatcgtggtcggacatacgtttctcagcagttctcatcaatctcccagcacactcgtcagacatctgcagaagggcgaacaatgtgcacttcgtcggaaagtttgcctagtgggcgttctacggggtttggacgatagtcatgtaaggtttttccctagtcgcccctcgttttaccgctacctagacttacgtccaatgggcacccagggcgcgggggctgaccataaaggacgataacgacaagaaactgcggtcactcttatgagtaaagctgatgctttcacccaggcgggaaaaaccgccgtgttgcagaacatccacggcaccctgcaattcctgcaacgcttcccgcccttcaaccagatggaacacgcccacttggcgtttctggtggagcagtgccaattgcgcttctacggccccggcgacagcatcctcaaaccgtcgggcgggccggtggagcatttctacattgtcaagcagggccgagtcgtcggcgaacggccggactccacccaaaccaccttcgaaatcaccaccggcgaatgtttccccctcgccgcgctgctgggcgaacgcgcgacccgcaccgagcacaaggccgccgaagacaccttctgcctgcaactgaacaagccggcgtttatcaagctgttcgcgctctccagcccgtttcgcgatttcgccctgcgcggtgtcagcgcgctgttggaccaggttaaccagcaggtgcagcaaaaagccgtggaaaccctcggcacccagtactcgttgaacacgcgcctgggtgaattggccatgcgccatccggtcacctgcaacccgaccacgccgctgcgcgaggcggtgacgctgatgcatgagcagcaagtcggcagcatcgtgatcgttgacgagcacaaggcgcctctcgggatcttcaccttgcgcgacctgcgccaagtggtggccgacggcaccagtgatttcaatcaggccatcgaaggccatatgacccaggcgccgttcttcctgacgcccgaccacagcgccttcgacgccgccatcgccatgaccgagcggcacatcgcccatgtgtgcctggtgaaagaccagcgcctgtgtggcgtggtgtccgagcgcgacctgttttccctgcaacgggtggacctggtgcacctggcccgcaccatccgcaatgcgccgcgagtagaaaacctggtggcgattcgcggcgagatcggccaactggtggaacgcatgctcgcccacggcgcgtcgtccacgcagatcacccacattattacgctgctcaacgatcacaccgtgtgccgggtgatcgagttgacgctggccgacaaaggcgaccccggcgtgcccttcagctggttgtgcttcggcagtgaaggccgccgcgagcaaaccctgttcaccgaccaggacaacggcattctgttcgacgccaaggacgccgtcgaagccgccgagattcgcggccgcttgttgcccctggcgcagcagatcaaccagagcctggcgctgtgtggcttcagcttgtgcaagggcaacatcatggccggcaaccccgagctgtgcctgtcgcgggccgaatgggcgcggcgtttcggcgcgtttatccgcgaggcgacgcctgagaacctgctggcctccagcatctatttcgatttgcgcgtggtgtggggcgacgaacagggctgcgagcaattgcgccagagcgttctggatcaagtcgcggataaccggctgtttcaacgcatgctggccgagaacgccctgcgccagcgcccgcccgttgggcgcttccgcgattttgtgctgacgcgcaaaggtggcgaaaaggccaccctggacctcaaggtgcaaggcctcacgccctttgtggatggcgcgcgcctgctggccctggccaatggcgtccacgccaataacaccttggagcgcctgcgccagctggtggccaaagaggtcatcgagcccctggacggcgccgcgtacgaagaggcctatcactttatccagcaaacccgcatgcagcagcaccagttgcaaacccgcgagaaccagccgtattccaaccgcgtcgaccccgacagccttaaccacctggaccggcgcatcctgcgtgaatccctgcgccaggcccagcgcctgcaaagcagcctgacctttcggtatcaactgtgagcctgttcgactggctgcgtacgaaaaagccagggctcgacgcagaacagcagcggcgcctggcgcaactgcccaaacccgcggtgctgggcgacggcgccttacgcagccagcgttgggtcgtggtcgacctggaaaccagcggcctgaacctcaaccgtgaccaggtgctgtccatcggcgccgtggtgatcgaggacggcgccgtggatttttcgcagatgttcgagcgcaccttgcaccgtgccgaaaccaaactcagccccagcgtgttgatccacggcctcggccccagtgcgattgccgccggcagcgacccggccgaggcgttgctggagttcatggcgtttgttggcgacagcccgttactggcattccatgcgccgttcgatcaacacatgctgtgccgcgcactcaaagacagcctgggttatcgcctggcgcatccgttcctcgacgtcgccgacatcgccccgctgctgtgccccgacgcgaatatccgcgaggccgggctggacgactggatcaaccacttcaagctgcaggtcggcgagcgccatcacgccagcgccgacgccctggccaccgcggagctgatgctcatcctgctgagtcgtgcgcgccagcagcacatcgactccccgcaggcgcttcaggcgcgcttgagccaatggaaacggcgcaaacaagcccccggtttctaagatcgttttgtaggatcgtacccacgctctgcgtgggtacgccagcggggacgctccgcgtccgcttgtggcgcaaaactcaagccccgcacaagggacgggatgcattcccacgcggagcgtgggatcgcccgcccgacagacgccaattgcgcccactgcttgcctctgacacaatcgcgaataattctcgttagtttaaacctcttgtttattcggtgatgccttgtcgtcggtccagaccccgcacagtgagcttgttggcgcgttgtatcgcgaccatcgcggctggctgttggcctggcttcgccgcaatgtggcctgcccgagccgcgccgaagacctgagccaggacacgttcatgcgcctgctgggccgtgacgaactgcgcgaaccccgcgagccccgcgcgtttctggtggccatcgccaaagggttgctgttcgactacttccgacgcgcggcgctggaacaggcctacctcaccgaattgatgctgatcccggaaagcgaacacccctcgccggaagaacagcaactgatcctcgaagacctcaaggccatcgaccgcctgctcggcaagctgtcgagcaaggcacgcgccgccttcctctataaccgcctcgacggcctgggccacgcacaaatcgccgagcgcctcggcgtgtcggtgccgcgcgtgcgccaatacctggcccagggcattcgccagtgctacgtcgcactgtacggcgagccgttgtgacggtgatcagcagcaaaccggtgtcggcgcgtgtgctggatgctgcgattgcgtggcaactgtccctggactccggcgacggcagtgccgtggaacaggaagaattcgccaaatggctggccagcgatgaagagcattcacgcgcctggcgccagttgggcatgctcgaccagcggttcagcgtggccgcaggcccggcgcgggcggcgctgttgcagtcacgcgaaggcattcgccagcgtgtgcgcaagctggggcgcggcctggcgagtatcgcgctggtctgcggcctggcgttgtttgccggcgagcgttacgtgccgatccactattggctggccgaccaacgcaccgccaccggtgagcagcgcaccctgaaactggcggacggcacgctgatcaacctcaacacccacagcgccatcgacgtgcggtttgatgaaaaacgccggctgatcgtgttgcaggaaggcgaaatcctcgtcgagactggccataacgacgctcgcccgttttatgtccaaacccgcgacggcagcctgcgcgcattgggcacgcggtttatcgtcaagcgcgaagacgacgccacgcgcctgagcgtgctgcagtccgccgtggccgcccagcctgaggcgctgcacaaggaacagattttcaagcaaggccagcaagtgctgatgcgcagcgacggcctcggcccgctgctcgccgtgacacccgccgccgacgcctggacgcgcggcatgctggtggtcgacaacgcccgcctgggcgatgtggtcgcggaactcagccgctaccgcaccggctatctgggcgtggataaaaccgtcgccgacctgcgcatcaccggcagcttcccgctgcacgacaccacgctggcgctgaacgcgctgctgccgaccctgccagtgcagattgagcagcacacgccgtggtgggtgacggttaccgccaagccctgagttttgcgcagtttgggcaatggctatcgcaggcaagccagctcccaccttgaaatgcattcccctgtgggagctggcttgcctgcgatggggccctcaagaccatcctgaaaaatatttccacccagccctatcactttttgaatctcgctcggcacataggcaattgcgaattacttccattcaggagccgccttatgtcccgcacgctagacaccttgttgcgccccagcctgttagccgtggccattgccctcagcgccccgctggccagcaccacgctgatcgccgctgaacaggcttccagcgtgcgcgcctacaacctgccggcggcgccgttggccagcaccctgaaccagatcgccagccaggccggccttgcgctgacgctgaacccttcgctggcagcgggcaagacctcggcgccagtcaagggccagttcgatgcacagggcgcgctacgcgaggcgctgcgcgggaccgggttgcagttggagcagagcagcgccgggacgtttacgttggtggcgattccggagggggttgtggcgttgccggagacgagcatcattgctcagggcaacaccgaaagtgcctggggcccggtgacaggctacttggcaacacgcaccgccgccggcaccaagaccgacaccgcactggtcgaagcaccgcgttcgatctccgtcgccacacggcagcagatgcaggatcgcaacgtccagaacctcgatgacgcggtcaaatacatgcccggcatcgtctcttccagctatggcagcgacacccgctacgactggatgcgcgtgcgcggttttgaacccacgcaattcctcgacggcctgccactgccgcgcggtgtgtacgccaacccgaaagccgaaacctggaacctcgatcgcctggccttgctgcgtggcccggcctcgtcgatctacggccaaacgccaccgggcggcctgctggacatggtcagtcgccgccccagtgctgaatcgagcaacgccgtccaagtgcaatacggcagtgacaactaccgccagatcaacttcgccagcaccggcaaaatcgatgatgaaggccagttcctgtatggcctcagcggtgtagtgcgcgatgccggcactcaggtcgaccacatcgacaacaagcgctacaacatcgcgccgagcctgacgtggaatatcgaccccgataccaagctgaccttcctgtcgcagttcactcgggacgataccggcaccaccagccagttcatgccgatccagggcaccaagataaaatcgccactgggcgaggtttcccaccacaagaacctgggcgacccggactacgagttctacgaccgtacctactacgctttgggctatgcgtttgaacaccgtttcaacgatacctggcagttcaagcagaacctgcgctacaccaaatcggaattggatttccggcaactgaccgtgggctccttcatctactccccggcagatgcggcgggcaatatcagccggtcgaccaccaacgtcgacgaaagcattggccagtttgcggtggacaacaacttccaggctgacttcgccactggcgacatcagccataccttgctgctgggcctggatcaccaacgtaccgatacctcctatcgggcgatctacggcacggcgtcaaatatcaacatcttcaacccgatcaacacccaaccgacgttacgcccgacgggtgtgcgaccgttctacgactacaaccagaaaaccgtgcaaaccggcctctacgcgcaagaccagatggccctggacaactggcgcctgacggtaggcgggcgtgaagactgggtgcatcagggcaccacctacttcaatgacaacgatgcgaccaataccgaccgcatcaaacacttcagtggcaacgcagcgctgagctatgtgttcgattcgggcttcgtaccttatttgtcctatgccgagtcgttccaaccggcgagcaacgcagatacaaatgcttccaaaacgtttaaaccgactgaaggcaagcaatgggaaacgggggtgaagtaccagccgcccggctccaatacactgctgagcgcggcggtctacgaactgacccagaagaatgtgcaggtcaccaccctcggcgcaggcggccagcaaatcaacagccagaccggcgaagtgaaggtcaaaggtctggagctggaagccgtgtctgatgtgaccgagaacctaaaggtcatcgccgcctacaccctggcaaaatccgaggtgcaaaaaggcatctacaaaggcaaccgcctgacactcatgcccaaccagcaagcctcgctgtggactgactacacctggcacaccggcgtacttgacggtttcggcatcggcttcggcgcccgctacaccggcaacacctacggcgaccaggccaacacctggctgggcaaggccaatgcctacacactcttcgacggcgccgtgcattacgacctgggccgcttggacaacagcctcaaaggcgcatcggtgaagttgaacgccaccaacttgttcaacaaggactacctttctacctgtgacggcaactactgctacttcggcgaccaacgcagcgtcgtcgccagcgccacctaccagtggtaatcggctgagttaataaccaggccgtcctccggggcggctttggtgtgtctgaaggctagaaaaatgaaaagcaaaaccatccgccgctggtccttcatccacacctggaccagcctgatctgcaccgtcttcctgttgctgctggccctcaccggcctgccgttgatcttccaccatgagatcgatcacctgctgggcaacgagccggaactggcgcagatgcctgctgacaccccgcagctgaacctcgaacaactggtggcgaaagcccaggcgcaccgccccggtgaggcgatgcaatacctggcgtgggatgaggacgacaagaacggcgtgatcgcgatcatggccgcgactgccggcaccgagcccaattcgtcgcacaccttcatgctcgatgcgcgcaccggtgaagccgtggaaacgccggccgccaacggtgggctgacgctgttcctgctgcgcctgcacgtggacatgtttgccggcctgccgggcaagttgctgctggcattcatgggcatgctgtttgtagtcgcgattgtctcgggcacggtgttgtacctgccgttcatgcgccgtttgaagttcgccaccgtgcgccaggacaagtccacgcgcctgcgctggctcgacctgcataacctgatcggcgtggtcacgctgacctgggcgttggtggtgggcgtgaccggtgtgatcagtgcctgcgccgacctgatcatcgccgcctggcgccaggacagcctcagcgcaatgatcgagccgtacaaaaacgcgccaccgctgacccaacgcgcaccggccaccgagctgctgagcatcgccgccaaagccgcgcccggcatgcagccggactttatcgccttccccggcacgcgcttttccagtgagcaccattacgcggtgttcatgaagggcagcacgcacctgacctcgcacttgctgacgccggtgctgatcgacgccagcaccctcgccgtcacggccatcgccgagcggccgtggtacatggacgccatgggcatgtcccagccgctgcactttggtgactacggcggcatgccgatgaagatcctgtgggcggtgctggatgtgctgaccatcatcgtgctcggcagcggcgtttacctgtggattgtgcggcgcaaggcggccaaggcatgaagccgcgtcagtcgaatttctggagggtgtttggcattccgctggggattggcgtgctcagtgcggccgggttgtttgcggcgttgctgggggatgggctgtgggattcgttgagttgggtcgggttgggggttcctgctgtgattggtgtgtgggcgttgttcaagcggcgcggctgagggcgccatcgcaggcaagccagctcccacagggggaatgcatttcaaggtgggagctggcttgcctgcgatgaggccctgaaaaacactcaaaagccccctcgccagccaccgcacaaccctctaggctagccactgcccatttcgaggaatgcccatgtccacgcccagcatgaccttgttccacaaccccgcctcaccctttgtgcgcaaagtccgcgtgctgctggccgagaccggccaacagggccgcgtggccttgcacggctgcatgccgacgccggtcaacccggacgcgcagctggtaaaggaaaaccccgtgggcaagatcccggccctgcgcctggccgacggctcggtgctgcacgacagccgggtgatcctcgattacctcgaccaccagcatgtcggcaacccgctgatcccccgtgacggctccgcccgctggcgccgcctgaccttggcttcgatggccgacggcatcatggatgccgccgtgctggtgcgttacgagaccgccatgcgcccggcagacaagcactgggcaccctggctggatgagcagcgcaacaagatccgccgcgctgtcgccgagcttgaggccactgcgattgccgagctggccagccacttcgatatcgccgccatcagcgtggcctgcgccttgggttacctcgacttccgccaccccgacctgcaatggcgcaccgcgaatccccagcttgccgattggtacgccaaggtcagccagcggccttcgatgctagagacccagcccccggtttgaccctctgtggtgagcgggcttcctgtggcgagcgggcttgccccgcgttgggctgcgaagcagccctaatcaagcaaaatgcggtgcatcaggtagtactcagcggctggtttcggggcggcttcgccacccaacgcggggcaagcccgctcaccacaacaagcccgctcgccacgacagccccgcttgtcacaacaggaaacagcaggttaatcctcgccaccaatcgcgtcctgacctgctgatcttcccgcaacccaatcattgccccgcctccagatcaacctgcaccttgcgcttgcccacgccataccaatccagtttgcgcgtcagcaccatcaccgtgcccagcaggccgaacaacaacagcgagcccatcagcagcgcgtaatcctcggcgctcagcaacccgtacaacaggccatacaacgccgccagccccgccgaaaaccccaggccatgggcaacactgcgcagcacatggcacacgtagaaaccaatcaacaacacgcaggcactcgccgacaacaggtacgccaggccaaagccgatgtgctcggacaacgacaacaacagcagatagaagaaggccaaggcaaagcccaccaatgcgtattggatcgggtgcaccgccaggttcttgagcacttcgaacaggaagaaaccagcaaaggtcagggcgataaacagcagtgcgtatttgatcgcgcggtcgctcttgaggtactggtccaccgggtcgatgaagctcacgccaaagctgcggctgttgaagtcgtcacacaccttgtcccactcacagccgcgcatagtttcttccaggttggtggagaagaacgtggtctgccagttggcggtaaaaccttgcgcggtgacctcacgctgggccggcagaaagttgccgataaagctggggtgcggccagttcgaggccagcttgacctggctggtcttgcccaccggcaccacttgcaactgctcggtgccttgcaggcgcaggtcgaaggcaaaatccagcggggccggttttttgctgtcttgctcgggcagcatcacgtgcacgccttcacccagccacgccacttgtgaacccggcgaaaactccagacgctggctgcccagctccagtttcaacgcattttcgatgccgcgaatatcgttgatacccaccgccagaaacgccggttcaaaacgatagtccgcaaagttttccgtaatgcccaactgcgcaggcagctcaaaacgcccgctgatgcggttgtcggcatggaacagccgcgcctggtaaatgccccgcgagcgcagctcggtttgcaccttgccgtcgagctcaaactgctccggcaggaaatacagacgaccacgcacttcgctgacttgctcgtagcgctcgttgagcttttcattgagtttccactcacggacggtcttgcgatacggcaccaccatcaccgggccggtgaggcgctggctgtagctggagctgcgggcgatgtccatcaagacgtcgtcgcgcgtctgctgacggtcgctgatgatgccgttgatcatcagcaatggaatcagcaacagcaggatcagcagcgcaatcgcgccaagtttgaaaagcaagctgcggttcatagggctctccctgttttgatgggcagagagtgagccgcgcctgtgggagatttatgtgggcaatgtggagactgtgtggagatgcagcaccacttgcacgccgccaggcacattgccgatctgcaacgcgccgccgtgcagcttcatcacttcttcgacaaagttgaggcccaggccggtgcttttgcgcccgctggccgggcgtggcagtgagtagaaacgctcgctcaggcgcggcagggcgtagtcgggaatcggcgcggcctggttgaacaggctgacctgcacgtcgttgtgctgagtgtgcgcactgaagcgcaaggtgccgcccggtggcgtgaagtccagggcgttatccagcaagttgcccaaggcctggcgcaacaggaaaggctcgccgaacaccttcacatccgcgccaatcgcctgttcgacgtgcaagccggcgccttcgatgcgcgcgcactgagccttgagcacctcgtcgaccaaggtggccagcggcatactgatttgctcttccaggccttggcgctgctccacttgggccaggttcagcaagcgttcgatcaactgctgcaaacgcgcgctttcactgtcgatattgccgacaaagcgctgctgctgctcgcggctcatgtcgccctgcagcagctccgccgcgccgcgaatcgccgccagcgggcttttcagctcatgggtgagggtgtgcacgtaatgctcgacgtaggccttgccctccaactgcgtgcgcatgtgctccacggcggtggacagctgcttgagttcgccaccgcgataatgcggcagctcggcgcgccgaccttcgctcaccgcctgggcataggcggtcaaccggtgcaacgcgcggctcagccaccaggacaacagtgcgcccagcagcaggcccaacaccaccagcccggcgccgtaccacagcaggcgatgttcggtgcggtcgacatagggctgcaacgagctgttgggcttggccacagtgaccacgccaatgatctggccgttgtctcggatcggcgcgcccacgtgcatcaccgatgagttagggtcatccagttcgcttttggtcgaccgcgcaccatattcgccgcgcagggtcaggtacacgtcattccatttggaatagtcctggccgaccgcctcgcccgtggagtcgagcaacacaatgcccttggcgtcggtgacgtagatgcggtggttgacctggtttttcggcaggccccaaatggtcgcacccggttgccggctgccgtaggccttgagcagctccggccagtggctttggccgagggtgccgttcttcacatccagccgcaggatctcggccagcaggttggcggtgtccaccagggtttcttcggttgactggcgcacgccagggcggatctctttcatcaccgtgttgagcacgaagtagccggtcaggctgataaacagcgcgtacaccaggaaaatccgcagccccaggcgcatcagctgtggctcgggctgtagctgtagccgaggccgcgatgggtctggatcggctcggcatcggcggccacgctacgcagtttgctgcgcaggcttttgatatggctgtcgatattgcgctcgtagccggcatcggcgggcacgcccactgcatcgagcaattgctcgcggctgaacacgcgctcgggttgctcgagcaggctttgcagcaggcggaattcgtggcgggtcaggctcaaaggctggccgcgatactggatttgcatgcgctccaggtcgatctgaaacacgctgggcgccacacccgggccgacgcgtttgaggatcgcccgcacccgcgccgccacttcccgtgggctgaacggtttgaccacataatcgtcggcgccgatctctaggcccactacccgatcaatctcggcatcccgcgcgctgaggaacatcaccggtacttcgctgaaacgccgcaattgcttgcaggtttcaaagccgctgatgtccggcaggccgatgtcgaggatgatcaagtcggcgggcgtctggcgctgatgggccagcgcctcctggccgaggctcagccaggtggtggtgaagccctcgccctgcagggcgaaaatcagcgtgtcggcaatcgccgcttcgtcttcgacaatcaggatatgcggcatgtgggtccgtcagcagtccggtttgtcagcagtgtaacgacgcgccgggttcaccgctgcaccgaattcacgcagggccttggcgccgatcagcagcgggtagttgaagctgctgcggtcggtgaggttgacctcgacggtacgcttgacgtcgcccaggcacatttccaggtcgatcaccgggcgcttggccacggtggcttcgtccttgtcatcgtcttcgtcggcgcggctcttgatcttgctgatgcgcgagactttgtgttcgtagactttgttggaggcgtccttgccgccgaggcggaagcgcacccaatcgtcgccatcgcgggtgaaggtctcgatgtcacgggccgacagcgaagcggtcagcgcgccggtgtccatcttggccttgaaggtttcgccgatctccggcaactggatgtattcgtagcgaccgtagagggtcggttcggcagccatgaccggcagagccactaaggcaaacgcagcaaggagcaatttcacgaagtgatttcctcgaaagaagtaggcggattctagaccgcaaaagcaacacttagttagccccgccatcagcagctcgctcccacgctctgcgtgggaacgatcagcatagccttcacattgtgaaacattcgtacggcgatttgcgatttggcctataggccaggcttgcttatcatggcccgcccacagaattccaagagttacttatgcgccgcctgctcaccggctgtttcgtcaccctgctgctactgctcaacaccctggtgctgtttgggccgctgatggtgtttgccctgctcaagctggtagcgccagggcgctatcgcgactatgcctcgtgggccgtgatgtggatcgccgagacctgggccgaaatcgacaagctgatcttcgcgctgtgcatcccgacccaatgggagattcgcggcggcggcgacctgcgcggcgacacctcttacctggtgatcagcaaccaccaatcctgggtcgacattccggcgctgatccaggcgcttaaccggcgcacgccgttcttcaaattcttcctgaaaaaagagctgatctgggtgcccttcctgggcctggcctggtgggcgctggactaccccttcatgaagcgctacaccaaggcgttcctggccaaacaccctgagctggcgggccaggaccttaaagtcaccaaagaagcgtgtgagctgttcaagcgccagccggtgaccgtggtgaactacctggaaggcacgcggttcagcgaggccaaacgcacacagcaggcgtctccctttgcgcggctgctaaagcccaaggcgggcggcgtggcgttcgtgctggcggcgctgggcgaacagctggacgcagtgctcgacgtgaccgttgtctatccgcaacaaaagattccagggttctgggatttgatcagcggcgcggtgccgaaagtgatcatcgacattcgcactcgcgagctcgacccggcgctgtggcagggcgattacgagaatgatccggcgtttcgccagaccgtccagaactgggtgaaccagctctggatggagaaagatgcgcgcatcgagcaactgcgcgcggagcgtatttagctgccagtgccccaggccgaggccagtttgcccagcaccgattcgttggcgccctggccgcccaagtattgcaggatcaccggcgcaaacttgccgatcatgctgttatccatgcccagtgcgctgaacgcggtgttcaggtcgctggtgctcttcacgttacccagcacgctgtccaggccgctggtcttgctgccgccgctctggccgagcagcccgctcaaggcgccgaggctgcccagggaattgctccccgagagttggtccaggccgggcacgctcttgcccagttgcgaatagtcattgccgctcagtttgtttttggccaggcccaacatcgcgccggtgccgcccacggcttgttcgggggtgacgttcagttgcgaggtcaaggcgctcagcaggcctgcggtctcggaactcggcgctgcggcagcggccttgtcattgctgccctgggcaccggagacggcgttagccacgtcgccgaggctgaaacctgccgcaaacaccgggctggcagccacggtcatcaggcaggacagggcaaaaccgcgtgaaatcttcatcaagacaacctctgaatgtaagagctaaaagcaggcgttggactgacagtcccgaaggattgttcccacttggagattagttcagaaaacgccgcatccaaatgccacgcctgcgcgtatatccaccatgcgccgcccggagttggatggaatgaatgcacaagctggactaccctctgcctaccgtgcgcaattccgtcgccctcgttcgagagcctggagaagccctatttcgatcaacgatgctgaccccttgcagcctctgctggcccagtgcgccttgggcaaccgccaggcattcgagaccctttaccgcagcgtttcgccacggctgcacggtgttgcgttgcgtttcatggggcgcaccgacctggccgaagaagtgctgcaggaggcctttgtgcgcatctggtacaacgcttcgcgctacgaagcccatctggcggcgcccatgacctggatggtgaacatcacccgcaacctggccatcgaccaattgcgcaaacaccgcgaacagcccttggccgacggccagcaagacgccctgctcgacgacagccccagcgcccacgaacaactcgaaagcctgcgcgaagcccgcgccctcaaccgctgcctcgacacactcgacggcatgcagcgccagtcgatcaccgtggcttacttccagggcctgtcgtgctcggaactggccgaacacttggccgcgcccctgggctcggtcaaatcctggattcgccgcggcatggagcgcctgcgcaggtgccttgaatcatgaactaccaaaccaccgccctgcgccgcgccctggccgccgactatgccatcgggctgatgcccgcgaccgcccgtcggcgcttcgacgccctgttactggaagacgccgcgctacgcgttgaactcggccattggcaggacgccctcgccagcctgaccggcgcactgcccgagcgaccggtgcccgaccacgtgtgggccggcatcaaggcacgcatcgaaccgcaagtactgcatgtgccggcgaagaagccgttctggatgagcgttcgcctgctggcggccgcctgcgcggtggtcgtcgccgtgctggtgggtgtgctttatcaacgtgatatcggcgccgagtacaacgccacgctggtggcggcgaatcagcaaccagcgctgcagattcaggcctttggtgatcatctgcaggtggagccgttgacgttggcggctgtcgagccgacgcgtgccctggaattgtgggcaattgcgcccggcggcaaaccgatttctctgggtttggtgcccacctcgggtaaaggccgcatccagttgagcaaagaacagcaagcgctgttgaccgcccccgtgaccctcgccgtcagcctggagccacaaggcggttcaccgaccggccaaccaaccggaccagtcctgtaccaaggcgcactcgcctcgcgctgacgccccataaatccctgtgggagctggcttgcctgcgatagcggtgggtcagccagagacaggttggctggccgaccgcaatcgcaggcaagccagctcccacagttgatcttcatcggctgggcgacttgctcctggcgatggatggcgcttatagttctgcggtcgtccacatggcgacacgggtttggcgactcgattgaaataatgcatgcaaaagcacctgctcctttgcaggtttttttgtacgcgtaaagctgcttcatggcggctgtgcgcgggagaccttcgggtctgccggcctttgctttatttcaccggttcgccaacctgcgtacagctgccacccattcgtttggcgacgtgtgagtggtagccccactctctgaaataaaggttaaaacatgaaccgatacatgccgctcaccggccacgacagcaccaccccttccctgcttatcgacacccaagtcccgctcgacgtactccacgatgccgccgtctaccgcatccgcgcggtgactcaagtcatggaaaacctcgcgtttcgcgaaggcctgaacaccgacaaccttgtcctccaggacttcgccctgctttgcgccattccattgcgtgacgggtgtgacctgctggatgtgatcagccgacgcttgcaggcctaaacaccagacgcaaaaagggcgacctacaggtcgcccttttatttggcctaagccttacgccgcactgaacaacttatgcggatcaatcacaaatttcttcggcacacccgcatcaaactcgccatacccgcgtggcgcgtcatccaggctgattacctgcacacccacgatctcagcaatgttgatgcggtcccacatgatcgcctgcatcaactggcggttgtacttcatcaccggcgtttgcccggtgtggaagctgtgggatttggcccagcccaggccaaagcgaatgctcaggctgcccatttttgcggcggcgtcgacggcgcctgggtcttcagtgacgtacaggcctgggataccgattttgcctgccacgcgcaccacgcccatcagcgagttgagcacggtggccggggcttcggccttggcgccttcatggccgtggccacgggcttcgaagcctaccgcgtcgacggcgcagtcgacttccggctcgcccagcagcgcggcgatctgttcgtgcaatggggtgtctttggacaggtcggcaatttcaaaaccctgagccttggcgtgggccaggcggatcgggttgacgtcgccgatgatcactaccgctgcaccgagtagacgggcggaggcggcagcggccaggccgacagggccggcgccggcgatgtagacggtgctgcctgggccaacgccggcagtgacggcgccgtggtaaccggtcggcaggatgtcggagaggcaggtcaggtcgcggattttctccatggccttgtcgcggtccggcagtttcagcaggttgaagtcggcgtaaggcaccagcacgtattcggcctggccgccggtccagtcgcccatgtcgacatagccataggcgccaccggcacgggccgggttgacggtcaggcacacgccggtgtgttgttccttgcacgaacggcagcggccgcacgccacgttgaacggcaccgagaccaggtcaccgattttcaggttttcgacgtcgctgcccttctcgatcacttcgccggtgatttcgtgccccaggaccaggccggtctgggcggtggtgcggccgcgcaccatgtgttggtcggagccgcagatgttggtggagaccacgcgcaggatgacgccgtgctcaatcttcctgccacgggggtcctgcattttgggatagtcgattttctgtacttcgaccttgccgttgccgagatacacgacaccacgattaccagacatgctttcacctcgctgttgtttttatggaaccgcgtcgcccaggcaggcagcgcgtttaagtgctcgggtacagatgctgtttttgcgttgttttttggggcctcatcgcgggcaagcccggctcccacattttttgaagtgtgaatacagtcccctgtgggagctggcttgcctgcgatggcgatctaaagaacgacagtgcgattggcgttcaaaaacacccgccgctcaatgtgataccccaccgcccgggccaatgtcagcccttcgatatcccgccccttggcaatcaaatcctcgggatagtggctgtgatccaccacttccacgccctgggcgatgatcgggccttcgtccaggtcgttgttgatgtaatgcgccgtggcgccgaccaacttcacacccttgttgtaagcctggtgatacggcttggcgcccttgaaccccggcagcaatgagtggtgaatgttgatcgccttgccatccagtttgcggcacagctccggcgacagcacttgcatgtagcgcgcgagaatcaccagttcggcgccggtctcttctatcacttgccacacctgacgctcctgggacggtttgtcgttggggtcaagggggaaatggtagtagggaatctggtgccagtcggccaacggcttcaaatccgggtgattggagaccacggcgaccacgtccatcgacagttggccgatgcgctggcggtacagcaggtcgttgaggcagtgatcggccttggagaccatgatcaccacttttggccggtagttcggcgccgtcagttcgaagatcatgccgaaggcttcgccgcgcgtggccaggccagcacggaaagcctgctcgtcaaaaccgtcgggctgacggaattcgacgcgaataaaaaaccggcccgagaggcggtcatcgaacgagtggtgctcggtgacgtagcaaccctgttcgaacaggtagcgggtgaccgcgtccaccgtgccgagcacgctggggcagtcggcagtcaaaatccatgtatcgggtgcgcggctcatagtggaatcctcaggccttcgtggcgagggggcttgtcccccgttgggctgcgaagcggccccaaaacctgccgctgggttatttcaggaaaaatgcgctgaccttgttgggaccgctgcgcgctccaacggggggcaagccccctcgccacaacagccctcttgtgctcattcctcaggcctggacgctcaggccgaattcggccgaggcgtcctgcagccataaccaccagtaatccgagaagctgcgacgaatcaccagctcccaagtgtcttcagcggtgtggcggatcaccagttgcgacttggcgaacaccgtgcccactgccttgcccaccgggaagttgttggggtgcacgtcgtagctggtggacttcatcagcacgtcgcgcacgttcgggccgctgagttcgaggatctgctggccgccgctgacgttgacgatctggatgtgcaaatcgccgagggccgcccgcaggttttgttcggcggcgaattcttcaccgctgggcaccaccagcagccactcatccgggccgagccattgcaggctggtttcgcctttgacgatgacctgcagggcgccgggcggttcgatgccgagggccttgtgcacaccggcagcgaaggccgcgtcatggccatcgccacggagggtcaggtggccgagaagtttcttttcacgcacggtcacgccggcgtttttgcggcccttgccgaccaggctggcgaggtcggcatggtgcagcgacgactcggccttggcgccggaggtggggcgttgttggtaaacattggctgctgtcataaagcacctgtgttgaatttgatcgttcccacgctctgcgtgggaatgccgccatggacgctctgcgtccgctctttgggcgcagagcgccccgggatgcattcccacgcagagcgtgggaacgatcaggtgtcagacgttctggcgatcacctttcgggtcaaagaacaccgaagacacaatctccgcctcgatcacgctgccatccgcttgcggcgaaaacactcgctcgccgatgcgcttcaagccgcccttcaccaccgccatcgcgaacgaataacccagcgagttatgcgcatagcttgaagtcacgtggccgaccatcttcatcggaatcgactgcttcggatccagcaccagctgcgcgccttccggcagccacacggttgggtcaatcggcttcaagcccaccagctgcttacgctcttcacgcacgcaatcttcacggttcatcccgcgccagccgatccacgagaacggtttggtgcggcctacacaccagcccatgttcaggtcgtccggggtcatcgagccgtcagtgtcctggccgacaatgatgaaacccttctcggcgcgcagcacgtgcatggtctcggtgccgtatggcgtcaggttgtactttttgccggcctcgacgattttttccagcacgcccatggcgtagtcggcctgcacgttgacttcgtacgacagctcaccggtaaacgagatacggaacacccgcgccggcacgccgccgaccaggccttctttccaggtcatgaacgggaagccgtccttgtccaggtcgatgtcggtgacctcactcagcaacttgcggctgttggggccggacaaggtcatggtcgcccagtggtcggtgaccgaggtgaagtacaccttgaggtctggccattcggtctgttggtagatttccagccactgcagcacgcgggccgcgccgccggtggtggtggtcatcaggaagtggttgtcggcgaggcaggcagtcacgccgtcgtcgaagaccatgccatcttccttgcacatcaggccgtagcgcgccttgcccacgtcgagcttggtccaggcgttgctgtagatgcggttgaggaattcgcgggcatccgggccttgaatgtcgatcttgccgagggtggacgcatccagcaggccgacgctgtcgcgcacggccaggcattcgcgtttcaccgcggcgtgcaggtcttcaccgttgcgcgggaaataccatgggcgtttccactggccgacgtcttcaaactcggcgccgtttttcacgtgccaggcgtgcagcgcggtgtagcgcaccggctcgaagatgtgcccacagtgacggcccgcgacagcgccgaaggtgaccggcgtgtagttggggcggaacatcgtggtgcccatctgcgggatggtcacgttgagcgaacgggcggcgatggccaggccgttgacgttgccgagcttgccctggtcggtgccgaagcccagtgcggtgtagcgtttgacgtgctcgaccgactcaaaaccttcgcgggtggcgagttcgatggcggcggcggtcacgtcgttttgcaggtcgacaaattgcttcggcgcccgtgcggtagctttttcatgcggcacctggaacagcgccagggtcggctcttcgagacggctcaaggctttcggcagtgtgccttccaccggcgtgaaaccggcttcgctggcggcgcgcacgccgccttcaaaaccatccgccagggaatcgcccaggccgtagacgccattgatgccgccgacgcacacgcgtttttgcggtgcttcgcccggcacaaaaccgaggatgtcttcacgccaggttggcttgccgcccaagtgcgaggccaagtgaaccaccgggctgtagccgccggagctggcgaccaggtcgcagtccagccactcgccggggctggtgactttgtgggctttgacatcgatggccgccacgcgcgcgccggtcacgtgcttgctgccacgcgcctcgatcacggcgctgccggtgaggatgcgaatgcctttcgcgcgggcttcttcaaccagcgcgccacgtgggttgtggcgggcatcggcgacggcgacgacactgaggccggcgtcaaaccagtccagcgccacgcggtaggcgtggtcgttgttggtcgacagcaccagctttttacccggtgccacgccgtagcgacgcacgtaagtcgagaccgcaccggcgagcatgttgcccggcacgtcgttgttgccgtacaccaatgggcgctcgcacgcgccggtcgccagcaccacacgcttggcgcgcacccggtgaatgcgctggcgcaccacaccaatcggcgcacggtcgccgaggtgatcggtgaggcgttcgtgaatggtcaggaagttatggtcgtggtagccgttgaccgtagcgcggggcagcagcaccacatcgtgcaaggctttcagctcagcaatcacgctggcaacccactcggcggcaggcttgccgtcgaggctttcgcgcgagtccagcaaagagccgccgaactcttcctgctcgtcagcaatgatcacccgagcgccgctgcgcgcagccgccaacgcagcggccaggccggctgggcctgcgcccacaatcagcacgtcgcagtgacggttcatgttgtcgtaggtgtccgggtcgttctcggtcggcgagcggccaaggccagccgctttacggatgtacttctcgtacgtcatccagaacgattgcgggtacatgaaggttttgtagtagaaacccggcggcatcagcttgccgccgaccttgccgagaatgcccatcatgtcgttgttcacgctcggccagccgttggtgctggtggcgaccaaaccctggtacagcgcctgttgcgtggcgcgcacgttggggatttgcgtggcttcggtagcgccgatctgcagcaccgcgttgggctcttcggcaccggcggcaaagatgccgcgtgggcgcgaatacttgaagctgcggccgatgatatcgacgccgttggccagcaaggcggcggccagggtgtcgccttcaaagcctttgtagctctgaccgttaaaggtaaaggtcagggctttattgcggtcgatgcggccaccgttggacaggcgattgatctggctcataccttctctccagaagccttggcggtaaattgcggcttctcgccgatcttgtaggtttcaagtatttcgtaggtcagcgtgtcgcgcgtggcgttgaaatactggcggcacccggcagcgtgaatccacagttcgtggtgcaggccacgcgggttgtcgcgaaagaacatgtagtcgccccactcttcatcggtgcaggcattcgggtccagcgggcgcgggatgtgcgcttggccggacgcgtggaattcctcttcggagcgcagttcgccacagtgaggacagaagatatgcaacatagggaatttctcctgttagtgggcgacggccgcagcgccgtgttcgtcgatcaaggcaccgttgtggaaacggtcgatggaaaaaggggctgccaatgggtgcatttcacccttggccaggcttgcggcaaacacgttgcccgagcccggcgtggccttgaagccaccggtgccccaaccgcagttgaagaacatgttcggcacgggggttttggagatgatcgggcacgcatccggcgtggtgtcgacgatgccgccccactgacggttcatgcgcacgcgggacagcaccgggaacatctcgacgatggcctggatggtgtgttcgatcaccgggtacgagccgcgctggccgtagccgttgtagccgtcgataccggcgccgatcaccaggtcgcccttgtcggactggctgatgtagccgtgcacggcgttggacatgatcacgctgtcgataatcggcttgatcggctcggagacgagcgcttgcaacgggtgggattcgattggcaggcggaaaccggccagcgacgccatgtgcccggagttaccggcggtcaccacaccgacgcgcttggcgccgataaagcctttgttggtttcgacgccgatgcacacgccgttttccttgcggaagccgatcacttcggtctgctggatcaagtccacgccgagtgcatccgccgcgcgggcaaagccccaggccacggcatcgtgacgggccacgccgccacgccgttgcacagtggcgccgagtaccgggtagcgggtgtttttcgagcagtcgaggtacgggatctcgtcggccacttgcttggcgttgagcagttcgccgtcgacgccgttgaggcggttggcgctgacgcgacgctcggaatcacggatgtcttgcagggtgtggcacaggttgtagacgccacgctgggagaacatcacgttgtagttcaggtcctgtgacaggccttcccacagtttcatcgcgtgttcgtacaggtgcgccgactcgtcccacaggtagttggaacgcacgatggtggtgttgcgcgcggtgttaccgccgcccagccagcctttttcgaccacggccacgttggtgatgccgtgttctttggccaggtagtaagcggttgccagaccatgcccgccgccgccgacgatgaccacgtcgtagacctttttaggggtcggcgtgcgccacatcttctgccagttttcgtggtggctgagtgagtgtttgaagaggccgaagcccgagtagcgttgcatagtcattactccaaaaccgcgctcagcgataaaccgggaaatcagcgcacagggcagacacgtgcttggccacgttggcctcgacgtcggcgtcgccgaggttgtcgaggatgtcgcagatccagcccgccaactcgatgcattgcggcactttgaaaccgcgcgtggtcaccgccggggtgccgatacgcaggccagaggtcacaaacggcgactgcgggtcattcggcacggcgttcttgttgacggtgatgtgagcgcgaccgagggcggcatccgcctctttgccggtgaggccctggcggatcaggctgaccaggaacaggtggttgtcggtgccgccggacactacgtcataaccgcgctggatgaacacgctggccatggcctgggcgttgtcgatcacctgttgctggtaggccttgaagccaggctccgccgcttccttgaagcacacggccttgccggcgatcacgtgcatcagcgggccgccctgggcaccggggaataccgcagcgttgagttttttctcgatctcttcgttggccttggccaggatcaggccgccacggggaccgcgcagggttttgtgggtggtggtggtgaccacatcagcgtacggcagcgggttcgggtacaggccggcggcaaccaggccggcgacgtgggccatgtcgacgaacagcagcgcaccgaccttgtcggcgatggcgcgaaaacgcgggaaatccagagtcttggagtaggcagagaacccagccacgaccatcttcggcttgtgctccacggccaagcgctcgacttcgtcgtagtcgatcagcccggtgtcggtgttgatgccgtactgcacagcgttatagagcttgcccgaggacgacactttggcgccgtgggtcaagtggccgccgtgagccaggctcatgccgaggatggtgtcgccagcgttcaacagtgccaggtacaccgcgctgttggcggaagaaccggagtgcggctgcacgttggcgtaatcggcgccgaacagttgcttggcgcgttcgatggccagggcttcaaccttgtcgacgtgctcgcagccgccgtagtagcgcttgccagggtagccttcggcgtatttgttggtgaggccgctgccctgggcttccatcacgcgtttgctggtgtagttctctgacgcgatcagctcgatatgatcttcctgacgctgctcctcggcattcatcgccgccagcaacgcgtcgtcatatccctggatctggtcttttttgctgaacatcgcgtctctcccagcctttcgtattgttgaggcccgtgcagagccctttgatgcgatggtagggctggtgcacacaggtcaaatgcctacggacgccacgcaaaggtgcgtttacgacatggcctggcgcgcaggcgaacaaagcgccgggattgctcatgtcataccagcagcagggatggaaaaaaccacccactcgcacaaaacaccaaaaagctagctacgcttgccactcaaacagcgccagctcatgcattcgacgcgttcaccgttcaatccgaaagattgaacgccccccgtcgaggaaacaggcatggcgctacttaaccaagttattgatatctgcaaacgtctggcgccccatggctggcgaaacctgttgcttggccatggtctcgacatcctcgcgcccaaccttgacgccgaactgggtaaaccgctgaccccaaaccggacacttggcggttttaaagactttgccttgaccggaacgcgcggtattgagcctggcaaacccgcacacagcctgctctaccacgccctggccaacgccaatgtgaccaccgacgccagcggcaacccactgcaggcctttgccacgccggcagaacttgaaaccgtcctcaactacgtctacggccgccagccgcccagccttgcgcaattgcaggcacgtgcgaatgggcacccgatggcggtggtggtgttcgcggtcgagtaccgcccggcaccggacacggtgcacaaggcccacgccgatttgtgtttttcgcgtaccggcatcgcgcgggtgggcactaaggccccgttgtacgacgcgcctagccgaggtttcctgccgtttgtagaaggggaaaaccacgccattcgagtgctgcctgcgcgctacagcgcctacatcgcggtccagctcaaaggcgaccgtgcccatttcggcccgatgcgctttggcgcagcagatgcaaccggtgatttctgggtgccgctgcataaactgttcaatggcagtgagtgtttggctggcatgacccttgatctcaatctgcacgcacagcataaaaacgaaaagttacgccgcatacacttggagttggcacccgattccggctggggtgagccccatatcaaccaaccgcccttcatcaccaccgaaggcctcgcggactggctgcctgagccagcgtatggcccaggattaatggccgccacgccccatgaacatctgactgaagccgcccgatacctgggtaaaccgttgacgttcaacgtgcctgaagacgctgggctcctggcttccagcttgtcactggacggaaatgcgccggagttcgtgcatattcgccataaagtcgatgacgcgggcaacgtcatcaatctcaatcgccgggccggcatgtttgaggagttgcagaagggcaattacaaggccctgcactacgtggactttaccgccgatggccgaatccaggctcagtgcgcagcgctggaccacgccattccacagcgtgtggctgcgtactcattggtttgcgcacctgacttttatcctctgtgcaagcagcgccacctgatggagtggctcgaaagcctggaccggcttactcagctcacgatgttccgcgcgcaaccgcagtgcctgtccgacactcgtatgcccgccaatatccagtcttttcccgagtccttttccagtacggacgtcagcattactgcaatcgttgcccaatttgatacttcgcctgccatggccacgcttcagccgagcgtcccgtctgcaaggtgcgcctcgtgtcttcccgatgcaggttcaggggtgttcgcacccggctgggatattggcgtcggtttttacccagaggattcgagcggcattgaacacctggcggctttcaggctgggcagcccatttcccgaagatgcaaagctgtgtgcagccctgagttctttctggcccgccgttgcacccgactcagcgcaatcctatgagccgaatgccggcgccgggccgaccatcaaaccgatgctggaccaggagatcggcaaaaatgccgggctcccctgggacggtgtgcccgcagcgaaaaaatatatcgccaatagcgccacccatcgggcctacgagactttccgctacaccgactatgtggaaaacgcgctcaacggcaagttctcgctggcgctgacgggcaaagtcgactcgcaggaatatcaacgccgtgtcgatgccttgcgacgggtcaggctgtcattgggcgccaacgccagggattggtttatcgactcgttcaacactgcaacaccggacgagtcccacatagtcactctcaacactaacgttaccgttacgccgaatgacgtgggttatcgctttgagctgtttcgctatgaacgggtgacatcgcccgcgttcgaccaagtgcgtatcaaactcacggaaacgtttacttacctggtatggccgcaggttgtcttgcgtcagcagggcatcaagccctggcagcgcgtttagaacatgccaggccaggccccatgaagcactacgacgtcatcatcctgggtgcaggcgcggccgggtgtgcggcggccatttcgtgcgctcaacacggcctgaaagtggccgttatcgagcgcctgctgtttccacgcgcacgccctggcgaaaccttgcatccgggcatagagcctttgcttgcgcaactgggcgtggctgaacacattcgcggcgatgcattcatccgtcctgcggggacctgggtgcagtgggatcaagagcgacgctttgttccatttggcgaagataaagacgggccctggcgagggtttcagattcccagggcgacgctcgatgggttgctgttggatcaagccatcgcatccggcgtgcatgccctgcaaccctgccaggcaaaacaggtgttagtggaaaagggccgcgtcatcggcattcggacccagacagagaatgtgtattgcaggcacttggttgatgcgagtggcgctcacggttggctggctcgccaactggggcttaccgcgcgtcgctactcaccgccgttgaccgccgtgtatggctacaagcgtggctcggtggaagaaacggcactcggcatcttcgcggatcaatcgggttggtattggacagctcacatcggccaggggctttatcactggacgcgactgcgctttgcccaagacaagcagcccaaggcgtcagcggtgccggcctgcctggaacaactggcctgtgagggcgccatccagggtgccgatgtcacctggagacgctgtgatcaagcggccggcaacggctatttcatcatcggcgatgccgccagtgtgttggacccaggcgcctctcacggcgtactcaaggcgctgatgtcgggcatgatggccgcacgctgtatcgccgatgaaacggccagccccgcgcatagacgcgaaatctcgctgcactattgccaatggctgcgggattggttcgagcacgatgtgcaaaaaatgcgcgcgttctacgccgctcatccgtttgctcctgattggctcaacgcgacgtcagccaatggccttgcggactaccaacaagagtaaaaaatgcaccgggtacaaggcgtaggcccaccggcgcatggcgggtacagtgacatatttggcgcggcgcaaaagcagcaaccccgtcaatggcgcgatcaggcaggcagccagccccagcagcgcaatcacgctgccactgctgagcagaatctgccattggttggcagccacgcagaccaaccccggtaacacgctgaaataccatgggcggctgaacaccagcagcatcgccaacggcaacaacacaccgaagaaaccgaacatcagctgcgtcgaaaacacacccgccagtatcagggcaagcagcgccaaccctcggtcaaaaagcgccttctgctgccatcctctggcaaccagcagccccaacgccaacgtcggcaatacattcaacgtatcggcatcgtcgataaacatccggtacggcacttcgctgatcacactgaacagcagcagccagcccaagtagcgccattggccggtcacgggcgaatttcggacacggtgcaaattggccgcaatcgccaggcaaaaccatggaaacgccaggcgccccggcacatacaggccatccaggctcagcccgacatagcgcagatggtccagcaccatgctcagcagcgccaaccacttgagcaaatccagggcgccatcgcgcaagcgtccgacaggcatcgtttgtgtaccgtgcataattccccagtgactttgcatttacagtgcgtgcgcacccgcgacaatcttggttacagtgcgcaccaacatcgaccacaggaatgggccatgaccgacaagagccaacaattcgccagcgacaactattccggcatctgcccggaagcctgggccgccatggaactcgccaaccagggccatcaacgcgcctacggcgatgatgaatggacccaccgcgccgccgacggtttccgtaatctgttcgaaaccgactgcgaagtcttcttcgccttcaacggcaccgccgccaactccctggcactgtcctcgttgtgtcagagctaccatagcgtgatttgctcggaaaccgcccacgtcgaaaccgacgaatgcggcgcgccggagtttttctccaacggctccaagctgctcactgcccgcaccgaaaacggcaagctgaccccggaatcgatccgcgagatcgccctcaagcgtcaggacattcactaccccaagccgcgcgtggtcaccctgacccaagccactgaagtcggcagcgtgtacaccccggaagaaatccgcgcgatcagtgtcacctgcaaagagttgggcctgaacctgcacatggacggcgcacgtttctccaacgcctgcgccttcctcggctgctcgccggccgacctgacctggaaggccggtgtggacgtgctgtgcttcggcggcacgaaaaacggcatggcggtgggtgaagccatcctgttcttcaaccacaaactggctgaagacttcgactaccgctgcaaacaggccggccagctggcatcgaaaatgcgcttcctctccgcgccctgggtgggcttgctggaaaacgacgcctggctcaaacacgcccgccacgccaaccactgcgctcaactgctgagcagcctggtggcggatattcctggcgtggagttgatgttcccggtacaggccaacggcgtgttcctacagctctcggaagcggccatcgtggcgctgacggccaagggctggcgcttctacaccttcatcggcaaaggcggcgcgcgcttcatgtgtgcgtgggatacagaggaagagcgtgtaagagaattagccgcggatattcggacagtgatgggcgcctaggcgcgacgaatactggcgaattgccgagactgttatttggtatttccgacagcagccaaccctattttcatcgactagcctcttggaacccgaaaggaaaacgccgctgcagcggccacctttcgggtacaactgcctgccgaataatcggccggaaacggaaatccagcagagggttagaccatggaagttcaatgctacgccgccaaagcgcaacaagacggcagcctcagcaacacgttcgtaagctgggacgagttccgaaaactggcgaacgtcggtgacaccatcagggagccttcaagaaccctgaccatctatgaaaaaaccttcgaactgacagcctccggcgatcagttctccatccaactctacgcccgttaatacctaaccagccggatcgttcccacgctctgcgtgggaatgcctccccggacgctctgcgtccacgccacaactcgattcaaggacgactggatgggtagaagccgctacgtcatcaccgaacccgaaaaaccgcatttcctgacgtgtactgtcatggagtggctaccgctatttacccgcgactacctcgtgggccatctcttggattgttggcgatatcagcaaaagcaccatgcgctacgcctgtttggctacgtcattctcgaaaaccacctgcacttcgtcgcgcaagcgcctgatctgtgcaagtgcgtcagtcaattcaaatccttcactgctcgcaccctcatcgacgacctgcagcgcaaaggtgccgagcgggtattacaacgcctacgcttcagcaaacgggcacacaaggcagatcgggtttatcaactttggcaggaaggctcacatgccgaactggtctacagcgagacagtgatgcgccaaaaacttgattacatccaccacaacccggtaaagcgcgggtatgtggacttagctgagcactggcgatattccagcgcccgtaattacgccggacgggaggggttaatagacatacaaaggtggtactgaaggcgggacgcggagcgtcccatgaggcattcccacgcggagcgtgggaacgatcggatgcggggagtcagaactgatgatcgtccccacgctctgcgtgggaatgcagcccgtgacgctctgcgtcacaactgaaggcgggacgcggagcgtcccaagaggcattcccacgcggagcgtgggaacgatcgggtgtggggagtcagaacatgatcgtccccacgctctgcgtgggaatgcagcccgtgacgctctgcgtcacaactgaaggcgggacgcggagcgtcccaagaggcattcccacgcggagcgtgggaacgatcgggtgtggggagtcagaacatgatcgtccccacgctctgcgtgggaatgcagcccgtgacgctctgcgtcacaactgaaggcgggacgcggagcgtcccaagaggcgttaccacgcggagcgtgggaacgatcggatcggcgtcgatcacgtggaaggttagaactcgatacgcacgtcgcccttcggcacgctgcagcacgacaggatgtagccttcggcttcgtcttcttcggtgatgccgccgttgtggtccatctcgacctccccgcccagcttcatcaccttgcaggtgccgcaaatccccatgccgcaggcttttggaatcattagcccaagtttggctgccgctgcgtggacggtttcgcctggcgccacacggatgcttttgcccgaggcgataaattcgacttgatgcaagtcggccaaatcgatttccggcgcttcggcggcttgttcggcctgctcgaccgcatcggcacgcgcctccggtggcgtggcaccgaaggattcctcgtgatagcgcgccatgtcgaagcccgccgcttccagcaggcgctttaccgcgttcatgtatggcgtagggccgcagcagaatacttcgcgctcaaggaaatccggcaccatcagttcgagcatcttgtggttcaggtagccgcgataacccgcccaaggctcgccaaggccgtgtttctcgcagatcaggtgcaggctgaagttgtcgatccgcgacgccatgtgctccagctcgcggtggtaaatgatgtctttgggcgagcgcgcgctgtggataaaggtcatgtcgacattggcgttagtgtcgtaataccaacgcgccatggacatcaccggcgtaatgccgacaccgccgctgagataaaggactttggggttgctgaagtcgatggcattgaacaacccgaccggcccgtgcaccgccagctcctggccttcatgcagcgtgtcgtgcagccagttggaaaccttgccgcccggcacccgcttgatcgtcaccgagaagctgtacggcaccgacggcgaactggaaatcgtgtacgagcgcatgatcggctggccgtcgatttccagctccagggtgacgaactgccccggcttgaaaaagaacaggatcggctggtcggccataaagcagaaggtgcgcacatcccaggtttcctggatgactttgacgcaacggacgatgtgccgaccattggcccaggtctgggtggtgaccggattcaggaagctgttggacatgctgttctccgcagccgtatatcggcctgatggtggcgattctgcgtaacgcgagaaccacccatttacctatctgcgacattcacatacttatcgcgaccagcccccataccacgggggttgcgcgtcgggatcagagtgggccatgtcgctaatggacaaggttctggcctttgccgggcccacactcgctcccaacaacgacgctttctttacgccttgctgcaaaacctgatcagccactattcgccggccacacagaatggccctgaggacacacacgatggacgtcaccgcaaccttaagcttgggcgatccgctggaacccgcacgcaaggccaccgcgcaaatgttgcaagagcgcgagcgcaccttttcgctgccgcagccgttttactctgacgagcggctgtttgatatcgacatgcaggagatcttccagaaagagtggttgatcgccggcatgacctgcgagattcccaccaaaggcaattacctgaccctgcaagtgggcaagaacccgatcatcgtgatccgtggcgccgaaggcgtggtgcacgcgtttcataacgtgtgccgccaccgtgggtcgcgcttgtgcaccagcgacaagggcaaagtcgccaaattggtgtgccattaccaccagtggacctacgagctggacggccgcctgctgtttgccggtaccgagatgggcgacgacttcgacatgaagcagtacggcctgaaacccgtgaacgtgaagaccgccggcggctacattttcatcagcctggcggagaacccgccggccatcgatgacttcctgtcgacgttgaaccactacatggaaccctacgacatggaaaacaccaaggtggcgatccagaccaccttgttcgaaaaagccaactggaagctggtgctggaaaacaaccgcgagtgctaccactgcaacgcgtcgcacccggagctgttgaaaaccctgctggagtgggacgacgtcaccgacccgcgcgccgaccaagccttcaaggaccacgtggccgcctccgctgccgcctgggacgctgaaaaaatcccttacgcccacgccagcttcggcctgcgtaaccgtatcgtgcgcatgccgctgctcaagggcaccgtgtcgatgaccctggacggcaaacaaggctgcaacaagttgatgggccgcatcaaaaacccggacctgggttcgatgcgcatcctgcacctgccgcactcgtggaaccactgcatgggcgaccacatcatcgtgttcaccgtgtggccgatcagcgcccaggaaaccatggtcaccaccaagtggatcgtgcacaaggacgccgtcgaaggcgtggactacgacgtggagcgcatgcgcaaagtgtgggacgcaaccaacgaccaggaccgtcgcctggccgaagagaaccagcgcgggatcaactccaccgcttaccagccagggccgtactccaagacctatgagtttggcgtggtgaacttcgtggattggtacagcgagcgtttgctgagcaacctcggcgctgcgccggcgccatacctcaagggcgtggccgcacacgaataactggcacgtgtgggagctggcttgcctgcgatgcggacacctcggagcctcagttgcaccggggtgagcccatcgcaggcaagccagctcccacattagttatcatcagtgttcaataattgatcaattccctcgcaaccctttaacactctgccctccagccttctcccaacaacttatccacaaagccacccacagcaattgtgggcaagtgcgtttgctcctgaaaataaatgaagaaaatccgtgacttattcaagtagtccggtttcagcccgacctgatcatttattgatcaaaccttagaaagccatggattacgtgccctgtagcagtacgcgaacaccttatccacagaagcaccaacagactttgggggcaagtttatcggcgctgtggaaaaccgcttcaaaccttcataaatcgggggttccggcgatttaaatcaataaataagccaatttgatcatattttgatcagacctatgaaagcctctgtctataaggcctgtagccgatagcgaacatcttatccacagaagcgccaacagactttgggggcaagtctggatctgcgaattaagttattcatggaaaaacccaggaaaaaccgtcagttagcctggttgtttttcgtacagagggctgcagggcttgagttaccgggggtgtggacaaccgcgaacaggttatccacaggtgggtcaacagggattgtgggtaaggccatagatccaatgtgggagcgggcttttcagtgggagccgggcttgcccgcgatgcagacaactcggtccatcagttagaccgaggtgatgctatcgcaggcaagccagctcccacaggtattagcgcactacgccttcttcgatgagcagcttgagaatggcttcggcgcccgcttccgggctcaaccccttgagcacttgcccgccgccaccactggccttggccgtggcagccttcatacggtccgcaccgctcttggccttgatcaccttgaggcgcttgggccgtggcttggcgggttgcagcagtgcgcctgtgaataactcgtcctgttcgatctcgacttcatgggccgccagctcaccgcgctgtgcagggccgtaggcgctctggcgtggcttgggcgcggcgttatccaccgtggccagaaacggcaggcgcactttcaagcgccgccgctgcccacgcggcaacgcctgcagcacgtgggctacgccgccttcgatggactccacgtgcgccagcccgacaatcagcggccaacccagttgctcggcgagcaggaacggcaacatgcccgagccttcgccggtttccgcctggctgccggtcaacaccacttgggcgccggcaccgcgcagatactcactgagtaccggcaaggcatcggaacctgccggctgttccagcacctgcaattgtggcaagcccatgcccaggtaactgcgcaacgtaggctcgtgaatatcgccggcgtgcagcacctgcaacttatccccagccatttgcaggcccagctcgaccgccctggcatcttgctcggcgcggcgtgggcggcctgaggtcgggtgggcgccgatggacaccaagctgattacattcgtggtcatggtcatgtccttaagccgcgtcgcgcttggcgccgttgcggtaggcctcgaccgcagcgatcaaggcttgcagaatcgcggcgctctcgccgatcaccgacaggtcggcacgcttgatcatgtcgcagcccggatcgaggttgatcgccaccaccttgtcgcaggcaccgatgccttgcaggtgctggatcgccccggaaatccccacggccacgtaaacccgcgccgtaacccaggtgccgctggcgccgacctggcgatcacgcgccataaagccatcgtccactgccacccgcgacgcgccttcggtggcgcccagtgcggcggcggtctggtggaacagtgcccaatccttcacgccgttgccgccggagaaaatgaattcggcttcggccatcggaatcgcggccgggtccaccgccaccgcgccgaggtcttcgatgcgcggcaagctgcgcgccaggggtgtggataactccatgggcaacacttcgtgacgtgtttcactgaccggatcggcacactcggcagccgcaagaatcaggcgtggcaatggccgggccaaatcttcctggcccgcaccggcgcggccgatgcacgccccgtccttgatctgccacacgcgtgtggccgggcgttccttgaggctcgcagcaaaacgccgccccagttcgccgccgccactgcggctgtccggcagcagccagtggcgtgggttgtactggttatccacagcccgcaggccgtgtacacgttgttccggtgaataaccgtcgaattcgtggccgtccagcaccaacagccggtcaatgcccgccgtggcaaaggcactttccttgtgttcgccaaacaccaccgccagcaccgcgccgtcgctgccggcgagttgccgcgccaagccgagtagatcgcggtcgtggctgctgaggcggccaccgaccatgtccggcaccacgttgatgtagaacgccggggcggtcacctgatgcaatggcaactgtacttccactgccgccgtacgcttgaccgcgccgccctgctgggcaccgctgcggtcgatacgcttgaggccgttggggccgataaaacccacgccgtgcaggcttttgcggatgacgccgttgggccccatccagctgtggagcgccggctgcatcgccgcatgcagcgggtgcaggcggttgcgggcgatccattcggcccgtgggtcgcggcggataatgtcgctcatcaatgcacctccgcaggttcacgcttaatcggggcttttgccggggcggcgtcttcgagcaacgcgtcagccaccagttcggcgatgtctttgatcaacgggcgcggttcaaccacaccttcgagcatcgccgtgcactgcgggcaacccacggccaccagctcggcgccggtttcgcggatgtcttccatgcgcatgtcggggatacgttgcttgccgggaatgtcggtgattggtgcaccaccaccgccgccgcagcagcgtgaacggaagcccgagcgttgcatctccttgacctcgatgcccaacgcgcgcagcacttggcgcggcgcctcgtattcgccgttgtagcggcccagataacaagggtcgtgataggtcacgctgttgcccttgtgctggcccaggttcagcgcgccgtcgccgatcaactcggccatgaaggtgctgtggtgctgcaccaggtagttgccattgaacgcgccgtactcgtttttcagcacgtggaagctgtgcgggtcgcaggtgacgatgcgtttgaagcagtatttttccagcgtctggatattgcgcgtggccagcagctggaaggtggcttcatcgcccaggcgccgcgcgacgtcaccgctgtcgcgctcttccaggccgagcaccgcgaagtcgaccttggccgctttcagcactttgacgaacgcgcgcagggtgcgttggttgcgcatgtcgaaggcgccgtcgccgacccagaacagcacatcgcagctgcctttttcgctcaacaacggcaggttcaaatccgctgcccagttcagccgaccgcccggtgcgaagccaccagggttgtcggtggcgatcaagttttccaggacttcagcgcccttgtttggggtggcacctttctccagggtgaggtggcggcgcatgtcgacgatggcgtcgacgtgctcgatcatcatcgggcactcttccacgcaggcgcggcaggtggtgcacgaccacagggtttcagcatccaccaggccgttgacgatcggctggtgtgggttgccgctgtgttcgccgacaggtttgccgggatacgggctgccggcgaacttggcgtcggtgccaccggccaggccgaccaccatgtcctggatcagctttttcgggttcagtggctggccggcggcgaacgctgggcacgcggcctcgcacttgccgcactgtacgcaggcgtcaaagccaagcagttggttccaggtgaaatccttgggtttttccacgcccagtggcgcggttttgtcgctcaagtccaacggcttcaagccagtggaacggccgccgccaaagcgctcggcgcgtcggtgccaggccaggtgcagggcaccggcgaaggcgtgtttcatcgggccgccccaggtcatgccgaagaacatttccgacacgccccacagcacgcccaggctcagcaatgccgccagcagccagccaccgaagtcggccggcagaattccggccaccggcaacgtcaccagaaaaaagctcacagagaacgccatcaggcttttcggcaggcgcatccacgggcctttcgacaagcgcgcaggcgggttgcgacggcgcagatagacgaaggtggcgccgacaaacatcagcaccgaggccagcagcaaggcgtaaccgaggatgcggttatgcaggccgaaaccgtgcaccagaatcgccagcaacgccgacaacacaaagcccagggcggtggcgacgtgggtgttggcaatgtatttgtcgcgggcgaccacgtggtgcaggtcgaccatgtagcgcttgggcatggccagcaggcccccgagcagatcgaccttggaggcacggccacggcgccacatgttcacccggcgcagcgcgccgaggacggcaaggcccagggcggcgaagagcaggatgggaagaaggatgttcaacatggtgaagctcccaaagaccacggggtcaatgatcgtccccacgctctgcgtggggatgcatcctgtgacgctctgcgtcacgacctaagagcggacgcgaagcgtccagggcggcattcccacgcagagcgtgggaacgatcaagtgggtcagaaatccttgcacaggcgcagggcgtcatagatcgcggcgtgggtattgcgctgcgccacacagtcaccgatgcggaacagcaagtacccgtcgcccggctcgctcaggcacggctgcggcttgatcgcgaacagggcctcgatgtccatctggcctttgttgcgcgaaccttccttgagcccgtaatagagcgcttcgtccgggcgcacaccgttctcgaccaccacctgatcgaccacgcgttcttccttggcgccggtgtattcgttctccagcaccgccaccagcttgtcgccttcgcggtagaccttttccagcatcatgtcgccggtcatgatcacttccttggggtacatgctgcggtagtaagtcgggaacgacgtaccgccgatagccacgcccggcttgatgtcgtcggtgacgatctcgacctggctgcctttgtccgcaaggaaatccgccaccgacatgccggtgaattcgcagatggtgtcgtagaccagcacgttcttgcccggcgccaccttgccgtcgagcacgtcccagctgctcaccaccaggccttccgccgcgccccagtgttcgttctgctccaggaacgggtgcccgcccacagccagcaccaccacatccgggcgcaggtcgaggatcgcatcggcattcgccgccacgcccaggcgcaggtcgacgttcaagcgcgccagctccagctggaaccagcgcgtgatgccggcaatctggtcgcgttgcggcgccttggacgcggtggtgatttgcccaccgataaagtctttcttctcgaacagcgtcacgtcgtggccacgctcggcggcaacgcgggcagcttccatcccggccgggccggcacccactaccacgactttgcgttttggcccggtggacttctcgatgatgtgcggcacgcccatgtattcacgcgaagtcgcggcgttctggatgcacagcacgtccagcccttggtactggcggtcgatgcagtagttggcgccgacgcattgtttgatctggtcgacctggcccatcttgatcttggcgatcaggtgcgggtcggcgatgtgggcgcgggtcatgccgaccatgtccacgtaaccgccttccagaatgcgcgtggcctggttcgggtccttgatgttctgcgcgtgcagcaccggggccttgaccacttccttgataccggcggccaggtgcaggaaaggctccggtggataactcatgttcgggatcacgttggccagggtgttgtgggtgtcgcaccccgaaccgaccacaccgataaagtcgagcatgccggtgtcgtcgtagtacttggcgatttgcttcatgtcctcgtgggacaagccgtccgggtggaattcgtcgccacacaggcggatgcccacgcagaaatccgggccgacttccttgcgcacggccttcaacacttccaggccgaagcgcatgcggttttcgaaactgccgccccattcgtcagtgcgcttgttgacccgtgggctccagaactggtcgatcatgtgctggtgcaccgccgacagttccacgccatccaggccaccggccttggcccgcgccgccgcagtggcgtagttgccgatcacgcgccagatttcttccggctcaatggttttgcaggtcgcacggtgcaccggctcgcggatgcccgacggcgacagcagcgtcggccaatgctcgccgtcccagcgcgaacgacggcccatgtgggtaatctggatcatgatcttggcgccatgcttgtgcatggcatcggccaggttctggaagtgcgggatgatgcggtcatcggccaggttgaccgatttccaccagccttgcgggctgtcgatggccacactggaagacccgccgcagatcgccaggccgatcccgcccttggctttctcttcgtaatacttcacatagcggtcggtggtcatgccgccgtcggtggcatacacctcggcgtgggcggtactgagcacgcggttgcggatggtcagtttgccgatctggatcggcgcgaacattgcttcgaaagccatggcacggttcctcgacttacaacggcttgacggtgaacaggccgtcgtcgtggccctcttcggagcctccgtagacttgttcggctacggtgcggatgttgctgccacgcgcctgcagaatctggtccatggcgccggcaaaccagccggtgaacatgtagtcgactttgcgcccgaccttgccgtacacgtagacgaaggccgagtgttcgagcttgacgctggcggtgcctttgtcgaggtcaatgtcctggatcttgaacaggccccagccgcgttgcgacaggcgcttcatgtagtgctcgaataccgcgacgccttccaggccatggcattcagcttctttttcacaccagtgccaggcggatttgtagccggccttgtagaggatttcggcgtaggcatctgcgcccagcacttcttcgatgcccatgtggttgttgacgaagaaatggcgcggcacgtacagcatcggcagggcgtcggaggtccagacaccggtttcgctgtcaacttcgattggcaattgcggggcgatcttggccatggaaacttaactccagaaaattcgtttggatgccccaggcaccggatggcctggggaaaagaaatgttggcggtggcttattcgccccagacgtccttcaggacattgacccagttttcgcccatgattttgcgcaccacgcgctcgctgtggccgcgcttgagcagggtttcagtgaggttggggaactcgcccacggtgcggatgcccagcgggttaatgatcttgccgaagctggtcaggcggcgggcgtagcccttgtcgtgggtcagcatttcgaagaaatcctggccatggccctgggtgaagtcggtaccgatgccgatggcgtcttcgccgacgatgttcatggtgtattcgatggcttcggcgtagtcgtcgatggtcgaatcgatgcccttggccaggaacggcgcaaacatggtcacgccgacaaaaccgccgtggtccgcaataaacttaagctcttcatcggacttgttgcgcgggtgctctttaaggcctgaaggcaggcagtgggagtagcacaccggttttttcgattcgaggatgacttcttcgctggtcttggagccgacgtgggacaaatcgcacatgatgccgacgcggttcatctcgccgacgacttcacggccaaagcccgacaggccgccgtcgcgctcatagcagccggtgccgaccaggttctgggtgttgtagcacatctgtacaacgcccacgccgagctgcttgaagatctcgacgtagcccaactggtcttcaaacgcatgggcgttctggaagccgaagatgatgccggtcttgccctgctccttggctttgcggatgtcggcggtggttttcaccgggatcaccaggtcgctgttctcacggatcagggtctggctggccacgatgttattgatcgtggcctggaagccttcccacaccgacaccgtgcagttggcggcggtcaggccacctttgcgcatgtcctcgaacaggtcgcggttccacttggcaatgatcagcccgtcgataacgatgctgtcggcgtgcaattcggctgggctcatcaggcgtccccttattggcgattcatgcgccgaatcgtctgccggcgctttggggccagcatatgcccaggggctgaacgaaccgggtgcaaaaacgacaggggaattgccgaaagcgtcaatccgcgacaaaggcctacatgacacgtctgactgacgactgttctttgtcttacgcttgagccagaattccgcatcacctgatatgagacggcgcaatgaaatcgattttcctggctttggcactcatcgcaaccggcgtccacgcggccgaagacacggacaacacgccgtgcgatggcatcgagaacgacaagcaaaccctggaatgcgccacctacaacaagaccaccgccgagcaattgctcaaggataactatcaaggcttgctggaacgcatgggttcgacctatggcagtaacaagtcgcaactggccgacattaccgctcgtctgaaggatgcccagcaaaaatgggaaaaactgcgtgacgccgattgcgccgtggacaccttcccggcggtgaatggcagcaaggactacgcgatccagcagaatgactgcctggcgcggatgagtgatgagcggtcggagtttttggagtcgattgggcaggaataatccggtttaatcgccgaaaatcattgaaaaggacttcacatgtactacccacgcgaagcgcaacgggatttcctgttcacgcgcgccaccctgctgttcgtctccatgctggtactgtcgctgatgctgttcctgtccaaggacaagggcgcaccttatgccgtgatcaacgtggcgcccgtggagacgatggggcaaatcacccaacttgaaagcgtcggcccccgggattcaagcaccaacgtgtattacgccttcgaccacgaaggccagcgcgaagaaggcatggtgaacaacagtagctatgtcgaagaccgaggctacacggttggcggcccggtcgaggtggtgtactcaaagtggttcccgacggtgcataacatcaaggcgaacctgaaatccagctcacccaacttctacatcatgagcatcagcgccggcttgatgattctgtgcttgatcctgatgttctggacgatccacaagatctacgcacataaagaggaagatcggcactactgatacctgatcccccagccctcctccctctccataggctaatgcatgactatctgcggcatcgaaatcaaaggcagcgaagccatcatcgctgtcgcctcgctggacacccaggcgctgacccacatcgccctggccaccaagaaaatcgctctcgaagatgacgatgaagcggccaacgtcaaagccttcgccgcccaggtgaaggctttcgtacaagcgaacgcaatcacccgcattgcaatcaagaagcgcagcaaaaaaggcgaattcgccggtggcccgaccacgttcaagattgaaggtgtgtttcagttactcgatggcgttgaggtgacactgctgtcgccgcagaccatcaatgcgcagaacaagaagcacaactttgagctgccgaccacgctgaacaaatatcagcatgaggcttacaaggcggcgtgttcggcactgctgaagaaataagccacagcgcaaatcccctgtgggagctggcttgcctgcgatggcggcgggtcagcaccacaaatgccatcgcctacaccgctatcgcaggcaagccagctcccacatttgatgcgcatacactcagtaatgtgcgcggcggcgatgaactcccaagccttggaaactgagatttatactcaattatggaaacgactataaattatagtcatctctataattggctaaaaaacgatcaaaccacctcccgtcgccggtcctcccgcgggcacttggcaaaccttgcccgatagctgcgggtgaaatacgacggcgactcaaacccgcacgcgatactcacctccagcacactcaggtcgctctggcgcaagagctgccgggctttttccaggcgcaggccgaggtagaagttgctcggcgtatcgttcaaatgcagacgaaacaaccgctccaactggcgccgcgtgactttgatcgcgtcggccaatgccaaggtgctcagcggcggttcggtgtgttgttccatctcgccaatcacctgcaccaacttcttgttgttgatgccgtagcgcgtggcgatctgcatgcgctggtggtctttgcgggggcggatgcggctgagtacgaattgttcggaaacctggatcgccagctccggcccgtgggcctgggcgatcaggtcaagcatcaggtcgatggacgcagtgccgccggcgcaggtgatgcggcggcggtcgatctcgaacagttcctgggtcaccgtgagctgtggataagactccttgaaggcgtcgatggcttcccagtgcagggtgaggcggtggccgtcgagcaaaccggcctcagcgagcacacaggcgccagtgtcgatggcgccgagggtcacgccttcatgatcgaggcggcgcagccagtgttccagtgcgggtgtggtgaacttcaagggttcgaagccggcaaccaccatcagcgtcgcgccttttttcagcggttccagcgcggcgtcggcgttgaccgacatgccattgctcgccagtaccgcgccgccgtcggcgctcaacacgtgccagcggtacagctcgccacgaaagcggttggccacccgcagcggttccagcgcggagataaagccgatggccgagaaacccggcatcagcagaaagtaaaaatcctgggacatggtggcgctctcgtaggacgggcagcgtggtcactgtgatacgccagttcaactggccattcaagagcacaggtcgctgcagtgcaagagcgggtcgccgccgtgcgttttgtcgggcccgaaggtacgtaacttgatcccacggcgcacaaagacgccggaccccacaataacgacctgccgagggatccaccatgaaccgactgatcagccgctgcgtgcttgcactcagcgccagcgccattttgagcaccagcgtattcgcggccgacgcagaatcctgccggaacgtgcgcatgggcgtggtgaactggaccgacgtaatcgccaccagcgccatgacccaagtgttgctcgacggcctcggctacaagaccaaacagaccagcgcctcccagcaaatcatcttcgccggcatccgtgaccaacgcctggatatgttcctgggctactggaacccgctgatgacccagaccatcacgccgttcgtcgatgccaagcaagttaaagtcctcgacaaacccagcctggaagacgcccgcgccaccctcgccgtgccgacgtacctggcggacaagggcctgaaaaccttcgccgacatcgccaagttcgaaaaagaactgggcggcaagatctacggcatcgagccaggctcgggcgccaacacccagatcaaggcgatgatcgccaagaaccagttcggcctgggcaagttccagctggtggagtccagcgaagcgggcatgctcgccgccgtcgaccgcgcggtacgccgcaaggaagccgtggtgttcttcggttgggcgccgcacccgatgaacgtcaacgtcgccatgacttacctcaccggcagcgacgacgccctaggcccgaacgaaggcatggccacggtgtggagcgtcacctcgccgacctacgccgaacagtgccccaacgtgcacaagttgctgaccaacctgaccttcaccgccgccgacgagagccggatgatgcagccgttgctggatcacaaggacgccatcgagtccgccaagcagtggctcaaggaccacccgcaagaccagcagcgctggctcgaaggcgtgaccaccttcgacggcaagcccgccgcagccaacctgcaactgaccagcaaataacctgattcgaatcaccgtgtcgcagctgctgttggctgcgaacggcatcactacgcccgcctgtaaggaaccgcctcatgaaccacgacgtcatcatcacctgcgcactcaccggtgctggcgacacgaccggcagaagcccacacgtgcccgtcactcccaaacaaatcgccgccgctgccgtagaagccgccaaggccggcgcgaccgtggtgcactgccacgtgcgtgaccccgaaaccggcaagttcagccgcgacgtcgcgctgtaccgcgaagtgatggagcgcatccgcgaggccgacatcgacatcatcgtcaacctcaccgccggcatgggcggcgacctggaaatcggtggtggcgagaaccccatggagttcggccccaacaccgacctggtcggcccgctgacgcgcttggcccacgtggaagagctgctgccggaaatctgcaccctcgattgcggcacgctgaacttcggcgatggcgacaccatttacgtgtccaccccggcgcaattgcgcgctggcgccaaacggattcaagagctgggcgttaagcctgagctggaaattttcgacaccggccacctgtggttcgccaagcagatgatcaaggaaggcctgctcgacaacccgctgttccaactgtgtctgggcatcccctggggcgcaccggccgacaccaccaccatgaaagccatggtcgacaacctgcccgccgacgcggtgtgggccggtttcggcatcggccgcatgcaaatgccgatggccgcgcaagcggtgctgctgggcggcaacgtgcgggtcggcctggaagacaacctgtggctggacaaaggcgtgctggccaccaacggccaactggtggagcgcgcgagtgaaatcctcagccgcctgggcgcacgggtcatgaccccggcggaaggccgaatcaagatgggcctgaccaagcgcggctaatttttccaaacactactgcaccctgtgggagtcgggcttgtgtgggagcgggcttgctcgcgaatgcggtgaatcagtaaccgaatgcatcaaccgacataccgcattcgcgagcaagcccgctcccacattgaaccggttcctcatacagaatttgcgaatactttaggaaattgccatgagctttatcaccgagatcaaaaccttcgccgccctcggcagtggcgttatcggcagcggctgggtgtcccgcgccctcgctcacggcctggatgtaatcgcctgggacccggcgcccggcgccgaagcggccctgcgcaaacgcgtcgccaacgcctggggcgccttggaaaaacaaggcctggcgccgggtgcctcccaagaccgcctgcgctttgtctccaccatcgaagagtgcgtgaaagacgccgatttcatccaggaaagcgccccggaacgcctggaactcaagctgcaattgcacagcaaaatcagcgcggcggccaagccgacggcgttgattggttcgagcacttcaggcctgttgccgagtgagttctacgagggttccactcacccggaacgctgcgtggtcggccacccgttcaacccggtttacctgctgccgctggtggaagtggtgggcggcaaaaacaccgcgcccgaagcgattcaggcggcgatcaaggtgtatgaatccctcggcatgcgcccactgcatgtgcgtaaagaagtgccagggtttatcgccgaccgcttgctcgaagcgctgtggcgtgaggcgctgcacctggtcaacgacggcgtggcaaccaccggcgaaatcgacgatgccatccgttttggcgccgggttgcgctggtcgttcatgggcaccttcctcacttacaccctggccggaggcgatgccggcatgcggcatttcatggcgcagttcggcccggcgctgcagttgccgtggacgtatttgccggcgccggagctgaccgacaagttgattgatgatgtggtggatggcaccagtgaacagctgggcaagcacagcatttcggcgctggagcgctatcgtgatgattgcctgttggcggtgctggaagcggtaaaaaccaccaaagccaaacacggtatgagtttcgctgaataaccgctgttgatttcctgtgggagctggcaagccagctcccacagttgaccgagtaatgacctggaatcccagacatgcctgcactgacgacttacaccaccaacatccagcccgactgggtggattacaacggccacctgcgcgatgcgttctacctgctgatcttcagctacgccaccgacgcgctgatggacactctgggtttggacagtgaaaaccgtgaggccagcggccattcactgttcactttggaactgcacctgaactacctgcacgaggtaaaactgggtgccgaggtagaagtgcacacccaattgatcgcccacgatgccaagcgcctgcacctctatcacagcctgcatggggtgggcgacgacaaggaactggcgggcaacgagcagatgctgctgcacgtcgacctcgccggcccgcactcggcgccatttaccgaagcgaccctggaaaaactcatcgccatcagcgctgatcaggccgacctgccccggcctgcactgctcggtcgtgtgattggattgccgcccaaaaaacactaaggaatcgccatgcaaaccgccgccgctgttgccgattttcgtacttacccgctgatcagcgacctcgccgaggtgcacctgctggccgatcagctgcgcgtgcaatgggccgatggtcgggtcagcccgtttcatcatcagtggctgcgggacaactgcccgtgcgcggaatgcgtgtacagcgtgacccgcgagcaggtgctggagattgtcgatgtggatgaacatctcacggccgtcagcgcgcgtattgaccagggtgttctgagcgtggaatggcgcggcggccatcgcagccaatacgatccgggctggttgcgggcgcatgcctacgacgatgaatcccgcgccgaacgccgtgccgccaaacccaaatcacggctatgggacagcacctatgcactgcccgtattcgactatgcgaccgtgatggaagacccgaaaagcctgctgcaatggttgctggcgttgcgcgactcgggcctcacgcaaatccgtggcgtgcccaccgaacccggctccctggcgctgattgccaagcgcatttcgtttatccgcgagagcaacttcggcgtgctgttcaacgtgcaatccaaggccgatgccgacagtaacgcctacaccgccttcaacctgccgctgcacagcgacttgcccacgcgcgagctgcaaccggggctgcaatttctgcattgcctggtgaacgaggccacgggtggcgagagtatttttgtcgatgggtttgccatcgcccatgcgctgcgcacggaagaccccggggcgtttcgcgcgctgtgtgaaatccccgtggagtttcgcaataaagaccgtcacagcgactatcgccggctggcgccgatcattgctttggatgccttgggtgaagtggcggagatccgcatggccaactttctgcgcgggccgttcgaggcgccggtggagcagatgccgttgttgtatcgggcgtaccggcgctttattgcgatgacgcgcgaagagcgttttcgactggtcaagcgcctgaatccgggggagttgtggtgctttgataaccgccgcaccttgcatgcgcgcaatgggtttgacccagcttccggggcgcggcattttcaggggtgttacatcgatcgggatgagttgttgtccaggatattggtgttgcaaaggtagaccgagctgcggctatcgcaggcaagccagctcccacattcgactgtgttcacaattcaaactgtgggagctggcttgcctgcgatggggccagtcaactcaccacaaatcccagacaaaaaaagccccgatccagccgtgactggatcggggcagagtgcttggtgtgagcgtgacatcccgagggtgaccaaaccttcaaggtgcgtgcctggcattcagtgtgcctgttacttctgtcggtaaatgacccgaaaacgacctgctcatagccatatgagccattcgttgaatctgcccttgccgaccggtcgagggcctaccagaatccaagtcaatccccgctccctacaccaggatgaacgtcatgatgcacgcggatttgattgaccaggatgacctgctgggccaactgcgctcgctgggttttgaagtgtccagcggtgctaccgccgagcaggcctgcgagtgtgcggtgcgcggtttgagcgcggcccgggccaaggcgctcaagggcatggtggaacagatgtacaccggcagcgcgacgatcctgccggcagtgcggcaggcgatcgacaagcagttgttgccggctttggtgcagttcaagcagaactctggcgcctgatagatcgctatcgcgggcaagcccgctcccacattttgacctgtgaatacattcaaaggtgggagctggcttgcctgcgatgaaggcctctcggtctagagccttacactcgcgaaagtcgactcgttccgagcctggctcaatgccgacatcggccccgacaacggtgataacaccagcgcctgcggaatcggcatcatcgccacttgctgggtggtgttggaccctacgcgctcatcccgtggtggaatgccgaagtattcgcggtagcacttggaaaagtgcggcgtagacacaaacccgcacaccgaggccacttcgatgatcgacatcggcgtttgcttgagcagttgccgtgcacggatcaggcgcagcttgaggtagtagcgcgacggcgagcagtgcaggtatttctggaacagccgctccagctggcgacgcgacacggcgacgtacaccgccagctcgtccaggtcgatcggctcttcgaggttggcttccatcaacgcaacgatttcctgcagcttcggctggttggtaccgagcatgtgcttgagcggcacgcgctggtgatcctgttcgttgcggatgcgttcgtacacaaacatttcggaaatcgctgccgacaattcacggccgtggtcgcggctgatcaggtgcagcatcatgtccagcggcgcggtgccgcccgagctggtgaagcggttacggtcgagggtgaacaggcgtgtgctcatggccacacgcgggaaggcttcctgcatcgacgccaggcattcccagtgcacgctgcaatcaaaaccgtcgagcaagccggcgcaggccaaggcccaactgccggtgcacacggcgccaaggcgacgtgactgacgcgcctggctttgcagccacgacacgtgctcacgggtaacggtgcgctggatacccacgccgccgcacacaatcacagtgtccagggccggggctttgtgcatggaggcatcgggggtgatttgcagaccgtcgctggcccacacctggtttccgtcgacactcagggttgtccagcgatacagctcgcggccggacagctggttggccatgcgcaggggttccactgcggacgccagggaaatcagcgtgaaattgtccagcagcaaaaagccgatggattgaggcgcacggttctggggttgagccccggagttgaacgacgtcatcgcggtatctcctcacacaaagcgggtgatggcctcaggcgaggctcttgttattgcgctcgccctggaaaggagaggctttgaattgatagagcaaatgccatgcctaaaattgaatggccattcaataactcctgaaaacgacctgatgacgcgtctatataagcccgtgcaacgagtgcgggatatgccccgaaaaggccgttggagtgagcctgctcacggggtgtgagcagatcggtagcacttgtgggaaggcgctttgagcgcgtgggaaaagtctgtcaccgcacgcacgggtgacgggtggtcgggcgaggaatcgtctgagggctacttgtctgtttgcgacgcgctaaaaggtggcgcttttggatccgggtgttcactttatgagcagtttggctgagccaccgctatcgcgggcaagcccgctcccacactttgacctgtgaatacattcaaaggtgggagctggcttgcctgcgatgcaggcgactcggtctcagcactcgaccgcactcaccgccaacccgccccgcgaggtttccttgtacttgtcatgcatgtccgcgccggtatcgcgcatggtgcgaatcacgcggtccagggagataaagtgctggccgtcgccacgcagggccatttgcgccgcgttaatcgctttcactgccgcaatcgcgttgcgctcgatgcacggcacttgcaccaggccgcccaccgggtcgcaggtcaggccgaggttatgttccaggccgatttcggcggcgttgcacacctgctccggcgtggcgccgagaatctccgccaacccggcggcggccatggcgcaggccgaacccacctcaccctggcagccaacttcggcgccggagatcgaggcgttctttttgcacagaatgcccaccgccgccgcgccgagcaggtagtcgacgacgttggcttcagtgacctgttcgctgaacttcataaagtagtgcagcaccgccgggatgatgcccgccgcgccattggtgggtgcggtgaccatgcgcccaccggcggcgttttcttcgttcaccgccagggcgaacaggttgacccattccatggcgctcaaggtcgaaccgatcacattgggcttgttcaactcctgcaagctgcgatgcaacttggcggcgcggcgacgcacattgagcccgcccggcaggatgccttcgtgcttgaggccctgctcgacgcaatcctgcatggcgcgccacagtttcatcaggccgctgcggatttcctcttcgctgcgccaggtcttttcattcgccagcatcaactcggcgacgcgcaggttgtgggtcttgcacagctgcaacagctctaccgcgctggaaaaatcatacggcagttcggtgcggtccatatcggccacgccgctttgcgcctgggcttgatccaccacaaaaccgccacccaccgaatagtaagtgtcgcggtgcagctcgccgttatcgccgaacacaacaagggtcatggcgttggggtgaaacggcaggttttcgtcgagcaggcgcatgtcgcgcgcccagataaacggcaccggcaaacggccgtcgagcagcagggtgtcggtctcgcgcagggtgtgaatacgcaggccgatttgcgaggggtcgattgcgtccggccactcgcccatcaggcccatgatggtggcggtgtcgctgccgtggccgatgccggtggccgacaaagagccgtacagctgaacttcgacgcgcctgacttgttccaacaattcacgttcacgtaatgcctggacgaacaacgccgcggcgcgcatgggaccgacggtgtgagaactagaaggcccgatgccgatcttgaacaggtcgaaaacgctgatagccattaacgtgtaactccgcaggtgaacaggccggacaccaaggagctgctacgctcagatcgcccagatggcggcatcatcaagcttttatccgccctcacggcgtctcacaccgacgcatccatgctcaccagcgtcgcttccgtgcgatcaggcgttttggccgtttttagcggtgcagatcggtaaaaacagcggttttgcctttggaaaaatctgtaagcgacgtcaccgacactggatacgaccatccctgtactggatacgacgccccctgtaggcgtcagattttcactggtacatgatcagtctcgactcgtttgcaaggcaccgcgccgccgctttgtcgcacgccccaaccgcaacacttataaagcgcggcgaatgccgccagaaaaaagacacaggagtctaccccgatgaaaggttcaccctcgttgttgttggccgccatgctgagtctgccagtcctggcaaacgctgcagaaccggaacagtgcaagaccgttaacttctccgatgtcggctggaccgacatcaccgtcactaccgcaaccaccagcgaagtcctcaagggcctcggctacaagccacgcaccacgatgatttcggtgccggtgacgtacaagtcgctggccgacggcaagaacatggacatcttcctcggcaactggatgccgaccatggaaaacgacatcaagcagtaccgtgatgccggcaccgtggaaaccgtgcgcgccaacctggaaaacgccaagtacaccctggccgtcccggaagcgctgtacaacaagggcctgaaagacttcgccgacatcgtcaaattcaaggatgaactgggcggcaagatctacggcatcgagccgggcaacgacggcaaccgcaccatccagaccctcatcgacaaagacgccttcggcctgaaaaccgcaggtttcaaagtggtcgagtccagcgaagccgggatgctctcgcaggtggaacgcgccaccaaacgcgaccaggccatcgtgttcctcggctgggaaccgcacccgatgaacacccgcttcaagatgaagtacctgaccggtggtgacgactcgttcggccccaactacggccaggccaccatctacaccaacgttcgcaagggctacacccaggaatgcagcaacgtgggccagttgctgaaaaacctgtcgttcaccttgaacatggaaagcaccctgatgggcaacgtcctggacgacaagatgaagcctgacgccgcggcgaaagcctggctgaagaagaacccgcaagtgctcgacacctggctggccggtgtgaccaccgtcgatggcaaaccagggttggaggccgtcaaggaatacctcgctaagtaagtgctgaccccaggccggtgcgctggcctgggatgttttccccttcgcatgtggacattcactaccatgctgactgaacagaaaatcccactaggccagtacatcgctgccttcgtcgaatggttgaccaaacacggtgccaactatttcgacgcaatcgcatcgaccctggaaacgatgatccacggcgtgacgtttgcgctgacctggttcaatccgctggcattgatcggtctgattgcgctactcgctcactttattcaacgcaaatggggcctgactgtttttgtcatcgcctccttcctgctgatcctcaacctggggtactggcaggaaaccatggaaaccctcgcgcaggtgttgttcgccaccctggtctgcgtggtcatcggcgtgccgctgggcattgttgccgcgcacaaaccgatgttctacaccctgatgcgtccggtgctcgatctgatgcagaccgtgccgaccttcgtctacctcatccctaccctgaccctcttcgggctgggtgtggtgcctgggctgatctccacggtggtgttcgcgattgccgcgcccatccgcctgacttacctgggtatccgtgatgtgccgcaagagttgatggacgccggcaaggcctttggctgctcgcgccgtcagttgctctcgcggattgaactgccccacgccatgccgagcatcgccgccggcattacccaatgcatcatgctgtcgttgtcgatggtggtgatcgcggccctggtgggcgccgacggcctcggcaagccggtggtcaacgcgctgaacaccgctgacatcgccttgggctttgaagccggcctggcaatcgtgttgctggccatcatgctcgaccgcatctgcaaacaacccgacgccaaagtagggggtgatgcatgagcattatccgattcgacaatgtcgatgtgatcttctccaaagacccgcgcgaggcactcaagctgctcgaccagggcatgcaccgcaacgagatcctgaaaaagaccgggcagattgtcggcgttgaaaaagccagcctggatattgagaaaggcgaaatctgcgtgctgatgggcttgtcgggctccggcaaatccagcttgctgcgctgcatcaacggcctcaacaccgtcagccgtggccagctgtttgtggagcacgaagggcgccagatcgacatcgcgtcgtgcacgcctgccgagctgaaaatgatgcgcaccaagcgcatcgccatggtgttccagaagttcgccctgatgccttggctgacggtgcgcgagaacatcagcttcggcctggaaatgcagggccgcccggagaaagaacggcgcaagctggtggacgagaaacttgaactggtgggcctggcccaatggcgtaacaagaagccggacgagctgtccggcggcatgcagcagcgcgtcggcctggcccgcgcgttggcgatggacgccgatatcctgctgatggacgaacctttctccgccctcgacccgctgatccgccaaggcctgcaagatgaattgctggagctgcaacgcaagctgagcaagaccattgtgttcgtgagccacgacctggatgaggcgctcaaattgggtagccgcattgcgatcatgaaagacggcaagatcatccagtacagcgtgccggaagagatcgtgctgaacccggcggacgactatgtgcgcaccttcgtcgcccacaccaacccgctgaacgtgctgtgcggtcgcagcctgatgcgcaccctggacaactgcaaacgcatcaacggttcagtgtgcctggacccgggcggcgattcgtggctggacctggccgaaggcaacaccatccagggtgcccgccagaatggcgcggtgctgaacctgcaaaactgggcgccagggcaagcggtagaaggcctgggccgggtgccgacgctggtggattcgaatatcggcatgcgcgatgcgttgcagattcgttatcacaccgggaacaagttggtgctgcatgacagcaacaataaggtggtgggaattctgggggatagcgagctgtaccacgcgctgctgggcaagaacctgggctgacagacaccgcaaaaccaacagaaaaaactgggtcaatgtgggagctggcttgccagctcccacatgatcgttcccacgctctgcgtgggaatgccgcactggacgctctgcgtccgctcttgagtcgtgacgcggagcgtcacaggatcattcaagcccgactatcagctatagacacggccaaggagctgccgatggctttcaaactgatcgagcacgtcccgggtgatctgttcctgggcaaagcccatcaggtcgtattcctgaggcccgttgtgcaggtagacctcggcccggtagtaacgggtgcgctcttcttcgggcaagtcgctcggtgccgacgagtaagcatccaggctcacttcatagacaaacgggttgccctcttccatctcgatacgcacaccgatgcagcgcttggatttgcccagcagggtctgcacctccagcccctggtcacgcagcgccgtcgccgcttcttccagcgcaggcgtgacgtgcttgtccataaagcgttgcacggtgccctggctcggttgcaggtccagcgcggtcagacgctcgctgaaaccacgacggccacgctcggccaattgcgcctgctcctgttcgatggcgacgtcctggcgcatggccttgtgcaaaccgaacataaagaaaatcagcaccaccgagaacggcagccccgccagcaccaccatggtttgcatggcttcgaagttaccggcgaacagcaagccgatggtcaccagggtgatcaccgccgaccagaagattcgcagccagtgcggcgcatcttcatcgacgttgccgcctttgcaggaaaggttggccatcatcaccgcgccggaatccgccggagtcaggaacagcacaaagcccacgaagatcgacacgccgatcacgattttcgacgccgggtaatgctccagcagttggtagatggccatcgacggttgttccagcgccgtcttgcccagctccacggcaccgtggttcagcaccaggtccagcgccgagttaccgaagatcgacaaccacgccaaggtgaaacccagcgggatcagcagcacgccggccaccagttcacgcacggtgcggccacgggaaatacgcgcgatgaacatgcccacgaatggcgcccaggaaatccaccaggcccagtagaacagggtccacaggcccatccagcgctcggtcttgtcggcgtcgccttcgtacacatagaggtcgaaggttttcagcaccaggccattcatgtagtcgccgatgttctgcacaaagccgttgagcaagtgcagggtcgggccgaacaacagcacgaagatcagcaagccgctgaacagtacgatgttgaggttggacaggcggcgaatgccgttctccacacccgacacggcggcgatggtcgccacggtgctcatcacgatgatcacgatcagcaggttggtgttgctgtgctgcatgccgaacaggttttcaagccccgacgacacttgcatcgcgccaatccccaggttcgtcaccaggccgagcaaggtcacgaacatgccgaaaccgtccaccgcgtggccggccgcgcctttgacccaacgctcgcccaccaatgggtacagcgccgaacgcaaggccagcggctggttatgccggtaggcgaagtacgccacggccaggccgaccaaggcgtagatcgcccagccgtgcaggccccagtgcaggaaggtcagttgcagcgcctggcgtgcagccatgttgctggcggccgcgccttcgggcgggttgaagtagtggtccaaaggttccgacgcgccgaagtacagcagcgagatgccgatgcccgacgagaacagcatgccggcccaggcgccgtagctgaagtccggggtgtcgtccttgctgcccagtttcaatttaccgtaggacgaaaacgccaggccgaccacaaacaccaggtaagcggcgatgaccaccatgtagtaccagccgaagcttttcgacagccaggcttgtgctacgccaagcatgcgcccggcctcctgcggggcgatgatcagaatggcggtcaacaacagaatgagcgcggtggaggtgtagaacacccaaccgttgacccgaaccttttccggcggggtctttataagagaggcagaactcatggcgcagatgctccgggcagtgcgagagagaaacacaaggcaacggttatcccgggacatcgatttttcggcagtcgacggacgggtgttataaagacaccccgaaaattcttgagccgcgccgaagcagtggccaggccctgatacggcctgtttcaagggtttttgcaggtgtcagtggttgccgcgcacaggtaggaaatatctgtaggtagcgaccatttgtcgcagatcttattctttgttgattgaacgttcaatcaaaacaaaatagactggccatcaagccgacggacgtttatcgcccaacggcaggcctaaggagaggtgctacatgcccaaggtcggtatgcaacccatacgccgccagcagttgatcgaagccaccttgacggccatcgatcaggtcggaatgggagatgccagcattgcgctgatcgcccgtttggccggcgtctcgaacggcatcatcagtcactactttcaggacaagaacggcctgatcgccgcaacgatgcggtacttgatgaatgtgctgatcgagaacgtccacgaacgcaggcttgcgctgaaggacgacagcccacgggcgcaccttcgggtgatcatcgagggcaacttcgacgccagccaggtcaacggaccggcaatgaaaacctggctggccttctgggccaccagcatgcatcacccgtcattgcacaggttgcagcggatcaacgatcaacgtctgtattccaacctgtgctgccagttccgccgagtgctaccgctgccgcacgcacgcaaagcagccagaggcctggcggccctgatcgacggtttgtggttgcgcggcgccctgtcgggagacgctttcgacacggagcaggcgcaacggatcgcttacgaatacatggatttccaattggccaagcaggtgagttagagcacacataaacgctcaacccctgaacgtctgccgctcagtgttgccagaaaccccatggcccactttcggcgggtaacgccaaccacttatgcacttgcgaggactttatggcccgtttcgaactgcaaaaactctacattgacggcggctacagcgacgctggcagcgatgccaccttcgaagccatcaacccggctaacggtgaagttctcgcccaagtgcaacgtgctaccaaagatgacgttgaacgtgccgtggtcagcgccgaaaaaggccagaaaatctgggccgccatgaccgccatggagcgttcgcgcatcctgcgtcgtgccgtcgacatcctgcgtgagcgcaacgatgagctggccgcgctggaaaccctggacaccggtaaagccttctccgaaacccaatacgtcgacatcgtcaccggcgccgacgtgctggaatactatgcaggcctggtgccagccatcgaaggcgagcagatcccactgcgcgacacctcgttcgtttacacccgccgcgagccgctgggcgtggtggccggtatcggcgcgtggaactacccgatccagatcgccttgtggaaatccgcaccggccctggctgccggtaacgcgatgatcttcaaaccaagcgaagtcacctcgctgaccaccctgaaactggccgagatctacaccgaagctggcgttccggctggcgtgttcaacgtattgaccggcagcggccgtgaagtcggcacctggctgaccgagcacccgcgcatcgagaaagtctcgttcaccggcggcaccgacaccggcaagaaggtaatggccagcgcttccagctcttcgcttaaagaagtgaccatggaactgggcggcaagtcgccgctgatcgtgttcgaagacgccgacctggatcgcgcggccgacatcgcgatgatggccaacttctacagctccggccaggtctgcaccaacggcactcgcgtgttcgtacccaagcacctgcaggctaccttcgaagccaagatcgttgagcgtgttgcgcgcattcgcgtcggcaacccgcaagacgaaaacaccaacttcggcccgctggtcagcttcgcccacatggaaagcgtgctgggttacatcgccaaaggtaaagaagaaggcgcccgcgtactgtgcggcggcgaccgtctgaccgacggcgacttcgccaaaggcgcctttgttgccccaaccgtgttcaccgactgcaccgacgaaatgaccatcgtccgtgaagaaatcttcggcccagtgatgagcatcctcacttacgagaccgaagaagaagtgatccgccgcgccaacgacaccgacttcggcctggctgccggcttggtaaccaaagacctgaaccgcgctcaccgcgtgattcatcagctggaagcgggtatctgctggatcaacgcgtggggcgagtccgacgcgaagatgccggtgggtggctacaagcagtcgggcgttggccgtgagaacggcatcagctcgctgaacaacttcacccgcatcaaatcggtacaggtagagctgggcgactacgcctcggtgttctaacacccgagtgttgtgctgcctgcgaggccgctatcgcaggcaagccagctcccacatttggaatgcatttccctgtgggagccgggcttgcccgcgatgaggcccgacctgaccatctcaaaagagggtgcatccaatgtcccaagaatacgattacatcattgtgggtgccggctccgccggtaacaccctggcgacccgtctgaccgaagacgaaggcgtcaccgtcctgctgctggaagccggcggcccggactaccgtctggatttccgtacccaaatgccggccgcactggcattcccgctgcagggccgccgctacaactgggcctacgagaccgacccggagccacacatggacggccgccggatggaatgcggtcgcggcaagggcctcggcgggtcctcgctgatcaacggcatgtgctacatccgtggcaacgccatggactacgacaactggtcgaaactgccaggtctggaagactggacttacctcgactgcctgccgtatttccgtaaagccgaaacccgcgacatcggcccgaacgactaccacggtggcgacggcccggtcagcgtgaccacgcctaaagccggcaacaacccgctgttccacgccatggttgaagccggtgtacaagccggttacccgcgtaccgacgacctgaacggctaccagcaagaaggcttcggcccgatggaccgcaccgtcacgcctaaaggccgtcgcgccagcaccgcacgcggttacctggacacggctaaaaagcgttcgaccctgaccatcgtcacccacgccctcaccgacaaagtgttgtttgaaggcaagcgtgccgttggcgtgcgttacctgatcggcgccgccgaagagcgcgttgaagcccgtgcgcgcaaagaagtattggtgtgcagcggcgcaatcgcttcgccgcaactgctgcaacgctccggtgttggcccggccaaactgctggaaagcctcgacatcccggtggtccacgacctgccaggcgtcggcgaaaacctgcaggaccaccttgagctgtacctgcaatacgcttgcacccagccagtgtcgctgtacccgtcgctgctctggtacaaccagccggccatcggtgccgaatggctgttcaacggcaccggcatcggcgccagcaaccagttcgaagcgggcggttttatccgtacccgtgaagaattcgattggccgaacatccagtaccacttcctgccggtcgcgattaactacaacggcagcaacggtgtgaaagagcacggtttccaggcgcacatgggttccatgcgttcgccaagccgtggccgcgtgcaattgaagtcgaagaacccgcgggactacccgagcatcctcttcaactacatggccaccgagcaggactggcaggaattccgcgacggcatccgcctgacccgtgaaatcatgcagcagccggcgctggaccaataccgtggccgcgaaatcagcccaggtattgaagtgcaaaccgatgaacagctcgacaagttcatccgcgagcacgccgaaaccgcgttccacccgtcctgctcgtgcaaaatgggcaccgacgagatggctgtagtggacggcgaaggccgcgtgcatggcatgcaaggcctgcgcgttgtggatgcgtcgatcatgccgatcatcaccaccggcaacctgaacgcgccgacgatcatgatcgccgagaaaatcgccgacaagatccgtggccgcaagccgctgccgcgcagcactgccgactactacgtcgccggcgatgcgccagtgcgtggcaagccgatgcgtgaagtaggccctactgcgcagtaaaccgtaactgatcattcccacgctccgcgtgggaatgcatcctgtgacgctccgcgtcacgacctcaaaagcggacgcaaagcgtccagggcggtattcccacgcagagcgtgggaacgatcacctgagaagtgctagcctcagaggctgcgttgccctcaggaggccccatgttcgaccaccacgccacactcaaaaagcacttcagtgccctgcgcaccactgccgaatttttctcgctgcgttacgtgcgcgaatccggccaatacctgtcggtccgcaagaacgtcgccgagccgccgcacttgaaccacgacgagggcgccatgctcaccgtgcgtctcaagggcgtggaagcctacgccgccaccaacgacatctcccttgccggcctgcaagccgcccttgagcgtgctgaacagcaagcccggcgcatcttgccccacgccctgctcgacctgcacacgcagccggtggccagcgatgtcgccgactacctgtcgcctgagctcgaccagcccttcccgtccctgagcgactgctaccaactgctcggcgacgaatcggccagcgtgcccaaggacgagcgcctggtcagttgggaagtcagcctgggcaccactcgggttgaacagatttacctcaacagcgccggcgccgaactgcgccaggcccagcgcttcgtctatccgggcctgagcgtcaccgccttcgacggcaacgacagccagacccgcaccctgggcggcaccaacttcggccagcaaggcagtgccaacgtgattcgccgcttcggcctggcaggcgccgcccgcaccgtcgccgaccaagcgctgcaattgctgctcgcgccgaacacgccccacggcccgcgcgacctgctgctgatgcccgaccagatgatcctgcagatccacgagtccatcggccacccgctggagctggaccgcatcctcggcgatgagcgcaactacgccggcaccagttttgtgaaggtcagcgacttcggccacctgcaatacggctcgcccttgctcaacgtgaccttcgacccggacatccccgagcagctcgccagctacagccatgacgacgacggcacccgcgccaccaagcagttcctgattcgcgacggcctgctgctcaagccactgggcggcgcgctgtcgcaatttcgcgccggcatgcaaggcgtcgccaacagccgcgcctgcagctggaaccgcgcgcccatcgaccgcatggccaacctgaacatcgaggctggcgacaaaacccaggccgaactgatcagcggcatcgagcacggcattttgatgagcaccaaccgttcctggtccatcgacgatgcgcgcaacaagttccagttcggctgcgagtggggccaactgatcgaaaacggcgagctcaagggcgtggtgaaaaaccccaactaccgggcgatttccgcgcagttctggcgcaagctcagcgccgtcggcgacgccagcaccttcaaggtattgggcacgccgaactgcggcaaaggcgaacccaaccaagtgatccgtgtgggccatgcgtcgcctgcgtgtgtgttcagtgatgtcgacgtgtttgggggagatgcctgatgaacaacttcaagacactggtggaatggctcaagcaggccatcaccgacaaggaacagtttcacctgggttatgcggacgaatcgtccgagttcgtgcgcttcaaccacgcgcaagtgcgccaggccgggcaagtgcaacaggccagcctgaacctcaagctgatcaacgacgggcgccatgccgacctcggtatcaccctggcaggctcgcccgaactggatcgccaacgcctcgccgatggcctgcagcagttgcgcgaaaccttgccgctgctgccgcaggacccgtacctgctgctcaatcacaccgcctggcaaagccataacgaacagctgcgaccgctgccggaactggcccaggtgctggaagaaatcagccaggcagcgcaaggcgtggacttggtcggcttctatgctgctggcccgatcagccgtggtttcgccagttcggatggcgcattcggctggcaccaggccaacagcttcaacttcgacttcagcctgttccacgccaacggcgaagcggtcaaagccagctacgccgggcacacctgggacagtgccgagttcgccgcgcgcttccagcaggcccgcgagcagctggaattcctcgggcgcccgctgcacaagctggcgcccggccaataccgcgcctacctcgcgccggcagcgctggaagaaatcatcagcatcatcacctggggcgggttttcggcgcaggccatcgccagcaaaagcagctcgttgcagaagctgtatgccggtgaacagtcgctgagcccgctggtgaaggtcgatgagcagatcagcggttcgctgagccaggcgttttccaccgaaggctacccgcgtggcgatgtcacgctggtcaatgccggcaaagccgagggccagttgatcaactcgcgcagtgctgccgaatacggcctgagcaccaacggcgccagcagcgatgagtcgccgagtgccttgcagatggcggcgggcagcctggcccaggccgatatcctcaagcaattgggcaccgggctgtacatcagcaacttgtggtatttgaactactcggacttgccggccgcacgcctgaccggcatgacgcgcttcgccacgttctgggtggaagacggcgagatcaaggcgccggtcagcaccatgcgttttgatgacagcgtctacaacttgctcggttcgcaacttgaagcgctgacggctgagcgggagctgttgttgtcggcgagtacgtacagccagcgcaataccgcctccaacttgttgccaggcgccttggtcaaacgcctgaccctcaccttataagcactgcgactcccctgtgggagctggcttgcctgcgatagcatcacttcggtgtcactgatacaccgaggtgtctgcatcgcaggcaagccagctcccacactgttctgggctcgttccttacagcctcttttagctccttcctaccgaaaaatcccatctcacacttctccccgtgcggccggttgtcgcccacaaaaaacctcgttataacggttagtggcatcccgccacctaccccacgtgcctgcacgtgatgcatgaccttgcctggattgggcaagctggagcgttgacatggaccatggaagttttgtcatagaagggctgttcaaacactacaacgttcacgttgagcagctcggtaacgattcggaaaagaaaacagtactgctggtcaacggagcgctgtctaccacccgctcatttgcccgcaccagcaaatgcctggcggaacacttcaatgtgctgctgttcgacctgccgttctccggctattcgcgcgagcacaacaccgacctggacctggtgaccaaggacgacgaagtgcaaatcctgcgggcgctggtggagcgcttccaggtcaaccatctggtctcggcctcctggggcggcatctccacgctgctgaccctggcgcacaacccgccttccatcgaaagctcggtggtaatggccctggcgcccaatctcaaccaggccatgctcgattatgtggagcgcgtgcgcgtgctgatcgaggccgatgacaagtcggcggtcggccacttgctcaacgagacggtcggcaaatacctctcgccaaggctcaagcgcaataaccatcggcatttgtcgagcatggccaccaccgagtaccgccaggcgcgctttcatatccaccaggtgctgggcctgggcgatggcaactacctgccggcgctcacgcagattgaaacgccggtgcatttcatcaacggcgcgctggatgaatacaccccggcagcagaggcccaactgttcaaaaaatacgtgggccgcagcaccttcgccgtcgccgaacacaccggccacttgctcgaccttgagtcccgcgaggccgcgttggcggtgcaccgtgcgctgttggattttctcgtcggcgagcacgcgacattgtcagatttagacgaaccgccagtgggaaaaggagcgatggatggcgcataatcgcgacacatagcctgctaacaaaaaggtagctcatgcccaatcgcgccccactcgatgccaagaccgcccgctggctcccctgggtggtggcgattgccttcttcatgcagtcgctggatgggacgattctcaacacagcactgccggccatggcccgggacctcgcggaaaacccgctgcgcatgcaaggggtggtgatcgcctacatgctcaccgtcgccttgctgatcccggcctcgggctgggtggccgaccgcttcggcaccaagaaaatcttctttggcgcgatcatgctgttcagcattggctcactgctatgcgccctgtcgagcagcttgaccatgctggtgggcgcgcgggtgatccagggcttgggcggcgcgttgatgctgccggtcgggcgactcgtcgtgctgcgcgcttacccgcgctccgagctggtgcggatcatgggcttcattaccatccccggcctgctcggcccgttgctcggcccgaccatgggcggctggatggtgcaatacctgacctggcactggattttcctgatcaacctgccggtgggcatgatcggttgctgggctgtgtggaaactcatccccgacctgcgcggcagcgagcgcacgcggttcgacagcatgggctttgtactgtttggcgcggcgatggtgctgatcaccatcgccatggaaggcctgggcgaactgcacctgccgcacctgcgggtgatgttgctgctgttcggcgggctggcgtgcctggcggcatactggctgcgcgccgggcacatcgataacccgttgttctcgccggtgctgttcaagacccgcacgtttgccgtgggcattctcggcaacctgtttgcgcgcctgggcagcggcgccctgccgttcctggtgccgttgctgttgcaggtggcgctgggctactcgccctcggaagccggcatgagcatgttgccgctggcggcggcggcgatgtttgccaaatccatcgcccgcaccttgatcgaacgcctcggctaccgcgtggtgctgaccggcaacacgctgttcctcggcatcatgctggccagcatgggcctggtcagcgagcacacgccttacccgctgctgctatgcatgctggcgattctgggggcgatcaactccctgcagttcaccgcgatgaacaccgtcaccctgatcgacctcgacgacgcccaggccagcagcggcaacagtttgctctcggtggtggcgcaattgtccctgagcctgggcgtggcctgtgccggtgcgctgctcggcggctttaccgctgaaaccggcaatgacggtgtggaaagcgtcctcggcgcgttccaactgaccttccttaccgtgggcatcatggccatgctggcggcggcgatcttcctgcaactgtcgcccaccgacggcaaacgcgtggtcagccgcgagcatgacatcgagcattaacaggcttcccgtctagaacttgcagggaaaatcctgtgggactggtacactgcgcaacattttgttttgcagagccagtcccgtgactaccatcgccaccgcttttaatactttgcccctgtccgccgccatgctggctaacctcgactcgctgggttatgtcgagatgacgcagatccaggcgcaaagcttgccggtgatcctcaaagggctggacctgattgcccaggccaagaccggcagcggcaaaaccgccgccttcggcatcggcctgttgaacccgatcaacccgcgttacttcggctgccaggctttggtcatgtgcccgacccgtgagctggccgaccaggtcgccaaggaaatccgtcgcctggcgcgcgccgaagacaacatcaaggtgctgaccctgtgtggcggcgtgtccctcggcccgcagatcgcctcgctggaacacggcgcccacgtcatcgtcggcacgccgggccgcattcagcagcacctgcgcaaaggttcgctggtgctggacggcttgaacacgctgatcctcgacgaagccgaccgcatgctcgacatgggcttctacgacgccatcgaagacatcatcagcaagaccccgccgcgccgccagaccctgctgttctcggccacctacccggtgagcatcaagcagctggcctccaagttcatgcgcgcgccgcagcaagtgaaggccgaagcgttccactccgacgaccagatcgaacagcgtttctatgagatctcgccggaagagcgcatggacgccgtgaccaaggtgctggcgcacttccgcccggcctcgtgcgtggcgttctgctttaccaagcagcaagtgcaggaaaccgtggatcacctgacctccaaaggcatttccgccgtcggcctgcatggcgacctggaacagcgcgaccgtgaccaagtgctggcgatgttcgcaaaccgcagcacctcggtgctggtcgccaccgacgtggccgcccgtggcctggacattgactcgctcgacatggtgatcaacgtcgaactggcccgcgactcggaaatccacatccaccgcgtaggccgtaccggccgcgccggtgagaccggtatcgcgatcagcctggtggcgccgtccgaagcgcaccgcgcccaagccatcgagcagttgcagaaatcgccgctgaactgggaccaactggacaacctcaagccgcaaagcggtggcccgctgttgccgcagatgagcacgctgtgcatcgcggccggccgtaaagacaaggttcgcccgggcgacatccttggcgcactgaccggtgaagccggcattccgggtgcccaggttggcaagatcgcgatctttgatttccaggcgtttgtggcggtggagcgtggcatcgccaagcaggcgttgcagcgcttgaatgacggcaagatcaaaggccgttcgttgcgcgtgcggatcctgtaacaacacgcatatttactgtgggaaccgaatcaatgtgggagctggcttgcctgcgatagcggtggtgaattcactacagccatcgcaggcaagccagctcccacatttgattgcattccaaggcaatcttttgtgaggacatcgttttgcgctcgaccgaagttgtgatcattggcgccggcgccgcaggcttgatgtgcgcgctgaccgccgccgggcgtgggcgcgaggtgatgttgatcgaccacgcgaacaaggccggcaagaagatcctgatgtcgggcggcggccgctgcaatttcaccaatatgtacaccgagccggccaacttcctctcgcacaacgcgcacttctgcaagtccgccctggcccgctacacccagtgggattttatcgggctggtggccaagcacggcgtgccgtaccacgagaagaaactcggccagttgttctgcgataacaagtccagcgacatcctcggcatgctgctcgatgagtgcattcaggtcggcgtaagcatgcacctggacacctcggtgcaggagattgccaagctggacgccggttatcagctgcaaaccaccttgggtgagctgcgctgcgaatccctggtgatcgctaccggcggcctgtcgatcccgaccctgggcgccaccggttttggttaccaagtggccaagcagtttggccatgaactgctgccgacccgcgcagggttagtgccgtttaccatcaccgaccagctcaaggacttgtgcggcgagttgtcgggcacctcagtggactgcctggtcagctgcaacggccagagctttcgcgagaacatcctgtttacccaccgcggcctcagcggcccggcgattttgcagatttcctcgtactgggaaaccggcgacaccgtggaaatcaacctgctgcccgaccacgacgcccacacctggctgcaacagcaacaggtcgagcgccccaacagcgagctgaaaaccctgctgggtgagatcttcaccaagaagatggccaacctgctggcggaaacctggtttgtgtccaagccgatgaagcagtacacccacgctgaaatcgccgacatcgcgcagaagctgggcagctggcaactggtgcccgccggcactgaaggctatcgcaccgctgaggtgacgctggggggcgtggatacgcgggaagtgtcgtccaagaccatggagtcgctgaaaagcccgggcttgtacttcatcggtgaagtgctggatgtgaccggtcacttgggcggtttcaacttccagtgggcctgggcctcgggctacgcggcagcgcaatacgcctgacgccgctcaaaccttgaaaggcaatcccctgtgggagctggcttgcctgcgatagcggcgttggattcaccctcgctatcgcaggcaagccagctcccacattggttttgtggagtgccgggaagttattttgcgcaattgatgtgatcgccacgcttgccgtggcgtccttgatagctcaatttagcggcatcgtcccggaagactccagacttcatgtcatcgacctcgttcaagcagtccatgcggcgcctgtgggcgctggataaattcagttacagcgtacgggtattcatcgccctcaccggcagcatggcgttgtgctggtatcaggatgaaatgacgctgctgatccccctgttcctggggattatcgccagcgccctggccgagaccgacgacagttggcaaggccgcctcaacgccctggcggtgacgctggtgtgtttcagcgtcgccgcgctgtcggtggagctgctgtttccctacccgtggattttcgcgattgccctggccctggccagtttctgcctgaccatgctcggcgccttgggcgaacggtatggcgcgattgcttcggcgacgctgattctgtcggtctacaccatgatcggcgtggaccagcgcggtggcgccgtctctgacttctggcacgaaccgctgctgctggtggccggcgccgcctggtatggcgtgctttcggtgctgtggcaggcgctgttttccaaccagccggtgcagcagagcctggcgcggttgtttcgcgaattggggcgctacctcaagcttaaatcatccttgttcgaaccgatccgccagctggatgtagaagcgcgccgcctggaattggcccagcaaaacgggcgggtcgtggcggcgctgaatgcggcgaaggaaatcatcctgcaccgcgtgggcaatggtcggccgggctcgaaagtcagccgctacctgaagctgtacttcctggcccaggacatccacgagcgcgcaagctcctcgcactacccgtataacgcgctggccgaagccttcttccacagcgacgtgctgttccgctgccagcgcctgctgcgccagcaaggcaaagcctgccaggcgctgggcgaatcgatccaactgcgccagccgttcatttatgacgacagcttcgccgaagccctcggcgacctgaatgcctcgctggaacacctgcgcatccagagcaaccccgcgtggcgcggcctgttgcgctcgttgcgcgcgttggcagccaacctgtccacactcgaccgcctgctgggcgacgccagcaaccccgactcactcgccgacgccaccgacagcaacctgctcgaccgcgccccgcgcaacctcaaggaaatgtggacgcgcctgcgtacgcagctgacgccgacgtcgctgctgtttcgccacgctttgcgcctggccctggcgctgaccatcggctatggcaccctgcatgcgattcacgcctcccagggctactggatcatcctcaccaccctgttcgtctgccagcctaactacggcgccacccggcgcaagctcggccagcggattatcggcaccgccatcggcctgaccgtggcctgggcgctgttcgacctgttccccagcccgctggtgcaatcgctgttcgccatcgccgccggcctggtgttctttatcaaccgcaccacgcgctacaccctggctacggcggcgatcaccttgatggtgctgttctgcttcaaccaagtgggcgatggctacgggctgttcctgccacggctgttcgatacgctgattggcagcctgatcgcgggcctggcggtgttcctgttcctgccggactggcaaggccgtcgcttgaacaaagtgctggccaacaccttgacctgcaacagcatctacctgcgccagatcatgcagcaatacgctgcgggcaagagcgacgacctggcttaccgcctggcccggcgtaatgcgcacaacgccgatgcggcgctgtccaccacgctggcgaacatgctgatggagcctgggcactttcgcaaagaagccgacgtgggcttccgctttttggtgctgtcgcacaccttgctcagctacctgtcagggctgggcgcgcaccgggaaacccagttaccggccgaagtgcgtgagcacttgatcgacggcgccggcaacagcctggcggcgagcatcgacgaaattgctacagggttggccaacaaggagccgatcgcgattcagagcgatgccgaagaagcgttggccgcggacctggagcagatgccggatgagatcgatgaggggcagcggctggtgcagacgcagctggcgttgatttgtcggcagttggggccgttgcgcacgttggcggcgcacctgatcaaagatactcgcgcggcttaatgtgtgttgtggcgagcgggcttgtcccgcgttggggcgcgcagcggccccagataaaaccgctgcggtgtatcaggtaaattaaggtctcaggtgtggggctgctgcgcagcccaacgcggggcaagcccgctcgccacgacaagcaaagcgctcatcccgatcacatcccatgcgccttcatcaaccgcgcataactgccatcaaccttcatcttggcaatctcccggtcaaaactggcgacgatctgctcgtgctcagggttcttcaggctgaccagaatatgcaggctgttttcactcaacggcttgggtaaaaactccacggcattgcgcacccgcggcgactcacgcgccaggtaatagcgggcgacatattcatcttccaacgtcagccttacccgctgcgccgcgagcatgcgcacggccatggcgaagttatgcacgggcactttctgcaactgcgcatcctggtcaaaggccgccgaataggcatagccgcgcaccacagcgatggactgatcatgcagttgttcgaggctttgataatcgatggggtcgtcgcggcgcttgataaagcgcacgcggttcagcaggtactcagcggaaaactgccccagttgcgtgcgcgcatcgtcgtaccaggcattgatcagcacgtcataccggccatcgcccacgcccatcaacgcccgcgcccaaggcacctgttcgaaatcactggcgtagccggcgcgggccaaggccgtgctgacaatatcagtcgccaacccgccgttgatcaaggtggaatcggtaaacggcggccaggcatccgcgaccaggcgcagacgttgtgcgaccgcaggctgggccagcaacaacactcctatcaaagcaacggcacgagaaaatcgcggcatgcttaaagtccttggcgggcaggcagtggcctgataacagtagctcatcaatgagcctgcattgcagattacacaaagaactcagcggcgctcgcactgaatgatggcaaattgacgccattcacaaaaatgctcaatttagacagggctgtccgtcgcgcttactatcgacaacggtcattaataagggaacacaccatgacggttgattgggtctgcaaacaccacgatgacttgggcaaggagcagctgtacgccattttgcgcctgcgcagcgaggtctttgtcgttgaacagcagtgcgtttatccggacctcgacgggcaggacctgtcgggtgatacccaccacctgatggcctggaacgatgacgcgttggtggcttacctgcgtctgctggaccccgagtcccagggcggtgatgtggtgatcggccgcgtgattgtcgcgcccgtggcacgcggcaccgggcttggccatcagatgatggaagaggccctcaagcgcattaaagatatctggcctgaaacgccgatttttctgtcagcccaggcgcatttgcaggggtattacgggcggtatgggtttgtggtggagggtgaggaatacctggaggatgatattccgcatattggtatgcggcgtcagtgaggccgccatcgcaggcaagccagctcccacatagatgtgggagctggcttgcctgcgatgaggccagaccaatcaccgccacattcagggataacccaacacctgcttgatccccgccagattagcctcgatccacccgcgatcaatcgccccccaactccgaatccgatagtgccccgcatggttgcgcgcgccatcttcctgctcgaactcacacacgatatccaggtcggccagcgccgcaatcgtatcctgcgccgtgcgccggggcatgccggtggcgtcggtcagcgccgggacgctgctggcctgcccgctgtcgatcaaatacgccacgtacagacggcggtagaaactgcttttggtcttgctcacgtccatgctcagtcgcctggtgaggttagggcttgccctgcaaatcgcgatacgtgaggtacacccgcaggtcgaattccacctgatggtagcccggcatcatgtattcacagagtttgtagaacgccttgttgtggtccgattccttgaagtgcgccagctcgtgcaccacgatcatgcgcagaaattccggcgccgcctctttgaacagcgcggcaatgcgaatctctttcttggatttgagattaccgccctgcacccgtgaaatcgtggtgtgcaggcccaaggcgcgatgggtcaggtcgaggcggttgtcgaacagcaccttgtcgatggccggcgcgttgcgcaggtgttcctgtttcaaggccagggcgtagctgtacagcgccttgtcactctgcaccgcatggcgctcggggtaacgctgctccaggtaggcacccaactggtccttggcgatcagttggcgtacttgctcctggagcgctgcggggtaagcctggaggtatttcagcgcggtcatgagttcagcaacagggttcgaatgggcgccagtgtagcgaattcaaagcaagcgcgggtgggaccagtcggccacttcctcggccaccaagggcagcgccgcccacgccccttggacaaatgagcacccattggccttgagccactgggcctgttcgagggtttccacgccctcggcgaccaccagcacatcaaaatgcccgcacagctggatgatgctgcacgccatcgcagcgtcccgcaccgaacccggcaggcgcgccaccaattgcgggtcgagcttgagcgtgtcgaactccaggtcacgcaagtgggccagggaacactggccgagaccgaagtcatccaaagcaatacgcaccccgagctgacgcaataacttgagctgcttgttggtttcctcaaggttactcatcaggctgtcttcgctgatttccacctccaactgccgcccctgcaacccatgtcgctcaagtacctgctgcagttggccggccaggttgggcatattgaactggctgctgctcaagctcacgctcaacaccagcgcgtcatcgaaggtggtttgccaggcctggcgttgggcggcgacctgctggtagatccaggcgctcaattggctgatcagccgcgcctcttccagcaacggtaaaaacaagcccggcggcacatcgccgacactcgggtgctgccagcgcagcaatgcttcgacgccgcgtaaccgcccgtcctccagcgacacctggggctggtacaccagggtgaaatccttgttttgaatcgcggtgcgcacgctgtcttcgagcatcagccgcgagcgggcgcggccgttcatttcctgatcgtaatagcgatattgctgacgcccggcgcgcttggcttcgtacatggcgatgtcggctgcgcgcagcaggccgttcaggtccgagccgcagtcagggaaggtcgcaatgccaatgctgacgccgagcatcacatccaaaccgtcgacctgctggcacacggacacgcgttcgatcagtttttccgaaatcttggccgcctgttccggaaactccagctccagtaaggcggtgaattcgtcaccgcccatacgcccaagaatgtcgtaggagcgcaaacacgcctgcatttgctccgaaacccagcgcaacacgcggtccccggcgtcgtggcccaacgagtcgttgacccgcttgaagccgtcgaggtccaggtacagcagcaccagcgacagctcgttacgttcgctgcgcaataacgtgttctccaccgcctggtggaagccacgccggttcaacagcccggtcagcgggtcggtcaccgcctggaactcgagttgctgatgcagatggcgcacctcggacatgtccagcaccgtcaccaccatggcgttctgctcggcgggcaacggcgcgcaggacaaggccaccggcacctgctggccgcgactggtgcgcaaaatcgcgtcgtgctggcgccacgtctcgcccttgcgatacgcctcgtacatggggaagcccaaccaggtgggcacatggggcttttgcaggaaactcaggaaactctcgccctgcaactcggccatcgtcgcattcagcagccgcgaaatggccgggttggcgtactggatcacactgccctcgcccaccaccaggatgccctcggcggcgttgtcgagtattgaggcgttaaaggcgcgggcggactccaggtcatggctcaggcgctgcaaggcccggcgattgcgctggtgctccagcagcgcctgcaccttgggcttgagaatgtgcgggtcaaagggtttgaacaggtaatcaatggcgccgctggcgtagccttccagcacggaggcggccgattgggcgtgggcactcaggaaaataatcggcgtcatgcgcgtgcgttggctgccacgcatcaggcgcgcgacctcaaagccgtccatgccgggcatgcgcacatccagcaagaccaggtcgacgtcgtgcgccaacagcaattccaaggcctccagcccggacgctgcggtcatcacatgccagtcttcgcgctgtaaaagcgcgcgtatgctgatgaggttttccgggtagtcgtcgactaccagaagaaccgaactgccatcgccgtggtgtggagcgcaatccatgctacgtctcttccttgaggggctgtaccggtcacttctgatgaaaaacccggacaaacactgaggcctcactctagccccggttctaaaaaagcagaagtgacgtgggtgccatcattgcgccaaagcccaggaagccgactaacggtcaagccctacaacccacggttcatgggaaccatggctttttggcattcctctgacgccaataaatcgccagcaattgtttaacaacccgacgatcaccgcctataaagaacctgtgaggcccacgggccagcgctttcaccctctgtaaaaggccaacaccatgatcgacctttccacctggaacctgagcattccggtcggctcgccgcccgcgaccatcgacacgccgaaactgcttagcggcttcaaggaccaatatttccaggccgaaggcagcaacgtgcaattctggacaccggtgaccggcacccgcaccgaaaacgccgtctacccgcgcagcgaattgcgcgaaacctacgccgatgggcgtttgcgcaactggacctataccgacgccgacaactttctgcgtgccacgctggccgttaaccaagtgccctccagcggcaaagtggtcatcggccagattcacgcctatgacagccagaaaccgctgatcaagctcgaataccaattcaaggaaaagacccagaccggcaacatcgtcgccaaggtgcgcatgcgcccggatgaagatgaaggccgcgtgattatcgtcgcctccaatgtaccgctggagaagagctttacgtacgtgatcaacctcaacaaggccggattgctgagcgtcgaggcggctgacgggcagtggaacgaacgcattggtgccgcgtggggcgccaagccgttgtacttcaaggcgggggcgtatgtgcaggacaacagtggcaatagcaaggaaggcgcgcgggtaacgtttgcgaagttggatattgatcacgagtaatgcttgagagaagccccggcaataccggggcttctgagtagtattatttattcaacacacatcaacatgaaacccatcgacgaatcacccgccggtttattatcgcccaccttaagcgtcaagacattcacgtaattaattgccggcagactgcccaacttcgcatgtccatagaagatatgatcattggaacttacatcggttaccgagacattgcagaaacgcggcggctgtttaaaaacgccaggcacaaagcggactttgtactccgagaagtaatcaggctgcgccgttaacttcacctctttcagccactggggcgattgcgcaatgacctggcctttattatcaacagacgcggtgaatatccggctatccgcgtaggcaaaagaccccgttgccgccaacaccagaacagcgccaacgattttaataaaattcatcatcaattctccatcattgaatagcatcaaggcccgaaccttaaatgattcgatgacgataaaagcgcactttcaatgacgcacgactaaaacagaaaaactggagaagcaaagagaaaacaccatatcccttcccggaaacttccgattgtgaatacgggggcgtttcgatttgtaggcaatgtccgattagctaaaggacaattcaccggttaatccaaacactcaaccccctcactcttccctgtgggagccgggcttgcccgcgatggcggtggttcagccattatttgcgttaactgacacaccgctatcgcgggcaagcccggctcccacaggggttaggcgttggcagacggtccagtggtcgtcctacgcagccgttgcggccagctagatcggcgcttatagttcgccccgtcgctggctttgatcggcgatagggtttcgcagccctaacgatacgtgtgtaaccaagcatcatgaatgcaacgacggcgcttctgcgttcggcgtttactttatggtggctgtgtgtgggagaccttcgggtctgccgggttcctcgtatcctcggtctgcgaacccgcacacagctaccacccattcgtttcgcagcgaacggcggtagtccttttagatacgaggaatatttgccatgacccaacaactaccaccccgccgcttcaccccatgcaccgaaaccgccaccgattaccccgtgctattaatcgacagcgacgccccactgctcgacctccacgcttgcctgcgcgaacgcctaaacgcagcccttgaacacctcaacctgatcgcctgctccagcctgccggacttcgccgagcgcgacttgaataacatcgccaatacagcgcgcattctggtgcaggacgtgagcgatgtgtttcgtgtcatcgaacaccgtggtttcgataagcctgacgctgcctgatcaaatcccagccacaaaaaagcccgcatcgctgcgggcttttcgtaggctcttaaggcgcacgtgttaccactggctttcgccgcatacccgacgcaacagagtcatgcagcgccatcgtacggcctgcgtcccattctttctgcatcgttgtaaacagttcaacgtcaattcgtacttgatgagcgcgtaatgcctcagacatggcgtcgctgattcgctcaataatcatccctgggtttgccaccccgcaatgcttgcggccaaattcgatcagttgctgacgatccggataggccttcaccttgttcatcttgatagctaaggtgcggtcgaccagtgactgaccagacttgggattgtaattctcgtacacggtagtggtcgtcacgtcgaatacaggcgccaactgcacggtttcaggggctccagggtgggtatagagcacaccgaaatttttcaggtgggcatcgccattgcgcaccatgaccgacaagcaaacgtatgagaaaaaacgttcaagctcacgcagcacatcgccgtgccggcaaacttcgttgattaccgcagcaagcgtttcgtagctttgggagtatttgtagttatcgtgaggatctttgttcagccccaacaacaccgccatatcctcaaaacccaacctgcccgactcagtcagatcaaagcgctccatgacaaagagatcgcccctttcagacagccagaaacgcggcgtttccaagccggcgaggcgagcagcttccaaacagagaaattcattctgagccaagtgagcatattcatcagcgccggacttcacgatcaagtcggaactgagcatcgttttacgattgcctgtcagcttatccagatcaggcaccaacaccttcggctgcaccccggaaatacctgactcaaaataggtctcaacgaggaaatcgaatacgccctgtgaggtatccccagacagaatttcctgtaacccgacctgcgccctcactggcgcagaagcctcaatggggttctcgtaactcagtcgaccaatctggttgccgccgatgatcgacagcaagcgcatctcgtccacttgcatgtgcttggccatacgacgcttaatctggtcagccaggaagccctccggcacattcatatcaaaaatcggatgtaatacgttgctgaccactggcgtcgggtcatatggaatcaccagtgacacttcgcaggaagcctgcgcagaggcgtaagcaaacgaaaactgtgagcccctggacagttcgccggccacgccttgaggcgtagtgatgttgagtaacttgattttactcatcgtgctcgaccagttcggcgagggatttaaggtcgattcgccggtcaacgacttccagcgccatgccaagggcgctgataaccctgaagacggtgtacatagccacgttttcccccgcctcaagatcaatgatcgtcttgcgactgcatcgagctttttccgcgagctgttgctggctatatttcttggctcggcgcagctgtttgagccgctcgccaaatgagggaggattggtgatcagcaaaatgtcacctatatgggactttttaacgaatatgtttgattatgtccgctatgacggacatttcaaataaccttacgtcgacttattcacagccacaaaaaagcccgcatcgctgcgggcttttttttaaacgcctgaggttcagttcaccttagcgttcaactcgcctttcaggtaacgctgatacatcgcttccaacgagatcggcttgatcttcgaagcattaccggcagtaccaaaggcttcgtaacgtgcgatgcacacgtcacgcatggcggttacggtggcgccgaagaatttacgtgggtcaaattcgctcgggttggtggccatcaggcgacgcatggcgccggtggatgccaaacgcaggtcggtgtcgatgttgaccttgcgcacgccgtacttgatgccttcgacgatttcttcaactggcacgccgtaggtttctttgatgtcgccgccgtactggttgatgatcgccagccactcttgtggcaccgaggaagaaccgtgcatcaccaggtgggtgttcgggatgcgtttgtggatttccttgatgcggtcgatggccagcacgtcgccggtaggcggcttggtgaacttgtaggcgccgtggctggtgccgatggcgatcgccagggcatccacttgggtcttcttgacgaagtcggcggcttcttccgggtcggtcagcatttggctgtgatcgagcacgccttcggcgccaatgccgtcttcttcgccggccataccggtttccagcgaacccaggcagcccagctcgccttcaaccgaaacgccgcaggcgtgagccatggccacggtttgttgggtcacgcgtacgttgtactcgtagtcggttggggtcttgccgtcttcgccgagggagccgtccatcatcaccgagctgaagcccagttggatggagcgctggcacacgtcagggctggtaccgtggtcctggtgcatgcacaccgggatgtgcgggaattcttcgatcgcagcgaggatcaggtgacgcaggaatggggcgccggcgtatttgcgggcaccggccgaagcctggacgatcactggggagtcggtcttgtcagcggcttccatgatggcgcgcatctgctcaaggttgttgacgttaaaggctgggacgccgtagccgaactcggctgcgtggtccagcatttgacgcatgctgataagtgccattgtgttgtctctcccgatcgtgggtcgttaatcgtgcaagcctgccgtagcggcggctgctattcaagttattgcaggccagggtttgcatgcctggcttgctgaatcgttattgctgcgtccgattcaaaatccatctcacttttgaaccggatctactgtgggagcgggcttgctcgcgaaagcgctgtatcagcaaacacattcattacagacccaccgcattcgcgagcaagcccgctcccacattttgatctcatcacattcgagatcgtgttcgtcttactgggctttgcagcctcgcccgatcaaatcatcggtggcgacccagtagatcaggccttcctcacctttttgatgaaacgccagctggtcattgctgtacagcacgcccgaggcagcgacgtcctgtttaaggcgataaacctggtccgaaccgccgaggcgtacatccacttcggagcgggcctggttggcaaagcgccagttgacctcggccttgctgtcgcaggtccaggtggtccacttgtcggcaggctctgccttgttgaacatgttcatgctgctgcaaccggccaatagagccagggctgccagggcgaaaacgcctttcattgccaatcctcgaacgacggcccaagggccgccactgctgtcggttagttgatcagacccgtcaggggcaaccctgttcctgaccgttgggcgcggcgtcgtatttctccaaccgctcattgccgatgcgcttgttgatcaccggcatggtttcggcttgccagtcggcctggtagcagctctttttttgccccggcccaggatctgcggccacaggcttagcgcttggcgtgctgccgcagccggccaacaggcccgctgcgatcaccagtgccaacgacttgatcatgggaatactccttttccggatcacgagcctcagcctttggcccgggtttccagcacttcaacggccggcagcactttgccctcgacgaattcgaggaatgcgccgccaccggtagaaatgtaggagatctggtcagcaacgccatatttatcgatggccgccaaggtatcgccaccgccggcgatggagaacgccgagctttcagcgatggcgtgggccagtactttggtgccgttgccgaactggtcgaactcgaacacgccaaccgggccgttccacagaatggtcttggacgacttcagcagctcggcgaagttggctgcggtttgcgggccgatgtccaggatcatgtcgtcagccgccacatcagcgatgagcttgacggtggcttcggcgctttcagcgaattccttggcaactaccacgtccaccggcagcggcacgctgactttggcagcgatggcgcgggcggtgtcgagcaggtccggctcgtacagcgacttgcccactgggtgcccggctgcggccaggaaagtgttggcaatgccgccgccgacgatcagctggttgcagatctggctgaggctgttgagcacgtccagcttggtggaaaccttggagccggcaacgatggcagccattggttgggccggagcgcccagggccttgcccagtgcatccagttcagcggccagcaatgggccggctgcggcgactttggcgaacttggccacgccgtgggtcgaaccttcggcgcggtgcgcagtaccgaaagcgtccatcacgaacacgtcgcacagggccgcgtattgctgggccagctcgtcgctgttctttttctcgcctttgttgaagcgcacgttttcgaacagcacgatgtcgccggcttttacgtcaacgccgcccaggtagtcagccaccagcggcacgtcacggcccagggctttactgaggtattcggctacaggcttaaggctgttttcggcggagaactcaccttcggtcgggcgacccaggtgggagcagaccatcacggccgcacctttttccagggccagcttgatggtcggcagcgaagccaggattcgcgcatcgctggtgacaacaccgtccttgactgggacgttgaggtcttcgcgaatcagtacgcgcttaccttgcagatcgaggtcggtcatcttcaacacggtcatgggtcgcagttcctgagttactgttgaggttgtttagaggcgatgtgcagataatgttccgcaacatccagcattcggttggcaaacccccattcgttgtcgaaccaagccaggatgttcaccagccgtgggccggaaacgcgggtctggctggcatcgacaatcgccgaatgcgggtcatggttgaaatcacaactggcgtgcggcaactcggtgtaggccaaaaggcccttgagcgggccgctggtggcggcgtcgcgcaatatccggttgacctcagtggcatcggtgtcgctgacggtttgcatggtgatgtccaggcaggacacgttcaccgtcggcacccgtacggctttggcctgaattcgcccggcaagttccggtaacaatctttcgatgccacgcgccaggccggtagacaccggaatcaccgactggaacgccgagcgggtgcggcgcaggtcttcatggtgataggcgtcgatcaccggctgatcgttcatcgccgagtggatcgtggtgatcgacacataatccaggccaatcgcctgatccagcaggcgcaacagcggcacgctgcagttggtggtgcaggacgcgttggacaccagcagctcgttgccggtcaggcagtcctggttgatgccgtagacgatggtggcgtcgacatccgcctcgctggccatcggctgggaaaacagcacacgcggcgcgccggcgtcgagaaaacgctggccatcggcacgggtgtggtagacacccgaacattccagcaccaggtcgacgcccaatgctttccagtcgatgccttcgggggtggcactgcgcaagacctgcacgcagttgccattgatatgcagacaatcgccttcgacccgcacttcgccagggaagcggccgtgggtggagtcaaagcgtgtcaggtattcgatgctggccatgtcggccaaatcattgatcgcaacaatttcaaacccggccgccgcccctcgctcgaacagagcacgcaagacgcaacgaccaatgcggccgtagccgttgagtgcaactttgtagggacgcggttggggcatggggttctcgattaccttgggtaatggggtggctgttagaccgctttcgcgagcaagcccgctcccacatttggaatgggttcacaattcaaactatgtgaacccgatctaatgtgggagcgggcttgctcgcgaaggggccagtacagccacctcaatttacagccttagtcttccagcagttcttcagcctgacccaggatgttttccagggtgaaaccgaactcttcgaacaacgctggcgccggcgccgactcaccgtaggtggtcatgccgatcacgcggccttccaggcccacgtacttgtaccagtagtcggcgtgagccgcttcgatggcgatacgcgcgctgacctgcaaaggcagcaccgattgcttgtagccggcgtcctgagcttcgaacacgctggtgcacggcatggacacaacacggacgttgcggccttgggcggtcagcttgtcgtacgcctgaacagtcaggcccacttcggaaccggtggagatcaggatcagctccggctcgccaatgcagtctttcagcacataaccgccacggctgatgtcggcgatctgcgcgtcggtacgcacttggtgctgcaggttctgacgcgagaagatcagcgccgaagggccgtccttacgctcgatggcgtgcttccaggccactgcggattcgaccgcgtcggctgggcgccagcaatccaggttcggcgtggtacgcaggctggtcagttgctcgaccggctggtgcgtcgggccgtcttcgccgaggccgatggagtcgtgggtgtacacatgaatcacacgcttcttcatcagcgcggccatacgtaccgcgttacgtgcgtattccatgaacatcaggaaggtagcgccgtaaggcaccaggccgccgtgcagggacacgccgttcatgatggcgctcatgccgaactcgcgcacgccgtagtacatgtagttgccgctggcgtcttcagccgagacacctttgcaacctttccacagggtcaggttggagccggccaggtcagccgaaccgccgagaatttccggcagcagcgggccaaaggcgttcagggtgttctggctggctttacggctggcgatggtctcgcccttggccgcgacttcggcgatgtaggccgaggctttttccgagaagtcggcaggcaggtcaccggccaggcggcgaaccagctcgttggccagctccgggaattcggcggagtaggcagcgaaacgctggtcccactcggcttcggtcgccaggcctttttccttggcgctccactcggcgtagatgtcggccgggatttcgaacgggccgtggttccacttcagcgcttcgcgggtcaaggcgatttccgcgtcacccaatggggcgccgtggcagtcttctttaccttgcttgttcggcgaaccgaaaccgatggtggtcttgcagcagatcagggtcggctgctcgctcttgcgggcagtgtcgatggcggtcttgatctcttccggatcgtggccgtcgacgttgcggatcacctgccagttgtaggcttcaaaacgcttgggggtgtcgtcggtgaaccagccttcgacttcgccgtcgatggagatgccgttgtcatcgtagaaggcaatcagcttgcccaggcccagggtaccggccagggaagcgacttcgtgggaaatgccttccatcatgcagccatcacccaggaacacgtaggtgtggtggtcgacgatgtcgtggccagggcggttgaactgcgcgcccagcactttttcagccagcgcgaagccgacagcgttggccaggccttggcccaggggaccggtggtggtctcgacgcctggggtgtagccgaattcagggtggcccggcgtgcggctgtgcagctggcggaagctcttgaggtcatcgatggtgacgtcgtagccggtcaggtgcagcagcgagtagatcagcatcgagccgtggccgttggacagcacgaagcggtcacggtcggcgaacgacgggttgcttgggttgtgtttcaggtagtcacgccaaagtacctcggcgatatccgccatgcccatcggggcaccgggatggccgctgttggctttttgcacggcatccatgctgagggcacgaatggcgttggcacgctcacgacggctgggcatcgctgatctcctggggtttgagaaaaagaaacggaaaaaaggaccggcattttccctcagccaccgcctgcgggcaatgacagatagtcacttgacggtgtttttcctgcggtttggccggcaatcgcttgcagaaaagcgccactgcttcgtctaaaggttatagcggctgcttataaccaccgattatcgaccaatatcaaaactttttgatattggccttgcggtgatttccacccgtcactagactgctggccttatgaacctatctgcgcccaccttgcgtcccgacgacggcgatgaactggcagccttgtgcaaggccgcgggtgatccgttgcgcctgaacgtattacgcgcgctgtccaacgattccttcggcgtgctggagctggcgcaaatctttgccatcggccagtccggcatgagccaccacctcaaggtcctgtcccaggccgacctggtggccacacgccgtgaaggcaacgcgattttttaccgccgcgccctgccccacaccgagttgcttggcggcaagctgcacgccgcgctgcttgaagaggtggacggtttggggttgcccagcgatgtacagtcgcgcatcgcccaggtccacgggcaacgcgctgcggccagccaggactttttctcacgggttgccgagaagtttcgcgcccaacaggacctgatcgccggcttgccccaataccgtgaaagcgtactggcgctgttggacaagctggtcttcagtgatgaggcgacggcgttggaagtcggccctggcgatggtggtttcctgccggaactggcgcgccgctttgcccaggtcacggcgctggacaacagcccggcgatgcttgaactggcgcgccagctctgcgagcgcgaagcgttgggcaacgtcagcctgcagttggccgacgcgttgaatgacaccaacctgcgggccgactgcgtggtgctgaacatggtcttgcaccattttgccgcccccgccgacgccctcaagcagatggcaaatttgctgcaacccggcggtagcctgctggtcacagatttatgcagccacaaccagagttgggccaaggaggcctgcggtgatctctggttggggtttgaacaggacgatctggcccgttgggccaccgctgcgggactcgttcccggggaaagcctctatgtaggtttacgtaatggtttccagattcaggtccgccattttcagcggccggctggcgacactcaccatcggtaaatatcaggaaaacatcgagatgagcgaatactcccttttcacctccgagtccgtgtctgaagggcatccggacaaaatcgccgaccagatttctgatgcggtgctggacgccatcattgctgaagacaagttcgcccgtgtggcgtgcgagactctggtgaaaacgggcgtggcgatcatcgccggcgaagtgaccaccacggcctgggtcgacctggaacagatcgtccgcgacgtgatcaccaagattggctacaacagctccgacgtcggcttcgacggcgcgacctgcggcgtgatgaacatcatcggcaagcagtcgcccgacatcaaccaaggtgtagaccgtgccaagcctgaagatcagggcgccggcgaccagggcctgatgttcggctatgccagcaacgaaaccgacgtgctgatgccggcaccgatcaccttctcgcaccaactggtgcagcgtcaggccgaagcgcgtaaatcgggggccttgccatggctgcgcccggacgccaagtcccaggtgacctgccgttacgaaggcggcaaagtcgtcggtatcgacgccgtcgtgctgtcgacccagcacaacccggatgtgtcctacgccgacctgcgcgaaggcgtgatggagctgatcgtcaagcacgtgctgcctgccgaactgctgaccaaagacactcagttccacatcaacccgaccggccagttcatcatcggcggcccggtaggcgactgcggcctgaccggtcgcaagatcatcgtcgacagctacggcggcatggcccgtcacggcggtggcgcgttctccggcaaagacccgtccaaggttgaccgttccgccgcctacgccggtcgttacgtggccaagaacatcgtcgcggccggcttggccgagcgttgcgaaatccaggtgtcctacgctatcggcgtggcccagcctacgtcgatctcgctgaataccttcggtaccggcaagatcagcgatgacaagatcgtcaagctggtgcgtgagatcttcgacctgcgcccttacgcgatcaccaccatgctcgacctgctgcacccgatgtaccaggaaaccgcagcctacggccacttcggtcgtacccctgcgcagaagaccgtcggcaacgacaccttcaccacgttcacctgggaaaaaaccgaccgcgccaacgacctgcgcactgctgccggcctgtaagcacgcgtcacaccaaaagccccgccgggttcgcccggcggggctttttattgtcgaatgattttcggagggcgcttacattttttggatccaatgcttgcaggccaaatgatggccctctagaatccgcgccctctcgggcccttcaccttacttggatattgccctgcgccagcccgggatacataagcgcgcaggcaatcgaacattgaggttttcatgcgcatttccacgctcgcccctgccgcccttctgctcagcctgttggccctgcctgcccacgccgccgatctgagcgccctgggtggtgccctgagctcccaactgagcggcacttccggcaattgccagcagcaagccaaagacctgcaagccaagatcgatgctgccgaggccgccaacgacgcgctgaaagtgaaagcctttaaagcggcgcaggaccaggtcaacaaaggttgcaacaaattggctgagtcccaggccaaagtcgacgccaagcagcaaacgcaggaagccaaggctgacaagaacgatgcagtgaaagccttgggcggtctgttcaagtaagcagaaacacccggtaaaaagccccgcgccgtcggggcttttttgtggctgtgtggatcatttaggctgggcaccctttccgagcaaggatgctcatgatgcggttactgattgctcttttactcagcgccctgcctttttcggcgtgggctgaagattgccccgaggacgctcgatcacaggtcagcaccctcgctgaacagatcaagctgtgggatgacagctatcatcgactcggccaatcccccgtcagtgatgagctctacgatcaggcccgactgcgcctggcgcactggcgagaatgctttgcccaacccgcgccagcggcggataacccactggccaccgcgcggggcacgcaggctcacccgatcgctcataccggcctggaaaagctgctggacgaacaggctgtcgatgactggctcaagacccgccaagacgtgtggattcaacccaaggtcgacggtgttgcggtgacattggtgtatcgcaagggcaagttgagccaactcatcagccgaggcaacggcctgctcggccaggattggtcgactgccgcgcgccaaatccccggcatcgtccagcaactgcctgaccccattgacctggtgctgcaaggcgaactctattggcgcctcgacgatcatgtgcagtcaaccgacggcggggtgaacgcacgcagcaaagtggccgggctgatgcaccgccgacagctgagccacgccgaggctgccggcatcggcttgtttgtctgggcctggcctgacggcccggctgacttttccgagcgcctggcgagactggcacgatggggcttcaccgacagcagccgctacagccagtcgatccgaaacatcgctgacgccgcacactggcgcacctactggtacaaccaacctttgcccttcgccagcgatggtgtggtgttgcaccaggcgtcgcgcgcgccagccaaacgctggcaagtcagcgcgccttactgggcggtcgcctggaagtacccggccgccaaggcactggcgctggtgcgcaaggttcaattcaacatcggccgcaccgggcgcattaccccgatcctggagctggagccggtgcgactggacgatcggcagatcagtcgtgtcagcgtcggctccctgaaacgctggcatgcgctggatatccggcccggtgaccaggtgtccatcaccctggccggccaagtgattcctcgactggaccaagtgattctgcgcaacgagacaagggtgccggtgcaagcacccaaccctcgagactttcattccttgagctgctttcagctggcccctggctgcgaggagcaattgctcgcccgcctgacctggctgagcggtaaccagggtttggccttgccgcacgtagggcgcgaaacgtggaacatattgatccaggccggtctaatcgcaggctttctcgattggttgaccctggatgcggcagagcttgctaacattgatggcttcggtgatcgcagccgtgcgcgattgctcgagagcattcaaagcgcacggcaacggccttttgcacaatggctcaaagccttgggcttaccgccttcagcacgcaacgatctggatggcggctggcaaaccctggctgccaaagacacccaggactggctggctaccgacggcatcggcgcgggccgcgcggcgcaactgagcgctttttttcgcgacccgcaggtacaagcattggctgaaacattacgtgtggcgggaatcgacgggttttgaacccggctcgccacctttaaccccggcagaattcatcctgccatttgattgcgactctggagccttacatgaaattcctcgcaccgtttgccctgctcacctttgcaagcctcatgagcgccccgctgctggctgccgaagaagcgccacaagtgacaggctgcgccgccaagcgccaggccatcagtaatcagatcgaccaagccaaggcccatggcaacagtgaacagcaagccggcctggaaaaagccctgagcgaagtcaccgccaactgcaccgacgcgtccttgcgcaaagagcgtgaaaacaaagtgctcgacgccaagcacgaagtcagccgccgtcaggccgacctcgacaaagcgatgaaaaaaggcgacgccgacaagatcaacaaacgcaaagacaagctcgcccagtcgcgcaaagacctgcaggaagccgtcgaagaactcgaccagtaaaaccggtcagtggtcccggaactgtttatggcaggccgtgcaggcatcttcgactttctgcacggcaggccccaggttgctggccttgtaaggctgcacctggcttgcgatcaccaattcaccggtggccgcttcaaggtttcgggccagctcctggaaacgtgcctgttgctgccacacgtcatccttggcgctggtgtgatcttcctcgcgcacgcttgggaaatgcttccacggttcgtgggacaacgcatcgagcttgaccgcgccttcggcgaatttagccccgtcgaacgggatacgcccacgcaacataccgcccaggtcttcaccggtcttaagcatctgtttgaaaatcgccttgcgctgacccaaaggcgagttcggatcgacaccgccgcaggcggacaaggtcaggcaggccagcaataccagggtcagttttttaaaagtcatcatggcttcaaggtcacgggaaacggcggccagtatcctcgccccgcccgcaaagaccaatagccctattaataataagggttgcccgccgacgttgaagcgcgggcaatcgcttcaggaattacgtgcatgaatgtcacctcgaaaccttggagccgccgcctggcgtgggctctgccgatgatcgcattgctcgccggctgcgatggcggcaaagacgccggcaaagatgaaaccgttaagccccacgctgtcgccacctacgtgagcgcaccgtgggaggcgctgcccaccgtttccgacagcgacctgctggccgggtttgaatcctggcgtagcgcctgccaacgcctcaaggctgacccggtctggggcgcgacctgtgcagcagcagccgccgtgccgggcaatgccgtggcggttcgcagctttctcaaggagcgcctggatgtgttcggcctgcgctcggctgacaacacgccgaatggcttgatcaccggctactacgaaccggtgtaccccggcagcctgaccgagactgccaccgcccatgtgccggtgtatggcgtgccggatgacctgatcatcgtcaacctggaaagcatctacccggaactcaagggcaagcgcctgcgcggtcgcctcgaaggtcgcgtgctcaagccctatgacgatgccagcaccatcaacggccaaggctccaccgccaaaccgattgcctggctgaccaacccgatggacctgcaattcctgcaaattcaaggctccgggcgtattcaactggccggtgggcgccaactgcgtgtgggttacggcgaccagaacggctacccctaccgccctatcggccgctggctggtggagcaaggcgagctgaaaaaagaagacgtgaccatgggcgccatcagcgcctgggcgaaggctaacccgcaacgtattccgcagctgttggcgagcaaccccagctatgtgtttttcagcgcgcgccccgacagcaacgaaggcccgcgcggctccctgaatgtgccgctgaccgccggttacagcgtggcagtggatcgcaaggtgattccgctgggcagcctgttgtggctgtcgactaccaaacccgacggttcgccgatcacccgacctgtcgcggcccaagacaccggcggggcaatcaccggcgaagtgcgcgcagacttgttctggggcaccggtgaagcggcgggtgagttggccgggaatatgaagcagcaagggcagatctggatgctgtggccaaaaggcgcggcgctgccgcatgtgccggacgcgcctgccgggacctgacagcccgccgagaagcaaatgtggatgagaacttacgtggcgagcgggcttgctgtggcgagcgggcttgccccgcgttggggcgcgaagcggccctaaagccaggcgccgagtttcttctgaaagaactcggtgtgcccattggggccgcttcgcagccc
